United States Patent 10,233,495 (METHODS AND COMPOSITIONS FOR SCREENING AND TREATING DEVELOPMENTAL DISORDERS) - sequence listing, part 141

SEQ ID NO: 709 - DNA, 589619 bp, Homo sapiens
accacataatgaaagtgcatggaactatttgaaagggtaagaggttgtttttgctttttttatatataaaaaagaagtggctatatgatgcatcatggagtgtattccataatcagattccaaaaggatagtaaataatttttcatttttctgaacctaagagcagaagtataacagcattatggaaactctctgggagtttgcccttctatgcacctcccaagtacctaccaacactgttttcagaataatccaccagtaaataatgccattttaattgtatttaagaatcctgtagtctttatatcaaagaatggaacacacacacccccaggctctagttggctcaggaacacagtaaagcggggtagtttacaggtagattttgccagtgggcagccaacctttctgttttcatttctagagatctccgccttcaggttaacctactcctcaactagaaaaggtttcacttgcctggccactgacgtaactaagctccttgttgaacataagaggtcttcaaggaaactaggctcaaagagcacaaagtatggaaccagttacccttggagatgtgtcaggggaggtgcctgtagtatttggagagctcgagggatgagaagccatctcaagagaagacgagggctgggcatgttagctcatgcctgcaatcccagcactttgggaggccaagatgggcggattacttgaggctaggaggtcgagaccagcctggccaacatggcaaaaccccgtctctactaaaaatatacaaattagctgagcatgttggtgcacacctgtaatcccagctacttgggaggctgaagcacgagagttgcttgaacctggaggtggaggtcagagtgagccaagatcacaccactgtgccccagcctgggcgacaagagaccctgtctcaaagaaaaaaaaaaaagaagaacatctctcctggttttgtccttcactttttaagatgatttattttgtgtgttgtacagtttaagttataaatgaacacttttaaacttcatttttaaaaactttttctacttagcttgtaattatcctttttttttttttttttttggagacaggatctcactctgttgcctaggctggagggcagtggcatgatcgtggcccactgcagtctcgatctcctaggctctagtgattctcccacctcagcctcccaagtagctgagactataggtgccaccactaggcatggctgatttttaaaaaaattttagtagagacgagatcttgctattttacccaggctggtcttgaactcctgggttcaagtgttcctcctgcctctgtttcccagagtgtttcccaggcatgagccactgcacctggccagctcttaattaactaatgatctatgataagactcatgtaatttaaaagtttcattatagtttcagcgtcattcattcaaaataactctccttttcttgtttgtgtttcagggtttattttctcttgatctttctactgcttttgttcttccttcacaaaatcaagtctttgttttttgttgttgtttacaggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagaggtaagctggtggggctcagtgctgtcatttttggtatctcagaattgatctgcccaataccactaatatccatgtcccctttcaacatcgttcctcagaattcagtgcagggctatttctggttaggggcagcattgacatcacttggcaacacagccggtgactcttaatagtgtgtcttcatttgaatgtgatttgagttaaattgtattggctcaaaggcatttgcgcttgaaattgaattacatattactttaatttttatttttcattttcagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctaaaaacaatgccatagaagtttgattttttaatagcattgaactatatattatacaagacacattgtctcagcttagaaaagcatttgagaaagaaaatattgctataaaactgtaaactagaaacatgatgtgttggaggaaatgttaaaatgtaaattggtcagttcttgactgaaagtgacaaaatccactcaaggtagtttaaacccaaagggtttattcaggtttataaatatctcacagaagaattgcctgatcttttagaaagacattcccaaaccatgctacacaactggaccgtcccgttgctgctgcctgtgccagaatcaggaaactgctggatgaggagtgaggaagccacgatcctggctgccagctccaggactgtgctgtgtctgcacgttccacgcaaagcacatctgctgcttttcccatgtagtgtggttccaaattaaaggctcactgcagtgcatctgattggaaggaaccaacaggatgtcttaaaagcttaactgcagaggaatctgggaagtgtagtttgtagctttctagccttttatgatgcaggacgccatgccaggaaggagttgggagtggttagcaagctagcttgctgtacctgcacttaatctcactttatttatttttatatattgattttttgtttacaaggagtcccactctgtcacccaggctggagtgcagtggcgtgatcgcagcttactgcaacctccaccgcccaggctcaagcaattctcctgccccaccatcccgagtggctggaattataggtgcccgccaccatgcctggctaatttttgtatttttagtagagacggagttttaccatgttggccaggctggtcatgaactcctgacctcaagtaatctgcctgcatgggcctcccaaagtgttgggattacaggcatgagacaccaggcccggcctcagtctcactttatctgtaatttttgttcaatgtcaaagcaccaaaatacaactaaggaaatcatacagcgttacatagtcatcctttctcaagataaatttaggaaataatattttaatactttttgaagaaaatatatgtagtgttatttctaacattttacatgtttttgttatttttagaatccaaaaatttccagttttatttttgaagctgccataaagtgccatttccatgtagaccatttcaaaggtgtcataaggatcaaaagctacatagaaaagttctcataagatagcaattactctctgccgggcacgatggctcacgcttgtaatcccagcactttgggaggccgaggcgggcagatcatttgaggtcaggagtttgagaccagcatggccagcatggtgaaacccccatctctactaaaaattcaaaagttagccaggtgtggtggcaggcacctgtaatcccagctacttgggaggctgagacaggaaaattgcttgaacccaggaggtggaggttgcagtgagctaagattgtgccattacactccagcctgggcaatagagcgagactcagtctcaaaaaaaaaaaaaaaaaagcaattactctcagaaactataatcggtgacccaaaactgattggatttgggactttggactcaacagagctcatagagacagcttaataaaaagcatagtgaggccgggtggagtggctcatgcctatagtaccagcactttgggaggccgaggcaggaggactgcttgagccctggaattcaagacctgcctgggcaacagcaagatctcatctctacaaaaatattttttaaagttattagtgaagagtggtgtgcgcctgtagtcccagcaacccgggaggctggggtgggaggatcacttgagccagggtggtccaggctgcagtgagccatggtcgtgccactgcagcctgggtgacagagtgagactgtgtctcaaaaactgtttaaaaaatgagtttgtcatttcaaggaaaacaacggaatgttgccagtgataaaatgtgagcttgcttgcttgcttttttttttttttttgagacggagtttcactcttgttgcccaggctggagagcaatggcatgatctcggctcaccacaacctccgcctcccgggttcaagcgattctcctgcctcaacctcccaagtagctgggattataggcgtccgccaccacgcccagctaattttttgtatttttagtagagacagggtttccccatgttggcgaggctggtgttgaactccagacctcaggtcatctaccagcctcggcctcccaaagtgctgggattacaggcatgagccaccgtgccaggccaaaaatgtgagctttcaagtgacaattttaggctggacgtggtggctcatgcctgtaatcccagcactttgggaggctgaggcaggtggatcacttgaggtcaggagtttgagaccagtctggccaatgtagtgaaaccccatttctactaaatatacagaaactagctgggtgtggtggcacgcacctataatcccagctacttggggggctaaggcaggggaatcacttgaacccaggaggcggaggttgcagtgagccgagattgcaccactgtactccagcctgggcaacaaagtgaaatttcatctcaaaaaaaaaaaaaaaagtattaattctcaggggtttggagaatttcctgttatctctgttatttctagttggttttattttgttttagtggtactccaggggttacaaaatattcaacttttcacagcctatttagaatattttgtcacttcagttggcatatggaaacattaccaccatatgtctccttaccgttcaccatttcttacattgaaaaccccatcagaggctgggcgcggtggctcacgcctgtaatcccagcactttgaagaccgaggcgggcggatcacgaggtcaggagatcgagaccatcgtggataacacggtgaaaccccatctctactaaaaatacaaaaaattagccgggcatggtggcgggcgcctgtagtcccagctactcgggaggctgagccaggagaatggcgtgaacccgggaggcagagcttgcagtgagccgagatcgcaccactgcactccagcctgggtgacagagtgagactctgtctcaaaaaaaaaacagaaaaaaaaagacaaaaaaaaaaaaaaaaaaacaaaaacccatcagataatcttataatacttttgtattaaaccaccaaacatattttaaagaactcaagaaaagaaggagagtgtatcgcatttacccagttatttatattctctgttattctttcatttctgttattctgtccaaagaactttctcttttttttgagatggagtctcactctgtcgcttaggctggagtgcagtggcgtgatctcagatcactgcaaactttgcctcccaggttcaagcaacctcagtgcctcagccttgccagtagctgggattacaggcacgtgccaccacgcccagctgatttttgtatttttagtagagatgggatttcaccatattggccaggctggtctcgaactcctgacctcgggtgatctgcccgcctcagcctcccaaagtgctgggattacaggcttgagccaccaaagaactcttttagcagttctgttagagtaggtctgcaggctacaaattctcttagttttccttcatcttagtttatttcaaggttattcctgaaggatgttttcactgcatatggaattctgggcttgcaattcttttctttcagcacttgaaaaacgttgtgccactttggtcttcatgatctcagaggataaattcactgtcattaggattgtgggtcacctacagctcgtggcatttctctttggctgttttcaattttttttccttgtctttatttttcagcagtttgattttgatgtgtctgggcatggatgtctttggatttattgcatttggggtttgctcagttttttgaatctgtaggttggtgtttctttcccaaacttgggaagttttcagccattatttcttcaaaagctttttagtgctttctttctcatctgctttgggattctgatggcataaatattagaccttttgttatgtcccacaggtgcttgaagttttattaattttcccctcctctctgttggtcagtttggataatttctattaatctgtcttcatgttcactgactcctctgtcatttccattctgccattgaatctatccagtgagttttaaaatttgattattgtacttttctattttaaatgtttatttggttcctcttactttctccaagttttttactcatactttcttttttaaaattattattttttatttgtttgagacagagtctcgctcggtggcccaggctggagtacaatggcacgatctcggctcactgcaacctccacctcccaggtacaagcgattctcctgcctcagcctcctgagtgcacctgccaccatgtccggctaatttttgtatttttaatagagacagggtttcaccatgttagccaggctggtctcgaactcctgatctcaagtgattcgcctgcctcagcctctcaaagtcttgggattacaggcgcgagccactgtgcccagccccatactttctattttaacttttgtttcaagaatgtttataattttttgagcattttcataactaatgtctttttcagataatcctaacagtcattttatagttggtgactcttgattatcttttcccatgcaagttgagatttttgtgatggttcatatgcctagcaattttgtatcctgagcattttgaatattatgaggctctaattcttgtttaaatcctatggagaatgttggcattttaattttttttttttgagaaggagtcttgctctgtcactcaggctagagtgcagtgctgtgatctgggctcactgaaacctctgcctcctgggttcaagtgattcttgtgcctcaaccttccgggcagttgggattacaggcatccgccaccatgcccggctattttttttttttttttttttttaagtagagaccgggttccaccatgtttaccaggctggtctcaaactcctaacctcaggtgatctgccctccctaagtgctgggattacaggtgtgagctaccgcgcctggccaacagtttaatttaagcaagcacatgaactagttagggacagcctgcaggttccgatcttcttctggggttcatgttccaaagtgagttctgtgttcataccctctgtggggctatttggatctgtctcgtggctgcatcctcccgtagtttggtacctgaacaaaaatctgttcatgagcacagttctctgagtgtttggtgtgctcgttaagtcgatgatacgcaggtcagcgatgagcccaagagttcaaaaacaactctgtgaggttgcttgccagatgctctcaccttccgctatcttctcagtgtttttaggttccctcaggtttcagtgcgctggtctgaaacttcccactttcagtttggcttgggggagctgcccacttccacaattgtgccacagcagtgggaaacagttaaaaacaacaaaacaccaagtttgtgtctgtcctcttggagctgcagtgctactgaatggaaaggactatctctttccctcagacttttggctgctgaagctttttgctctggccttgggcttgactgggggctggagtgcaaagaaaagaagaaaatagaaagaacagggaattttcttcactccctctgagggttaggagtttccttttctgctccacgagccagaatcagagggtttctcccgagtctctgtgtgtgcccccgacactcagttccaggctttggactaccttcagcttgaagatgggtgacacaaccagtttgatggtgcgtcaaattctgctgttctttttatttttaattttttgtttgaatttaattcctctaatttttcatcagtgttaaaatttcaccttttcccagcacccccaaaaagcctgtgggcacaaaatggtggccacgtggcaaagaactcagcaaggagagctgctggttggtttctatctttgtttgtttgagacggagctttgctcttttgcccaggctagagtgaagttgttggggaaaccagccccacaccacccggcgggtaccccgagtccagcgaagacaaaggaattagaataagagtttaaaaggcgggtccgggggaccggagcgttggaggcttgctcacggccccgagctctcggcctccacccaatttattggtgtatattcacactgttgtgcaaccatcacccccatccatctccaggactttaccatcttctcacactgaaactgtgcacccgttagtatttttcatggctatgtggatgtaatataatttctttcagaaacccctattgttatacattcaggtttctttttttctctattataaatatcttttatcagcaatgcttcagcaagatctcttgtgcatacatcttgcagacatattatttctttttctttttttttttttttttttttgagacggagtctcgctctgtcacccaggctggagtacagtggcgcgatctcggctcactgcaagctccgcctcccgggttcacgccattctcacgcccgccaccatgcccggctaattttttgtatttttagtagagacggggtttcaccgtgttatccaggatggtctcggtctcctgacctcgtgatccgcccacctcggcctcccaaagtcctgggattacaggcatgagccacggcgcccggccacagacgttatttctgaaggataaattcctagaaatggatttgctagggcacgtaggaggaattccaatttacactcacttgtatgtgtgaggaaactttcagactctactgtaacgacaggaggtattaccgctgtttgtccatgtgataggcaaacgtttctgttaattttaatactgtttggatagctagtaccggctcagtttttttaacccacaccatgttactgtcttgattctggactttcgcagtgtgtcagtgtagaagcagctaacgcttccgatgtacacaacctagacgttccatgacccagctgacttcgatgctgcaagcctccctttcggtttcccggagcaagcgcccgagtgcgtgttgggctcccggcagggctcctggccggccctcgacggacttccccgcctttgcccagtcctgcccctccgcggaggcttgccaaggtcttgtctgctgcgcttgatgtgtgcagctcagctttactgcgtctaggctaagccccacagtttcttttacagagcgattgtccaacttcaggcatctgggtccccgagtggcgggtctgggccggagctgggaatcagcctttccagcaaggtccctgcagatgccgcgggtctgaggactacgctttggaaggcctcgcagtgcgtctagatctgacagctgctctgcatgagcctggctccaggctgaagcaatagtcggtcaacacaaaatcgttctcccaagttagggaagcagaagccagacagggagactgggtaggtgcgcgctggtaccgccgcggcgttcgctccggcttcagtgcacggccggaggaggacgccagggggcagcagcgccacgctcacccgcccaggacgcgcttccgaacgcgcaagcgcagtaggcccagtgcgtgctggcccggggtggcaggagccgcagaggcttgggctgcaggtaggtgctgcggcgaggggtgagagggcgaaggggcgagggggcgtgcagctgggtttcccgggggaccctgtacgtggcctgggccgcaccccccgcagccccggccgcctgcccgcggcctgtccggaggctccctaggaggctgcgctgggcctgagcggccgtgtccaccgcgcccagcccctatctccgcgtccacccctgcgcggtagcgggacgttaaagaaccagagaagggcccggcgaggtggctccagcctgtaatcccagcgctttgggaggccgaggcgggaggatcgcgtgagctcaggcgagagcagcctgggcaacatggcggaacttctgtctccgtaaaaaagcacttagccgggcgcggtggcgccgcctatagtcttatctactccggaggctgaggcgggagaatgcttgaacccggcgggggcggaggtttcagtgagccgaaatcgcgccactgcacttcagcctgggggccagagtgagaggctgtttctattattattactttatcattattattattatttgagacggagtctcgctctgtcgcccaggctggagtgtagtggcgcggtcttggctcctgggattacaggcgtccgccaccacgcccggctaatttttgtatttttagtagaaacggggtttccccatgttggtcaggctggtctcgaacgcctgacctcaggtgatccgcccgcctctgcctcccaaagtgctgggattacaggcgtgagctactgggtccggcagaggctgtctctgtttaaaaaaacaaaaaccaaaccaaaccaaaacaaaacaaaaaacaaaaaaaccagaaaggaccgaggactctgtctcagctctttgcctttgggtgtttattctgcacgagatcattgttgccaggaggtgttaagtgtaatcatattctcttttttttagaaagcaaaatttcgctgttttgttgcataatcttgtctttgccaccctttgcctttgctatagaaccttaaggctaaataagcgttcagaatatttaaaataatcctcttaatgtaccttgtgctttattggcgcaatggaattctactctaaactgtattggatgacattactctgtgtcttccctagttgtagaaaatatcttgtaagtcggtaaaaactagttttgtccctttgcttttcttttctttttaagctgtaaatgtggagcagtgggtcccaagcctttctctatcaataagccttcctatcagtgtcagaaatgctttgcatttcagtcgtgcctgaatttcttctgcccaacctgccccaccatctttattccttaatgtgcaggctgttttcaggaccagtaaatttcagtggtttttgcttacttctggacacgaaagttcctttagccacacagcctcatgctatgctctgggcggcctactccagaatatgcctgtgaaacaaaaaagcaaatcggggttgaggtgggctgaagtcttctttaagaaaccggcagtcccagggtaccccagcccagcccctagctgaccacgctgggtttgatttagttcaactcccgagcattgcggtatttaggggaagaatgggcttgaggccagaaaacttggctcttctgtgtatagttcagtgaccttagatatattacttcacctctgactcagttgtcttatctgtgaaatgggaataacaacaattacatccacttcacagaattggtgtgaagttgacagtgtataaaagtcaaatgaattttggggtattttttttatttgttttgttttggtttggtttggtttgtttttgccgagagaggattcagaagtgaatgtgaggacttagggatatataaaaggtttttggggcatatgaaatttggattcagcaagaaatgcattaaaggttttctgagtaatgctgagggtccaagagagattagaaaatatgcatttctagagtcccacagagttttgtagctgatgttggcagcctttgagtggaaatgaagaagtggacagggcaagttacatgggtctggtgaatgacaagcagatctgggtttatgatgaagcctctagcctcttcacttgcacaaataccttccaaaaccttgcacaaatcctcttgccaaaactctggcaagaggctcagcacttttacattcataactattcttctcttaaggaattaccactccttgccccaacttgtataagcttcaggccccataaaacctgaatccactagtggcaaggaaggattggtgggaggttaggggtaaggagggttggagggttgaaaggatttatcgcagggtttgagctgggaaacttggattggagaaggaggtggcagatgagggtcctcagaagacaggagccgtgaggagaggaagagcggattccgtggagcgaacacaggagagggaaagcagcctgtgcggctgaggccatgaagagggagaggtgcagagtgaccaggcagttggtgcgtctttgccgagtacccgctgtgtgccaggcactggggtgcagtggtgaacaggacaggcaggcaggcttcttggtgctcagaatctagaggaagccggggcctgggtatcccagaaagggagcctttgaggaaagctcaggggccagagagtgtggtgcagggagggtttagggaagcagataggggctagatttcaggaggccacataagagtttggacttgatcctgtgggccgagtggggggctgttgaatgttaagcaaggtgggatcagatccgtgctttagaaagctctccctgcatgggccggacatggtggctcatgcctgtaatcccagcactttgggaagccaaggtgggcggatcacgaggtcaggagattgagaccatctggccaacatagtgaaactccgtctctattaaaatactaaaattagctgggcatggtggcacgtgcctgtaatcccagctctgtaatcccagctactcaggaggctgaggcaggagaatccctttaacaagggagtcagaggttgcagtgagctgagattgtgctatagcactccagcctggtgacagagtgagactccttctcaaaaaaagaaaaaagaaaaaaaagaaagctctccctgcatgtatcagagaaacttccatgtatgcctggggagatgtatacacagcttgtctcactaattgtggaaaagtcaaaccagttgaaaatagtgaactgagttttgtgcatctgcatggataaatctcagaaatgtaatgttgagcttttaaaaaaaactggttgcaggaggataataccagcccatcactgtttgtataaagcttgaaaacatatgtatgatttatgggcacatacttgtgaaaataagcatgtatgagaagcggagtttggtaacccatccctgtagtcagtcccagctgcttgggaggtggaggcaggaggatcacttgagtctagcctgggcaacatagtgagactccatgtcttaagtagatagataagtaggtaggtaaatagataagatcgattagatagatagacagcatgtataggaattatatacaccagtggttttcagactttagcatgcatccaaatcacctagaggatttattaaaacacagatgttcatttctgattcagtaggtttggagtgtggacccaagaatttgcatttctcccaggttcctgggctatgacgccacaggtctggggagcacagtttgagaatctctgatgtccaccaacttgaagatagtgatcacttcttgagggggagtagaattggatggggaggagtccagagggtcttcaactctatttgtaatatttaatttctttaaaaaaagatctgaaaaaatgatgcagtgtgacttgacaaagctggatgaatgcttatgattttttttttctctgtgtgtgaaacacttaaagaaaaaggatcctgtttgctgtgtaatcctgagaatggactgcaagagaggaaaaactgggcgtctgcttgggaatctattgtggaaacccaggtgagaggtgctgctggctcacgcagcggggtggaggggaagggcagcaaggaaggagatatgcaagcagttgtgagggaggttttggtgggagcattgactgcatgtggtaatcggttggtttagagtttaggggagggaggaatcaagtcacacacacctggtctgtaacttgagtgggtggttgggtcatgagcccatgacagagggaaccctggaggaggggcctgtggggactggggagttctgcagtggacatcccataccttgataggccagtgagcaaagcataggagagacctgggctgcagtgcagacttagaaagcagcagagttcagatggctgctagtgtcccaggtgtgggtgaggttacctgggtctttggcagacctggaggaatgccatcacctaaggcagggcttggccaaccacagcttctgcttgtttttgcgtagcctgagagctgggaatgcttttatctttttaaatgttagggggagacttcaaggaagatataattcacaaaccataacatttgacattttaaagtgtacaattcagtgatatttagcatatttacaaggttgtacaatcatcatcactgtctaattcaggaacattttagccaaaaagagaccccatccctgtcagcagctattccaccccctgcctccccagcctctgggagccacaaatctatgttctgtgtctgaatttgctgtttctggacatttcatgtaaatggaatcttacagcatgtggcctttttgtcaggcttatttcactgagcatgatgtttccagggttcacccatgttgcagcatgaattagtgctttattttttatggctgaataatattccatttatggatgtaccacattttgtctatccattcatctgccaatggacacttggcttgtttccactgtttggcagttgtggataatgcttccgtgaacattcatgtatgagtgtgtgtgtgagtgtgtgtgttttcataggtacatactgggcagtggagttgctgggtcgtgtggtgactgtgcttaaccttttgaggagcggccagactgctttccacagtggctgcattttactttctcaccagtgatgtttgaggatttcagtttttccacattcccctatgttgttactgatttttgtattatagccatcctcatgggtgtaaaatgccatcttgtcacacttctgatctgcgtttgccttgatgactggtgaagctgagcatctttcatgtatgtgcctgttggccatctgtgtatctactttggagaaatgtctgttcaagtcctttgcccattttaaaaattttatttgtttatttttttgagacagggtctcactgtcactcaggctggagtgttgtggcacgatcacagctcactgcagccttggtctcctggactcaaatgatcctcccacctcagcctcctgagtagctgggcctataggcacaggccaacatgcctggctaatttttaaatttagtttttgtagacaggaggtcttactatgttaccctggctggtctggaactcctaggctcaagcgatcctcccaccttggcctcccaaagtgccgggattacaagtgtgagccaccaatgcctgaccctttgcacatttttaaattgagttgttttttttgaatcttttgagttgttcaccagacatccacatggagatgtcaaggaagcaagccttgggttctgaggagaggctgggaatggagttttacctttggaagttgtcagcaggcagcgatgaaaagtcctgagtctgggtgagctctcccagggagtgtggcagaggcctgagctctgaactctgggggaccccactacgtggactcagagatgaggagctgccagaatgtagtttcctggaaaccaattatataaggcgtttaaggagggagttatcaatcacggtagatgctattgatagatcaaggaagactggggctgtgctttgactgttgtgtttagtgatgtggaggccacctgtgctgactgtgataaggtcagtttgggtgcagtggcagtgagttggagagaatgagaggacagagctgggcgtggggtttgcctgagctgggctcggggccagtttcatggtaacacactgtttgtagtaataggagagtgcaggaacctggggtggggcttgggaactggtggaaatgctctctgattgcttctgtttttctagtaaaataggatgatctcgttagatgatcagctgagagtgaaggtgggggaacaggtggtacatgtttggagaaggagagtgtgagcttccagctagcctaaggccactcgggacacacctatcacttttattgactcactgcaataagcgaggctgcatactggcgggacttgcatatcttcatcagagggacagagagtcatctgagagggcacagggcaggagtccttcggggcctctctgacctggcccggggcagggagctggggatggaagtgccatgagtgcaaatagggagcagggggtcagaggaacagaggatatgggaatgggtggtggagccgggagagactggagctttgccaatgggggcctgggctgagcagggctcagagcatgtggtgatgagccttatggcaggtgaggctcaaggcccagtgtgtgcttagggaagtgggcagcagagcgggtgagggacccgtgggtgtatcacaggggtagggtgttgaggaagttccaaagcaagctaataggggttatggctggagagaggcccagtgtgtgtgctaatgggggatagtgtggtagaggcaccagggtgtgtgctaataggcctctgaggcctcgtgtgtggtgatgggggtgtgtatggtgttagtgctgtgtgtgtgtctgtgggggcctgcagggtaggagagaatggggtgcttatggaggggaggtggttgaaggactcaagtgctgggtgtgcgcttgtgggggttgtgccgtggtgggtgtgtgcatgcgctaataaaggtctgggtagttggagcccagtgcatgctaatggaacagagctggagggacctcatggagggatctgatggagggaggacggtgggagacctgagcctgtgctagcggggatgaggattgtggatctctgtgaggtagggggtggtggtggtgcgggaagggtcttggtaccgtcagaggcccggtgcgctaagggtcaagttggtgtgaggtgcacgtgtgtccctgagcacgaggacactctaggaaggggcagccggatggtttaaggcgttctagaggctgctactgtgggtttagagccatagaggcactgaagtgtgtgccattgctgggagagtcagcagtgtgaggtctggagtacgctcaagagcgccagaacagtatgagcttgtgtgcttgcatctgtggggtactggaatgtgttgaggttccagggaatactgatgcaggggatgagtagagccgtggaggggataaaaataaatttaaaaggccaggtgcagtggctcatgcctgtaatcccagcaatttgggaggctgacgcaggaggattgcttgaggccaggagttcaaggccagcctgagcaacatcgtgagacccagtctctacaaaaaaaaatacaaaaattagctggatgtggtgatgcgcacctgtagtcccagctactaaggaggcagaggtgacaggattgcttgagtttgaggctgcattgagctatgattgcaccactgcactccagcccgagtgacagagtcagaccctatgtcaaaaaaaaaaaaaaaaaaaaggaagaaaatcatagaattttggagatgagtaaagtttaggcaaatttaaatgaagtagtgttttgatgggctcaaagccatgtagaactgagtgtaaaggggccaagatctagtctggactgcaaagtggtcctctttccttggagactaccaggttaacatagatgtgcaggattatctccagaaactccttatctgaaggtctgccctgtttgggaactgaggttgcttctgtgtgtcagagtgactttgatcctccaggaaagcatgggatgttttatcccaactgataagacttcaaactgcaaaatttctggtagtctgtgattgtagagaacagaatttctaggtagtaaaaaaggagtcttcatccaaagggggtttttgacactttatggctgcagtgtgttctaaggagaaatgccgtttcctgttaactttgtggtttcattgacgtcttgtcccagctctgtatatgggagtggattttgttttctcaaggaggaggtaggaacaagcttcctgtcctggatttttcatggctggctcctctcaggcctctagtcacagtgtgaaggtcacctccttagagaggtctcctgggatgcttcctccagggagttcctacacagttactctctatctttgaacccccatcacaggatgatgatagacctatttgtttacttgtttattgtctgtcttccccactagacttttcccctaagctccagcaggataggaaccatgctggtgtaattcactgtgtgtgaatgtctccagcacccactgcagggctgggcacatagaagctgctcaggacatgttgcgggaatgagcagctggaagtcagtgatggagaagaagagagcagactgggacagagagactctgatgggcttccccacggccctgctctgtcctggggcttgagaacctgaggaaacctggacttgaggcaggaggagggccctgggaaagttggaccgtttggactatggcgatttgtctgggtacatagctgcagtttctgtttacacacttcctgtttggtactttgtggcagggtgtttcccgaccagtccctgggcgccaactagagtatggactgaccaggtacctggatggagacctgagctggagaaggagatgcgcttgggaggtaaccctgcatgtcacagctgtctctgacccagttctgtcccagtgccccagcattccagtgctgtttagctggctcccactggcatggccacatccactgttaaagtctccatatacttccattctgctccattctgcttctgtaaatcacctctgccatccacggtcctacttcaggcttctccgcagccaggcccctccaccatggccttgcacggctccagcggtagagcccacacattatcagtggttacttatcgctggtgtgacatctgagtggtcatctctccaatctcatcgctgttattctagctcatgtacttgtcagctcctgtccgtggtcataaccagggcttcttaataactggtctcccagcctcagtctctttcaccccaaatctacctttcataactgctgaagagtagcttttatttcttaaaactgttgaggggattctgagtacctcccagggaacaggacagctgcttagctgagttcgacagaggccctcagcttcccagcctccacctgctaccctaagcagcctccttctgctgtcctttgtccaccctctgtccctgtcccaccagttgactaatacattttgctttcattttactgaatattcatgagcatctatttaatgcatgctactgtgagtcggacagagtcagacacaaacacctcccacctaacctaatctagaggaacccgcattttagtttgtaataaaaagtaatgattatggaaacagctaacattgggcatttgggataagcctggtgttcgatacctgctttaatccccacggtaacgctgcagcttacaggacccttgagtagaagaggcatcagaacacatttttggaaatgaaaggaagtgaaagctgactgtcatgacttcttgtttcattgtgtattttaggaaattgcagaggccgtcaacatggaaaagcagccccagaacagcaggagaggcctcgccccccgagaggtgccgccagctgttgggctgctgctgatcatggccctgatgaatactctgctctacctctgcctcgaccacttcttcatcgctcctcgacaatccactgtggaccccacacactgtccctatggtcacttcaggataggacagatgaaaaactgctcaccttggctgtcctgcgaggagctgagaacagaagtgagacagctgaagcgtgttggggaaggagctgtaaagagagtgagtccgggttcatttgcgattgctgtcatcctgttatttcgcttaacacagtgtcctccagctccatccatgctggcacggattacggaatttcatcctttgttactgccaaagtgtactccattgcatatgtgcaccacatttgctttggttgattctgtatcttggcaattgtgaatagtgctgcagtaggcataggtttcagcccttagggaagcagtgtggcatccagtgttaggagccctgctagctctacgtttttattgttgagctcaataatcttacatctggcactttatctttttttttttgagagtctcgctctgtcacccaggctggagtgcaatggcgccatctcggtgcactgcaatctccacctcctgggttcaagtgattctcgtgactcagcctcccgagtagctgggactatgggcatatgccaccacgcctggctaattttttaattttagtagagatggggtttcaccatgttggccaggctggtcttgaactcctgaccttaagtgatctacctgcctcggcctcccaatcggactttatcttaataagtaatccaaggcaggaaaaaagtcaaatgcataaaagagtgccatagtgatagaaaactagaaacaaaacttttagaatagttcattaaatgatggtccatccacttgacggaatattctgcaactgttgtgtagttaggaaccccaagaggcaacatgaataaaaccttatgatgataagtgaagaaaacaagatataaaattgtataattgacttttcaactgtgaaattacgtgtatatgtagataaatacaaaaatggtcaggcgcagtgtcttatacatgtaatcccagcactttgggaggcggaggtgggcggattacttaagcacaggagttccagaccaacctgggcaacatggcaaaacccagtttctacaaaaatacaaaaattagcctggcataatggtgcgcactacttgggaagctcaggtgggagaatctcttgagcctggggagtttgaggctacagtaagccatgatcttgccactgcattccagactgggtgacagagcaagatgctgtctccaaaggaaaaaaaaaatatgaaaatgatagaaattgtgctagggtgaaagggggattatgggcaatttcttttcctgtttttcaaactctgtgatggtattatactgatttttaacaatttatttttaattggcatgtaataattatccatatttatggggtacacagtgatgtttccatacctacttacagtgtgtagttagcggatcagggcatatctgccatctcaaacatgtatcacttcttttggttgggaacattcaatatcttctcttctggctatttgagagtgtataatatattgttaattatagtcatcctatggtgctatgaaacactggaacttgcttctcttatctagctgtaattttgtatcctttaacaaatctctgcctatcctcgcctttgctctacccttcccagcctctagaaaactgttaggctttttacttctttgagtaagcttttttaaacttctgcatatgaatgagaacttgtagtgtttaactttctgttcctagtttatttcacgtaacataatgtcctccagttcctttcatgttgccataaatgacagatttccttcttttttatagctgaatagtattctattttgtgtatatataccacattttctttatccattcatctgctgaaggacacttaggttgattccatatcttggctattgtgaatagtgctgcaataaacatcgggatgcacatatctctttttttgttgttgttttttgagacggagtttccctcttgttgcccaggctggagtgcaatgatgcagtctcgactcactaccacctccacttctgggttcaagcaattctcctgcctcagcctcctgagtagctggagttacaggcatgtgccaccatgcccggctaattttatatttttagtagagatggggtttctccatgttggccaggctggtcttgaactcctgaccttgtgatccacccaccttggcctcccaaagtgctgggattacaggcgtgagccacttagcctggctgtgcatatctctttgatatattgatttcctttcctttggatatatacccagtagtggaattgctggatcatatgttagttctgtttgtaattttctgcggaacctccatactgttttccataatggctgtactaatttacattctcactaacagagtataagcgttcccatttctctgcatcttcaccagcatttgttattttttgtctttttgataatggccatcctaactggggtgagatggtatctcattgtgattttggtttgcattttcctgatgattagtaacattgagcattttttcacaaatttattggccatttgtatgtcttctttcgagaatgtcagtttagatcatttgcccattttttgatcatattgttatttttttctgttgagatgtttgagttccttggatattgatcccttgttagatgaatagcttgcaaatattttctcccattatgtagtttgtctcttaactctatttgtttcctttgctgggaagaaggtttttggtttgttataatcccattggtttacttttgcttttttttttttttttttttgactgagtcttgctctatcgcccaggctggagtgctgtgacatgatcttggctcaccgcaacctccacctcccaggttcaagagattctcgtgcctcagcctcctgagtagctgggattacaggcgcccaccaccatgcctgtatttttagtaaaaatggggtttctccatgttggccaggctggtcttgaactcttgacctcaggtgatccgccctcctcgacctcccaaaatgctgggattacaggcatgagccactgggcccagccctcagttataattttgcaaaggcggtttcaatccctccctttggggttttgtagcatcttattcttaaggtgtgggctatgaagatggaaaaaggccattgatcactctagcttcttcatgctgacagggggcatagttggggtcggagttgaccctaaggtgagaggagtagaactgctttgcagctgtctgagtatattcatgcaggccgggctgtggttccaaggctttcgtgacaaaggcagtagtatctttatagttttagtacagcatttaaacagacagtctactataaggtaaataatgagttttaggataaggagtgcaatttccagttttaaaagtaaaggtttgaaagcattagtctggggacttatagtccacaaaaatattaggatttagtctaaattgaagaaaaaaaaaactaacaacatgtgtaccatagtttttggaacataatttttctctctttagtccttatttttattaaaacaaatcacgataggactgatttgttggcaaaataaactttaattttattatgcttggcctgattatttgcataaagcgcatcagtaatactttttttttccgagatggagccttgctctgtcgcccaggctggagtgcagtggcgtgatctcagctcactgcaacctccgcctcccgggttcaagcagttttcctgcctcagcctcctgagtagctgggattacaggtgagtgccaccacacctggctaatttttgtatttttagtagagacagggtttcaccacgttggtcaggctggtctcgaactcctgacctcgtgatctgcctgccttggtctcccaaagtgctgggattacaggcatgaatcagtaatcacctggcaagaatactttttttttttttggtagagatggagtcttgctccgtcacccaggctggattgcagtggtgtgattgtggcttactgcaacctccgcctcccgggttcaagcaattcttctgcctcagcctctcgagtagctgggactataggtgcacgtcgccatgcctggctgatttcttttgtattttagtaaagacggggtttcactgtgttgcccaggctggtcttgaactcctgagctcaggcaatccgcctgccttggcctctcaaagtactaggattacaggcatgagcctctgcgcctggctagaataattattttttacataggctttttaaattgcctttgatggaactctgttccataaggaatctcagataagactttctaaagctgagtccagccataggtttgtaccttcaaatacttatgagttgggtaagttcctctcctcttgatgcccctagataacttggggctcctgggcctgtcagaaagtgacattctatacttaccatgggtcaggaaccctgtacagggactgtgtagacaaagtatgagctcagttttcccaagggcttttactggctttacaagtacaagtcaaggttgattccataaaggaaagcatgccattctagtcaaacccttggtaaaataaccagtgttttcaatagtgtcctgttacaaaagaaaacagattcttattgtatttatgaaaataactgtattgccataaattaagaatactcacaaatagtttttaaattctggagaaatcaagtagaaacaaatatgcgccaaattttattcacaggagtgtactttactcagttgctacaagctgtaaatagcttaaaagaaatttccctgactctgaaaaagcaaagaatcagcagcattttaaacaaaaaggttacttcagacttttattagtttagtccatgcatttaacttctgtttgatatttatgaacatttcagctttccatgagagttctaaaagtttttttcctttattctatgtcataatctccagagttatcagaaacttgcattcaagagcacatatcaaagttttatagctgattataaaaccatcttctaaagaggaccaaattaaaacagcagttatctttggatgagaaaagcattttagggaagccacaaagacacaattaacaaggaaatttgtgaatctgtggcacacaataattcaacacaacagttattactgatgacatatactgagtcatatcagaattgtaggaattttatacagttttgcagcacgtaactttatatcacaaatttatatgaatataacccaaagaaagttaagcaccattttctatttgacagtgtttcctgcatgattttaatacattaaataagctgaatatgtcttttgtactttaggggacttaatttttaaaaattttttattttaacttagagcttgattttgaaaggtttgttaaataccaaacgtttaaaacattggatattacaaaatggagtcttaggtttccgtaagtcattcatttagccaaagtaactcaaaaattttcaaaaggaaaaaccattattctggtaggagactcagctttccaaacaagacccaatgaaggtagcatgaggctgattgcctcctctctctcccctcccccttttttcttttgtagtttacttaaaaggtaaataaaaacctttcattatcttttaatattccataaaaatcctttttaaaagagaaaactgaattttatgtttccattagtgtatttttaacgttaaagccagttttaattacatcttataaatctgtctagttctaattagtttgaccataaggtaagattttttttttattttttatttttttcaagacgcagtctctctctgttgcccaggctggagtgcaatggcatggtctcggctcactgcagcctccatctcctgggttcaagtgattctcctgcctcagcctcccgagtagctgggactataggcatgtgccaccacacctggctaatttttgtatttttagtagagacagggtttcactatgttggccaggctggtctcgaactcttgaccccttgatctacctgcctcagcctcccaaagtgttggtataacaggcgtgagccaccacacctggcttgccataaggtaagatttttatgaatcttttataaccctttacaattttgtttttttcttagaacaaaactgttttaagaaaactctgttgtgcttttattccaatttccaatttatggaaaaactgcataacgtgacttaaactttagccaatatgttcacacacagaatctcttacaattaagtttttataaccctttcacaacttgttcaaacctttagacttttcctatctcatttaaaacagtccgttaacactctaaacttaggcaagaaatccacattcccatgccttctcataatcttttaccaaaagtacattttacttcccttacatgcctcgtgtatagaactgtttcttcagtagtctcaagtgcatattacactgttaactcaatgacttttacttttggtggaaagcctggtgagtaagcaatttcaattacgtaccaggagtggagcctaggacaccagaaggtctgactgtttccagtgtagctagggagtgtggctaactccacatgtctcaggccttacctagctataaagcaggcaagttgtacagtaagagtcatagtggcattttatgaagtatttaacaggcctaacaacctttgaattgtacaacatttcttgcataaattgccttttcatgaatacgttcacaacttacagagaccatctacaacatgcttggactttcagacttttcctaaacatccctctttttaaacagtcattttactttaggaccagattttaccatacaagatcttttcttatataaaatttcttggctgggcgtggtggctcacgcctataatcccagcactttgggaggccggggcagaaggatcacctgaggtcaggagttaagagaccagccaacatggtaaaaccccatctctattagaaatactaatattagccgggcgttgtgctgggtgcatatattccaagctactcgggaggctgaggcaggagaattgcttgaagctgaagccgggaggcggaggttgcagtgagccgagatcgcgccattgcactccagcctggggtacaagagtgagcctccgtcttaaaaaaaaaaagtcttgggggtgaagccaagatggccgaataggaacagctccagtctacagcacccagtgtgagcgacgcagaagacgggtgatttctgcatttccaactgaggtaccaggttcatctcactggggagtgccggacagtgggtgcaggacagtgggtgcagcacaccatgcgtgagccgaagcagggcgaggcattgccccacccgggaagcgtaaggagtcagggagtcccttttctagtcaaagaaagtggagacagatggcacctggaaaatcgggtcactcccaccctaatactgcacttttccagcgagctcaacaagtggcacaccaggagattatatcctgcacctggctcggagggtcctacgcccatggagcctcactcattgctagcacagcagtctgagatcaaactgcaaggccgcagcgaggctgggggaggggcgcccgccattgctcaggcttgagtaggtaaacaaagcagctgggaagctcaaactgggtggagcccaccacagctcaaggaggcctgcctgcccctataggctccacctctgggggcagggcacagacaaacaaaagacagtaataacctctgcggacttaaatgtccctgtgtgacagctttgaagagagtagtggttctcccagcatgcagcttgagatctcagaatgggcagactacctcctcaagtgggtccctgacccccgagtagcctaactgggaggcaccccccagtaggggcagactgacacctcacacggccaggtactcctctgagacaaaacttccagaggaacgatcgggcagcagcatttgcggttcaccaatatctgctgttctgcagcccccgctgctgatacccaggcaaacagggtctggagtggacttccagtaaactccaacaaacctgcagctgagggtcctgactgttagaaggaaaactaacaaacaggacgtccacaccaaaaacccatctgtacgtcaccatcatcaaagaccaaaagtagataaaaccacaaagatggggaaaaaacagagcagaaaaactggaaactctaaaaatcagagcgcctctcctcctccaaaggaacgcagctcctcaccagcaatggaacaaaactggacggagaatgactttgatgagttgagagaggaaggcttcagatgatcaaactactgcgagctaaaggaggaagttcgaaccaatgggaaagaagttaaaaacttcgaaaaaaaattagacgaatggctaactagaataaccaatgcagagaagtccttaaaggacctgaaggagctgaaaaccacggcacaagaactacgtgacaaatgcacaagcctcagtaacctatgcgatcaactggaagatagggtatcagtgatggaagacgaaatgaatgaaatgaagcgtgaagagaagtttagagaaaaaataataagaaatgaacaaagcctctaagaaatgtgggactatgtgaaaagaccaaatctacgtctgattggtgtacctgaaggtgacggggagaatggaaccaagttggaaaacactctgcaggatattatccaggagaacttccccaatctagcaaggcaggccaacattcacattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaatagcggatctctcagcagaaactctacaagccagaagagagtgggggccaatattcaacattcttagagaaaagaattttcaacccagaatttcatatccagccaaactaagcttcatcagtgaaggagaaataaaatactttacagacaagcaaatgctgagagattttgtcaccaccaggcctgccctaaaagagctcctgaaggaagcgctaaacatggaaaggaacaaccggtaccagccactgcaaaatcatgccaattgtaaagaccatcaaggctaggaagaaactgcatcaactaacgaggaaaataaccagctaacatcataatcacaggatcaaatacacacataacaattggtgaatctcacaattatgtgtcttggagttgctcttctcgaggagtatctttgtggcattttctgtatttcctgaatctgaaagttggcctgccttgctagattgtggaagttctcctggataatatcctgcagagtgttttccaacttggttccattctccccatcactttcaggtacaccaatcagacgtagatttggtcttttcacatagtctcatatttcttggaggctttgttcatttctttttattcttttttctctaaacttcccttcttgcttcatttctttcatttcgtcttccatcactgataccctttcttccagttgattgcatcgactcctgaggcttcttcactcttcatgtagttctcgagccttggctttcagctccatcagctcctttaagcacttctctgtattggttattctagttatacattcatctaaattttttcaaagttttcaacttctttgcctttggtttgaatttcctcctgtagctcggcgtagtttgattgtctgaagccttcttctctgaactcgtcaaagtcattctccgtccagcttttttccgttgctggtgaggaggtgcattcctttggaggaggagagacgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtttgcctgggtaccagcagcggtggctgcagaacagcggattttcgtgaaccgcgaatgctgctgtctgatcgttcctctggaagttttgtctcagaggagtacccggccccgtgaggtgtcagtctgcccctactgggggctgcctcccagttaggctgcttgggggtcaggggtcagggacccacttgaggcagtctgcctgttgtcagatctccagctgcgtgctgggagaaccactgctctcttcaaagctgtcagacagggacatttaagtctgcagaggttactgctgtcttttcgtttctctgtgccctgtccccagaggtggagcctacagaggcaggcaggcctccttgagctgtggtgggctccacccagttagagcttcccggctgctttgtttacctaagcaagcctgagcaatggcgggcacccctcccccaggctcgctgcggccttgcagtttgatctcagactgctgtgctagcaatcagtgagactccgtgggcgtaggaccctccgagccacgtgcgggatataatctcctggtgtgccgttttttaagcccgtgggaaaagtgcagtattagggtgggagtgccctgattttccaggtgccgtctgtcacccctttctttgactaggaaagggaatgccctgaccccttgcgcttcctgagtgaggcactgcctcgccgtgcttcggctcgtgcacggtgcgctgcacccactgtcctgcacccactgtctggcactccctagtgaggtgaacctggtacctcagatggaaatgcagaaatcacctgtcttctgcgtcgctcacgctgggagctgtagaccagagctgttcctattcggccatcttgccccttcgatgctttgagatttttaaacccaagattacattaaaagaaccagttgtgcactctcccagtcatctcaaggacacagtacacctgtgtcaggggagctgctcaaagtctggaatgtagatttggggcaacaggtatattaagaagaaagattatagcagagctgggagtcaaatttttttttctcatcgttataatgaaatgacttattgaagggcctgttgtatagtacattaaaaatccatacagtatagcttggatcctgtcagaagagtggatttgattctttctcttaaattattttgtagctctcattttgtgtaacctttgggaggatcccttgtgatgtcttaatgtttgaggctatatttaatgcttaccttctggaaagatgttacatgaacagtctgtttaaagcatggaggaatagtgtccacttcttggcctcttgccagctctgcctcctcatcccttccatcccttctaatcctggacctctcgtcttctgtgcttgtaccccgcatgacgtcatccagccttctggcttcatctgtgcagagactgcttccctgaagttttctatacagctgcctacccgacatgtacctggggtttctgagaggcttctcaaactcaccacgtcacagatctccctcagagcctactcaccttttattatttcctaactccatcagtcctgctgttctggccacctatcttgtcaatatcctgacctctctctcatccaccttcagtacatcagcaagttacattgtttctacttttggaagagacctggaatttgaccactcctcaggcttgcaccaggacccagcccagccccccaaaccaccctgaccctggacttaaattgtttcaccagcctccaaaaatggtctttctgcttcacacttgctccctacctcttcagtctattctgaacacagcactcagaatgcctcttctaaattattggtcaaatagtgtcattcctctgctcaaaatcctttggtgctctctgtctcattctgagtaaaagagcccttgcaacgacaaggccctgcgagacttaacagcctccctccagctctctcctgctccatggtccctgtccggtctactccagcatcagagccatgctgttctggaagcctgtgggcatgctgccactccagggcccttggcccttgctgttttctgtctgggctgtagttccacaaataacaagtggttccttcccttacctccttcacggtcttgctcaaaggccaccccagtgagaagtccttcaaccccgtttaaaattgcaaaccatccctgcttaattcttctctaaagcgcatttctctttccaatatactttatacatttcctatttactttattcattgtttgcctactgcactagtatgtaaatttcatggtggtagggatttatgtttattgacataatgaagacacatttgactacatagcagttaaaatattgtaagaccacattaactaagttaattatattctttttcttttcagagacagagtctctctcttttgcccagtctggagtgcagtggtgcgatcatagcttattgcaacctcaaactccagtgatcctcccacctcagcctcttgagtaactgggaccacaggcgtgtgccaccatgcctggctaattaaaactttttttttttaaagagttgagatcttgttatgttgcccaggccggtctcgaattctgggctcaagtagtcctcctgccttggcctcccaaagtgctaggattacaggtgtgagccactgtgtctggcctaattattttctggatcttgtcttttacatttgcaataaaggatctcataggtaatacattgacccttgaacaatgtggagattaggggcactgatcccccacataataagaaatctgcttatactgtttgattccttaaaaacttaacaactaaaagcctactactgatatcatagttggttaactgtactttatataagtattatatactgtattcttcaagataggtagatttcatgcatgtccgtgtgaagagaccaccaaacaggctttgtgtgagcaataaagcatttaatcacctgggtgcaggcgggctgagtccgaaaagagagtcagccaagggagataggggtagggccatttttataagatttgggtaggtaaaggaaaattacagtcaaggggggtttgttctgtggtgggcaggagtgggggtcgcaaggtgctcagtgggggagctttttgagccaggatgagccaggaaaaggactttcacaaggtaatgtcatcgcttaaggcaaggactggccattttcacttcttttgtggtggaatatcatcagttaaggcaaggagcggccatttacacttcttttgtggtggaatgtcatcagttaaggcggggcagggcaaattcacttcttttgtgattcttcagttacttcaggccatctgggcgtatatgtgcaagtcacaggggatgcgatggcttggcttgggctcagaagcctgacgagagaaatgttattaagaaaaatcataagaaaaaatacatttactgttaattaaatacatttactgttctttaagtggaagtggatccatcatccatcgcaaacgtctttatccttggttttttcacagtgagtgggctgaggaggaggaggaaaggaagaggttggtcttggtatccaaggggtggtaaaggcagaagaaaatctgtgtgtaagtggaactgcgcagttcaaacccgtgttgttcaagggtcaagtatatataaagagctcccagtaattaataagcacaaggcagacaaccctatagaaaattggataaaggacagtgaacagacttttgacagcagaaatacagaaatgcctaaaaagatgacaaatgcctagccttattagtaatcagggaaatacaaattagaagagtaaggtattttcatccattgattggcacaaattacaaacagtggtaataatctggtgtgactaagggtgtattcctaagattctatcatgcgctgctggtgaaagtgcatgctagcacagactttggagggtaatgatggcaatagatatttggtaaattctgtctgcctacctagcttataaaatatttgtgcatgtacatagacatgtaaatataaggctatacactgtagcattgtcattagaaaagggactaacttaaatgtccaggtctttagaaatagatcatataagatcttattaaaggtctttacaaaattatagctacataataatcttaagaaagaatccagtctattttgacagcatcaattccaaattcctggtatttttattatattatactttaattttaaagaaaaaaggtagtagtatctgtaaaagcttactggaaatacacaagtgtaggtattatgcccacactatgaaacattactcagctttaaaaagaatggcctagatctacatgtatatatggaaaggatttctgaggctcagttaaatgaaaaaagagctgcaatgtatgtatgttataacgccattagtataacagcaaacccaaatgctgttttacaagtgtacattaataaataaaggcatagaaaaacttctgggaggatgacagccagttaccaggtttcctttgggtcgggaagtaaaactgggggcagggagacatcctgcctatcctctgtatttgagtttttaccaagaaaagtgttcacgattaattttataataaaaaagtaaagtattttaactgttctttccaaataaaagtcttttagaaaatgattaaaagcaactaaattagaggttgtgagaaatgattcttaaacagtccatgactagcaaattttttatattggaggattcaaatatttgtgtgtgatctcaaagactaatagtatttcataataatatttaataatcttcatttatctgaaacaaaaatgaatgagacacaaatgagggatcaggagccctggggcctgtggctgagcctccccaacttactgttttttttgttgttgttgttacggagtctcgctctgttgcccaggctggagtgcagtggcctgatctcggctaactgcaagctccgcctccacggttcatgccattctgccattctcctgcctcagcctcctgagtagctgggactacaggcacctgccaccatgcccggctaattttttgtatttttagtagagatgggatttcaccatgttagccaggatggtcttgatctcctgacctcgtgatccacccgcctcggcctcttgaagtgctgggattacaggcatgagccactgcggccggccccccacttattgttgaatgtgtagcagcagcttcccaaaagccagcatcgtttttaggtgaaaaatgggcctagaaaaccaaagccattgccagttctggtggtgaccatgcagaggtgggcgtaaggaagccatggatctgaacaaaacctcagttgttcgtattagagccaattatcagattcagtgggatgcaaatctatggagagcgtgtgttcaatatgaaaatttaaaaaaatcttgaacttttagaatgtggtcttatctagtccttaaaaattaggaaatttttagtgcatgtagcagccagagtgaaaaacagcttttttttttttttttttttttttgagacgaagtctctaaccaggctggtgtgcagtggtgtgatcttggctcacttcagcctctgcctcctgggttcaagcaattctcctgcctcagcctcctgagtagctgggactgcaggcgcgcgccaccacgcccagctaattattttgtatttttagtagagatggggtttcaccatgttgccaggctggtctcgatctcctgaccttgtgatcctcttgcctcggctcccaaagtgctgggattacaggcgtgagccaccgcgtccggcccaaaaacagctttttaatagaagttattatccttagtgaaatttctcaaatatgaggattagagagtcttgaaagagttttcatttgaatgttatgagccaatcaaagttatctgggtttttccataatgaacctcccttcttagatccagaaaagatcttcatggtccttgggtctaactccattttatataatatttctttttctttttttttttttaaattcccaatgttagtttttctgaaattttatatatttttgagttaaaaaatttaagttgtaaaagtaatatatgttcatcttggaaaataccaaaagatatgaaggaaaaaaaaatcacccagaatcttaccacataaagacaactaaggcattagcatatttcctttgatttccatgtgctgtaatttaaatttgtctcgttttatgcagttggaacaatattatacaaatggttttgtatacttctcatttgtaacattgctttttttttttttgagatggagtttcactcttgttcacccaggctggagtgcaatggtgtgatcttggctctctgcaacctccacctcctggggttcaagctactcttctgcctcagcctcctgagtagctgggattacaggcatgcaccaccatgcccggctaattttgtatttttagtagaggttttaggttttaggtttcgtcatgttggctaggctggtctccaactcctgacctcaggtgatctgcctgccttggcttccaaaagtgctgggattataggtatgagccaccgcacccagccgtaccattacttttatctgttataactgtataaatatatacattttggtgaccgcatgatatatatatatattgaatgatcctcccacctcagcctcccctgagtagctgggggtacatgtacgctccattacaccctgcttgtttcttaatttctttctttttttttttttttgagacagagtttcactcttgttgcccaggctggagcacagtggcgtgatcttggcttacggcaacctctgcctcccgggttcaagtgattctcctgcctcagcctcccaggtagctgggattacaggcatgcaccaccacgcctggctaattttgtatttttagtagagtcagggtttctccatgttggtcaggctggtcttgaattcctgacctcaggtgatccacccgccttggcctcccaaagtgttggaattacaggtgtgagccaccacgcctggcccaccctgctagtttctaaaaaatgttttgtagagatgggttctcactatgttgatcatgctgctcccatcttttgataagtttcagtgtatgcttttataaataatgtcagatttttattcctggagcttcttacctatttccgattattgccttagatttagatgttagagtctcttgataaataatgcaaaaaactgctttggaaaccataacctttatttgaacaatgacatggcacactgcttgcagaatgagcctggggcaggaatctcctgagtcctgagcctgctttctcttttgtaatcttctgccttctcttgggatttaagcaaaagatcagaggttcttcctttaattacagtgcttcctgcaagcaaatgaaaggtgaaaatccaaggcagaaatgtgaacttgctcttctattagctgtggactctatgagaaggtctagtgtttatgtagcatttcagctcctgcctttacagctgaagtaacaccaaaccacagaacatgcaaaaatgttttccttacatataaatgttcctatttatgatttactatgccaccttttaaaattaatgagtaacattgttacacgtgatgggcagggctctacgccctcatgtaggcttttcggggtctccacacttacccacttttccagtccactcccctgcctcctcttcctccccacccactgtgtggtggtccattggaactggcagtctacttgccactcctccctgccatgcagttatatggagtcttccctcctgagctagcactcccctgccctacattgaatctgcaggtccccctcgttctatgagaccagcttcccaaagccttccagcaccctctgcagcagctctcagtgtcctgcccagaggcaatcgcttcctgccctgaggttccacccactaatgtggcacttgccttgctgaatgctgtgtttgctcatcggtctctcttcataactagacggagagcaactctacgatggggtctgcaccttgttaatttctgtatcttctgcagaacacctgccacttaaaagatatttgttgttctttggtcactaaattaggtgagagttcaggcctgatgctctctatggctttgttgcaggtctttctgtctgagtggaaggagcacaaagttgcactctcacagctcaccagcctggagatgaaagatgatttcctccatggactgcagatgctgaaatctctccaaggcacacatgttgtcacgctgcttggctattgtgaggatgacaacactatgcttactgaatatcaccctctaggttccttgagtaacctggaagaaacactaaacctttcaaagtaccaaaatgtgaacacgtggcagcacaggctggagctggccatggactatgtcagcatcattaattacctgcaccacagccctgtgggcacacgggtcatgtgcgactccaacgacctgccgaagacactgtcccagtatctgctaacaagcaacttcagcattttggcaaatgacttggacgccttacccctggtgaaccacagctccgggatgctggtgaagtgcggccacagggagctgcatggggatttcgtggctccagagcaactgtggccctatggagaggacgtgcctttccacgatgatctcatgccctcatatgatgagaagattgacatttggaagatcccagacatctccagtttccttctggggcacattgaagggagtgatatggtccgattccatttgtttgatattcacaaagcatgcaagagccagactccctcagaaagacccactgcccaggacgttctggagacctaccagaaggtcttggatacacttagagatgccatgatgtctcaggcaagagagatgctgtgaaaaccagtccagccaatgaaggtgggattgaagggctgaatggaagttacagcattctactctgatggtggagttttttgcctgagtttcgtgttttattgttttttttatggcttagccatgtggttcgttgtccacatccacatgtacgtttgtatgtagtccacattggttgttagatttttttttttttctttgagatgcggtcttgctctgttgctgaggctggagtgcagtgatgtgatcttggctcactgcagcctctgcctcccaggttcaagcaattctcccacctcagcctcctgagtagctgggattacaggcacaccaccacgcctggctaatttttgtatttttagtggaggtggggtttcaccatgttggccaggctggtcccgaactcctgacttcctcggcctcccaaagtgttgggattacaggcatgggccactatgcctggccagttgttagatttccatggatttgtagtttccaaagtttctcgttattgatttctacttttcttccattgtggtctgagaaggtacttgatatgatttagatttttaaaaatttattgagacttgttttgtggtctaacatatggtctatgctgcagaatggtccatgtgctgatgagaagaatgtatattctgcagctgttggaagaaagggtctgtaaatgtctgttaggtccatttggtctataatgcagattaagtctgatgtttctttctagatgatctgcccaatactgaaagtgaggcattaaaatcccctgcttttttttgtattaggatctgcctctctctttagctctaatagtgtttgtttatacatgtgagtactttggtattgggtgcatatatatttaaaattgttacatccttttgctgaattgatccctttttcattatgtaatgatcttctttgtccctttttatgttttctgacttagtctattatgaataagtatagctactcctgcacatttttggtttaaatttgcacggaatatttttttccatctgttcactttcagtctatatgtgtttttacatgtgaagtgagtttgttataggtaacatatagttgaatcttgtttttttaaaatccattcagccagtctatgtattttaattggagaatttaaattatttacattcagggtttttattgataggtgaggacttagtcctgtgcatttgttttctgattgtcttgtatatattttttcctatcttttttatttatttttattttttattttgagacagagtgttgctgtgtctcccaggctggagtgcagtggcaggatctcggctcactgcaacctctgcctcccaagttcaagcaattctcctgcctcaacctcccaagtggctgggattacaggtgcccaccaccacacccagctaatttttgtacttttagtagagatggggtttcacctatcttcttttgtattgtttactttacaatttggtggttttttaaatagtcataatgtttgattcctttttctcatttgtgtttctgttctattagtgagttttaagcctttgtttgttttcatgatggtagataccatcctgtctatttgaagatcagatgagattgggcgtgttcagggtggtattaatgtgggaatgaaggaggactggagagacaatggggtgagacaagaggatttttattgagtgcactcagacccagctgataacattcaaaaactgggcccagacaaagacagtacttgacttttatacacacttctaaaagggggtgggctagcttgaaacaagcttatggtggcgtgaagcaaagatacaggggcagaacaaaggcagctaatcaaactgtgacaggttcatgagccaggattacatatgacccttgctgtgcagctcacatggctgttatctaggcttgctcaaaagagccttgcatgggcttatctcataacgttcgctatggcacccagactgccgcagcccaggcctgctcaggcatgtcttacaaccttcactgtgctgcttagttaaaacagagtacttgaagttactggttacagaaaaccggaatctataaactcatatgtttactcataagggaaaggaaaatttgtttttttctccctatgttgaggaagtgctgggagagtctccagagcacattcctttgagcctttgcttatttgataatgttatcgagactttgtctgggtccaggctttgactgttaactgcctttgggatgagtcagcctaatatagaaagcttgtttttctttttttaattttatttttctttctttactttcctgcctcagtatggctttctcttccagatgtaggattcccttaagcatttcttgtcgggctgatctggttgtgatgatttccctgttttttctttttttttgagatggagtcttactctgtcacccaggctggaatgcagtggcacaacctctgctcactgcaagctctgcctcccgggtttgcaccattctcctgcctcagcctcccaagtagctgggaccacaggtgcctgccaccacacccggctaattttttgtatctttagtagagatggggtttcaccatgttagccaggatggtctcgatctcctgatctcgtgatctgcccgcctcagacctcgtgatccacccgcctcggcctcccaaagtgctggtattacaggtgtgagccaccgtgcctggccagtattttttttttaaaactaaattatcattaatgttaaaatttaactgaccatgtatataactgtgtaattgctgctttctcacagaactgtctaggattcattcaacagaccacagaaatgaggtctggcatttaacagactaatgatagaagaaataaactggtttatacaagaatatcaaaatactgtcatgtggtttagtgtagctcaagttatgaattagtgccaactcttgctgcagtgtctctcacacaattttatcttggaacttggcgatttaaattgactttcttcactgaaaagagttctttcatgatactcttcgtgaattgctcatatagcagcttaatctctttcatttgctgtctcctaacaatgctaacttgttgccacctcttttgttgctcttgaaatattttaattagtttttcttcctctcctcagtcttctacatgtctatgttgtattcttgaagcaaagtcagcaactgtataggatatctataattccatttctgcattctgtgttctcaaaataacattcagttatgttctcggtgttgatgcaagcttttgtatatacttttgaggcctttatctttttgcagcaagaccctgtttaatggcagctgcaattacttgtagcttctctacatcaacccccttgtcttcctcatctgtttctgcaaaaggttttctttccctgtgctcatcagtttctggatccttttctccctgttccatttcctgggtggccatgacctgagcctccaactggaccttggcagccctcctgttgctcctcctgccttgggtgcaatcgctagttgtcctgggatgccagaggcgactcctcaaccctgagggacccttgatggtgctccctcacaggacctgtataatgcctcactatgaggctcctctgagggcctggggtcctcctcctctcagtttttacttgtgtgggaaagactttatttgtccttcaattttgaaggatagctttacttagtttaatattcttggctggcagttttttttatttcagcactgtaatatatattatcccattctctcctgacctgtaagtttttttttttttttttaaacaggaaattctcttataagtgacttgatgctttccttttgctgtttttagaattctctctgtgtttgacttttgacaatttgattgtaatgtgccttgcagaagacctttttggtttgaatcttttttgggattactgaacatcctgtatctggatgtctgtatctcttgcaagacttaagaaatgtttgactgttattttgctaaataggttttctgtgcctcttcccttctctttcctgaaacaccgagaatttatttggtctgactgggttatttcaaaagacctgtcttcaagttcagaaaatcttagttttgctttatctagcgtacttttgaagctctcagttgcatttttaaattttattcattgaatttttcagttccaggatttgtttggttatttttctatatctatctctactgactgtcttattcagatcatgaattgttttcctactttgtattatctgtgttctcttgcaacttgctgagtttccctaagatcattattttgaattccttttctggcatttttatagatttccttttcttttgaatctgttactggagaattattgtgtctctttggaggtatcaaatttccttgctttttcatgtttcttgtgtccttacattgatatctattcagctagtggaagagttgcttcttccaattttatggattggctttcataaggaaagacttttttgtaggcatatctgtagttttggttgtgattaggatgttttggctttgattctggtgagcacaggagtgtaggctcaatgatttcttcagctgtaaccaatgtaactggtgtcatgtaaccatgtcactgtgagtcctcagtggcttaagttgccattgttagctgaggctgttgtgaggcttttctggggaaagggatgccagaggggccagtccctgggccttttggtggcatgggcaggctttagctgtggtggcgatgggctgggcatgctagtcctcaggaccccagctggtgtaagtgctggtagtggggggcccaggtgggctggtcctcaagcccccaggcagcatttatggtgctggcagtggcagtagcagcagtgggctagacactggactgtcaggtggcaatcatagctgttggcagtagctgtggcaggatgaatgggacagtttctagccccctaggtgatgcacttgggtgggcactggtggtaggtggggcaggcctgttcaggccttgggattgtgtgcgtgggcaccagtggtgttggatggggtgggccagtcgtcaggcccccctacagagcatataggcaccagtagtggcatgagggaaagatagcgctggagaacactggtgacagtgggtggagcaggcctgtctttaggttcttggatggcacatatggacatactggtcctcaggccccctgaaggtgcacacaggcatgctgttgccctgctgagaggggcaaggttctgttggtggcattggtgttgggaagatggctcccaggttctgggagcttcagctccctttttcctggggtagcctccctggtgtgctatactgcctgttccctgggatataagacacttcatgggtcagagtactggggacctggctgcactgctgggtgattgtgatactgcaaccttctggatggatgtgggaggatgttcttgggggtccagggatgtggactgcaggggcttattggaccccaagtgggcaggatataatctggtgggggctagcctcttaaaatggtgctgtgccacagcagcatgtttcttgggatgtgagtaggatccagtggaattccctttctggaagaacgcatttgcatggattccaggcagctccgtatactggactcagggcctgtgaaggctgacggcatcccctgtgggtgccagcatctgtgctgcgaatgtggaccactgcagttctttgacttttcttttcccagaaatgggattcccctcctgcttctgagccagtccaagacatgctggctgctttatttactgctccctttgtgcctcagaagttccctgttgaatagtgttctgtctttggtgctctacctgacatgtggttaactacttgcttttttggtcctttgttgtgcaggagttgagtgccaggctcacggttttttgattaccatagttttgtagtttttgaaattcagaagtgtgagacctccaactttttctttttcaagattattttggctgttgagtcaattatgattccatatgcattttagatggatttttctatttctggaattgtgccattaggagtctgatagatactgcattgaatctgtagagtgctttgggtagtattgacatcttcccactattaagtcttccagtacatgaacacatgcattttcctgatgactaatgatgttgtaccttttcatatgcttattggctatttgtagatcttcctgggagaaatgtctatgcagactttttgccaattttttaatttgtccatttaaaaatcagggttttttttgttgttgagttgtaggagttctttttgtattccttatactagtcccttatcagatatatgctttgcagatattttctcccaggtgggttgtcttcacttccttggtagtgtcttttaatacacaaagttttaaatttttatgaagtcaaatgtatctacatttttctttggttgctcatgcttttggtgttgcatctaagaatccactgccaaatccaaggtcatgaagatttactcctatgttttcttctaagaattttatagtttttgctattacataaggtctttgagccattaagatctttgacttaacttttgtatatgatgtaaagtcactgtcaaacatcattcttttgcatttggctgtccaggtatcccagcattatttgttgaaatgcctacacttctttatattcccttgactcctctaaccaaggcagttggacctttgctactaccactgccctgaaactgctgtcactgggttactgaggactgggtagcttagttgagtagataatcttttgttgtttcctccttgtaatatacaagccttggcttctgtgacatcatactctcctagatttccccctgtcactgtggcttcttctcagtctctgtccatccctggtgctcctgaaggttctgttctcagccttacacacattacctgggtgatctcattctctgccatgacttcacttgccatatatgtgctgattttccccaaattcctatttctcccgacctttacatctattttatttgcaggtcatatatctaataaggaattgatatccagtgtacatgtagaactcctgtaattcaatacagaaaccaaacagtccaattaataaatggagaagagatttgaatgaacatttttctaaagaacatctcaagctcaagatttcccagataacttttctttcttcaaaatctgcttctgtgtttcctcatctgtaggtggcacagcatacatctgatttcccaagccagaaacctcatagttattcttgactccaggaagaaatattattgagtttttaaaaactcagcttattgactcattgttttatataataaaatgcaacagttttaagtgtatatttcaatgagttttaatacatttatgtacttgtgtcactatcctcatagatagagacaaaacatttctatcacaccggcaatttcctatgtgtcccatcccaatcaatcctttcccctttgctggctccaaacaatgactctttcctatctttttagaaagattagaattgcttttctagagttccagtaatggaatcatacagtgtctaagtctgtttgtggtgctgtaacaaaatacctgagactgggtaatttataaattataggaatttatttctcacagttctggatgctgaaaagtttatgatcaaggcactagcaggtttggtgtctgagggcccagtttctaatttgaagatggtgctttaaacactgtcctcacatggtagaaggggcagatgggcaaaaaaaaaaaaaaaaaaaaaagggcaaatgctgtgtgtagcccctctcataaagggcttaagctcattcaccagggaagagctctcatgacctaatcacctccaaagaccccacctcttaatactattgcattgcagattaagtttcaacatgaattttggagggatacaaatattcacaccatagaatatagtaatatagtatagtatatattttttgtgtctgtctgcttttgctcagtgtaatgtttttgaggttcatctatgttgttgcatgtattagtaggttgtatctattggtgcatagttattccattgtatgtatgtaccacactcttcatttacctgctgatggatattgcattgtttccagttttgggttattatgaataaaactgctgttaaccttaaaatataagtctttgtgtagacatatgttttcatttgtcttgagcaaatacctgattggtcagatggtcatatgtcagtatatgtttaatatcatgtacttccaactgtttaccaaagtagttgtgccattttattttcccactagcgatgtatgagttccatttgatccacatctttgccaacacttgttatttattttagcccattaaattttagctgttttagtgggtgtgattagtgtctcaatgtagggtttttttgtttttgttgtttttttttggattgcctttctctattgcccaggcttgagtgcagtggcacaatcatagctcactgcagcctcaatttcctagactcaagtgatccttccacctcagcctcccaagtagcagttagaatcaaggtttctttccatgtggatatccaattgttccagcattatttattgacaagattatcctttccttcattaaattcctttggcagcttggtgaaaaaccaatgggtgggtttatttctaggctctctatcctgtccctttttgttttttttgtttttgttttgagacggagtcttgctgtgttgcccagctggagtgtagtggcgtgatctcggctcactgcaacccccgcctcccgggttcaagtgattctcctgcttcagcctcctgagtagctgggattacaggcatgcgccaccacgcccagctaatttttgtatttttagtagagatggggttttaccgtgttggtccggctggtcttgaactcctgacgtcgtgatctgcctgccttggcctcccaaagtgctgggattagaggcatgagccaccacgcctggcacctatccttttttagtaaatcttaacatcaggtagttgtaagacctgcaaattcgttatttttcacaattgttttggccattttaggtcctttgcatttccacatacatttttagaatcaacttgtcaattttaacaacaacaacaacaacaacaaaactcctggaactttgactgggattgtattgaacttatagatcaatctggggagaactggcatcttaacagtaatgattcttccaatctatgaacacagtatatctctccaactttttaggtcttaattttgttaaattgtttgtagttttcagtgttctggtcttgtacctgttttgttaaatttaaaaaattcccactttgggaggctgaggcaggcagatcacgaggtcaggagttcgagactaggctggccaaaatagtgaaaccccatctctactaaaaatacaaaaaaattagctgggcatagtggcacacgtctgtagtcccaggtacttgggagtctgaggcaggagaatcgtttgaacccaggaggcggaggttgtggtgaatcgagattgtcccattgcactccaacctgggcgacaagagcaaaactctgtctcaaaaaaaaaaaaaaattccatcataaaagaaaaaaaattcaattgtaaattccagttttttcagtgtcaacatccagttgtttatgtccagaaaataaaaatacaattgatttttgtatactgactttgaattctgtgaccttgccaaactcatgagttctagtagctttttgatgggtagattccttaagatattccacatgtacaatcaggccatctttgaatggagccagtttgtttgcttttatatttctttgccttattgtgtatccttgctttgttcttgatccacagggggaagcatttggtctttgcaagtgtcaggttaggttttttggagatgcctttatcatactaaggaagttccctctttttctagttgctgagagttgaataggtgttgaatctgttgatcacatggggccatatgacttgctctggccagagaaacatgaaggaagtcatagacatctcttctagataggcgcttgaagagccagtgtaggatttgctacattgtcctcccaccgccgcttctgctgtgatgaagcgttgggcatcagtgtgaacaagaaagggattgttgttggggtaagccatgaggttttggagctgtttgttaatgtattacagtctaatgagaaggttcttgccctcaggacaaactccttgccttcatggagcttacattctagtgcaagtggggcagacaaatacacgtaatgtcaggtggagattagtgtaatgaagaaaagcaggatccgaggctccagcaccttttagctttagataacggtttttgtggaaggcctccttaaatgaggcagcagttggcctgagagctgaatgaagtgagggaggagccatgaggtgtctgggtaaggaagggtcttccaggtacaggaacagctatgcacagccctaagacaggaactccagactctcctggacatggagggtgtgacaaagctgtcctccaagtgaaaagagaagggcacattcagccagtgacttctgtggtttaagccagggctgggctagagagggccgctgctgtgtgttaggcagaagatgactagttggccatggcctggccagaccgctccgatgccagcgtccttcagctcctgggatttcgagcgatggggcagggggcaaagaggaaagagggagtacctgaatgtcctgacattctggcataggggctttctttgagaaaaatcatttgactgaacttgagtttgtgagatagctcatgaccattactttcctgagttattctccaccttcaaactcaccaacagcttctactgtacttaggaagaagcctgcactcaactctgctatctagttcacctcctctctcccctctccccttagagaaccctgctccagttgccccaggtttctttcagttccttcacaaagtgacactttctctgcgctgttggaaaggctgttccttctcctgagaacactcttcctgctttctcctggctaacatctctcagggctcaacttaaatgacagtcctcctggaagccttcccagacaagcctgggtgcttctgtcaaatgccaccttagcattttgtccttctcctaatagcactaatcacattgtcttgtagctttaaaaaattatcaaataattcagacacccaaagaagtataaaaaataatacaaaatgcaccgtatcacccaacttaagcaatgaaacactgccagtgaagtccttaaggttctcctcccttcctgctctcaacccttaccggaatttaatgtttatctttctgagacagccaggtgggaaggggtccccagagaaactccaactggcctgcacactggtgtgctttgcatgtctgtgtggtttgtaggtaacttcactgcaggcctccatcttgttttacaatctgggggcatggcctgtaactccctggtaaggctttgtttagcaatcctgccttagggagtgagtccctttctagttcgatagctgcatgttttcctagccctgtctcttaaaggatcccacccagtgactgaggtttcttctgcctgcctgtgtaactatatatatatgttgtgtatgatgtctgtaaaaagagctctaattaatctggcctaaagaaagacaagcgcttagatcaaattttttttaaagagaagataaaagctgtggtacctttcagtttatgtgactttaatctttgagaaataaaaacagctttaaagattattggtaaaaagcagatgccatcaaaatgtaaataggcggactaaattatgcaggccagatgcaaggtttgctaagtgttttaaggttataaactgctttttgggttttgagaactatttgtcttgatggcttcacaattattaagacctgggaacatatggaactaaccacacccttaattatgctaggagtcaaaccttggctgcatctggcacacaaaacagcttaccaagttttacattaaaattaaaaattgctaggagttactgttttaacatgtaattgagactactggaaatagatttatatgcgaggtgtgtaagaacagtaaatttttttttttttttgaaacggagtcttgctctgtcgcccaggctggagtgcagtggagtgatcagggctcactgaatcctccgcctcctgggttcaagctattctcctgcctcagcctcccaagtagctgggattacaggcatgcgccaccatgcctggttaatttttgtatttttagtagagatgaggtttcaccatgttgcccaggctggtccctaactcctgacctcatgatccacccgcttcagcctcccaaagtgcttgggattacaggtgtgagccaccacgcccagccaaatgtgtttttttgtaaaaggttataagaaggcatggaaatgtaaatttttgcctagggttaaaggattgttttaaattaggatgaagttgcaggttcaaacaagtggtggaagcattgtggaaattaatcttgcaaaggggttttctatgtgaacatattgactaaatttcaaagggtattatatgatttttctgtaaattgagcattgaaataaaagcacaacaaggtattcttaaggcactgatctgctcttcagcaaaatttgtaaggggttataaaagatttttgcttctttaaaatttctgagtcatcattttggcaaaataaataacttatggtaatctggaattctgtttcataacatcaagtgctttaaacctcgaacatatttaacagccttcccaaatcaaacttcagtttcaaaattgtctttcctgatgtttggctttttggaccgtttggagtgcccctgaaatatccaagaaataggtaaacaggatcatttgacatgtttaggtacatgggattgccaaaatgatgttcagttttctttaggttatatttttgtgaataatgctaatgtatgttccaaaattatatgggatttctaaaactctaatgtctaagtatatgctatcaaccataattaaggttgttaagttattgtaaaccacagagatagccaaacttctttgtcaattgtgtttctaactgcaactaacctggacatttggctagtcacagacaattgttgtcttgttttaatcattttcaaaagatggtttataataagcaataggactctggcaggtactctcaaatacaggtttctgataactttggagattgtcacattggaataaaggcaaatgtacaggattcataaagagctgaagtgttcacgaatatcaagcaaaacaagaactaaatggactgaactcaaagctgaagcaaactttttgacttttgctgggaatattgttgatccttgttttgtttttcagagtcagggaaacttattttaaactatttatggtctttaataattgactgaggtatactcctgtggacaagatttggagcatgcttgtttctctttgcctggttcctttttttttgtggacagactgttactctttcgcccaggctggactacagtggagggatcttggcccactgcaacctccgcttccctggctcaagcgattctcctgccacagcctcctgagtagctgggactacaggcgcgggccaccatgcccaggtagtttttgtatttttagtagagatggggtttcactatgttgtccagcctggtctcgaactcctgacctcaagtgatctgcctgccttggccttccaaagtattgggattagctgtgagccactgcgcccggcctggttcctctagaatctggaaactatctgtgagtatttttaacttgtggcaatatagttgtctggatcggtgtgataggaatccatttatcttttgttaacaagacgcaattggaaaaactggttattttcccgaggctttcactggaaggctatgcttctgtttaaagaatcaatctcgacttgcagggccaataaaagcccagtggggaagttggcctcatactcttgtctacacagtccctgtacagggttcctgacctgtggtcagtaaagaatgtcacttgctaacaggtccaggagctccaagtttatcctgggaccttaagaggagaggatcacccaacccaaggtgtatcatgggaacttaagaggagaggattagcccagttcatggctgggcttggctttatcttatctgagattccttgtggaacagagttccatcaaagccagtccaaaaggcctttgtagaaataattattcttgctgcactttatgtaaataatcaggccaagtataagactgaagtctattttgcaaacaactgagtcctatcataatttcttttcttttctttcttttcttttttttttttttaacaaaaacgaggcctggagaaaaattatgttccaaaacttaccataatttgtcattcaattctaaactcagttgtttttaaatttttgcctgcatttttagactgaccctgcttgtgaaccaaccagcaatctccagctgcagctcagaaagaacaagagggatgggtaatgtaaaaaaatctggattagtattctagttatgagcaattatcctgcaaattctgctaggcaatgggaataaatagggtgcccatcatccagaggtttccttttgggaaagtaagaccaagggagctaaccaaagccaagcaccatgcacccaaatcctaccaaacataactgtagccaccagttatctgggtgtgtcacaagacatccttttctctcccttgttggaggactcagttccacagtttttccttagcatttggcttacgagaaggagtccatgcaacccctcaacccctgagcataagtgaggtctagggaactccaagactactgacagcaggggtgatagggcattcatgggtagaggagataattcccaccctctagacccctgcttcatggatgcaagccattttggcacccatggtagcactttcgaaggttgcatggggatgcaaggatggaagaggacgctattccttctatccctcacgtaccccaggtatttgctaggaaaagaaccagggatgcctgctcccctctttctatgtgggtagccatttatcttcagtctgcaccactttcaaatgcatctggaacccttcggattcctttgaaaaaatgccttcttttttcctttctcctcctcggttcacaatgacaatcctaattgtgtctccatactatgggacactcccctcagatgcattttccaaactggaaagagttaatttcctaaaccttaaactggctggcttaggattggtttcaggggaagggaacccagaagcccaacatgccagcaaaagggtaaagttgtttaccattcggacttttggcccccttctccgtgtacaaattggtaaaaagcctcaggatttttgagctgtccttatccctccccttgtttcttttcttttctttttttttttgagacagggtctcactctgtcgcccaggctggagtgcagtgatgtggtcttggctcactgcaacctccgttcaaacgattctcctgcctcaacctcctaagtagctgggagtacaggcaggcaccaccactgctggctaatttttgtatttttagtagagacagggtttcaccatgttggccaggctggtcttgaactcctgacctgccaggctggagtgcagtggcataatcttggctcactgcaaactctgcctcccggattcaagtgattctcctgcctcagcctcccaagtagctgggactacaggtacttgccatgacgcccggctaattttttgtatttttagtagtgacagggtttcaccatgttggccaggatggtctcgatttcttgacctcgtgatccacctgccttggcctcccaaagtgctgggattacaggcgtgagccactgtgcccggccatatgtgtttaataacccagtttgtctcttcttgccttcaggacatcaaacggtcatgctactggaagctcggaccatggccccttctgctgggcacccttagataggcctctgagggagatctgattgccattttcccgaaacagtgccccctatcagcaggaagcagttaagatctgtctttgtccctattcttatcctagtggcagttagatagacttctttagagcgaggaatgagccagatgggaagggttccctggtaaaactccaactggcctgtgcactgctctggggtggagccacagaagttcgctcctcagtttgcagctgggaggagcctggccctcctcttcctcgggagaacctgggatttaatctgtgaggtgggaagcctacaactaggagaactctggctctgctgagtccctgttcccctttttcttcctttacacccaataaaaccctgccttacccttcaaattgtctgcgagcctaatctttcctggcgtgtgacaaggacctccaccgtctttagctgaactaaggaaaagtcccgcaacattttcatgtgtgcctttgtatttttattacatatatggatgtccctaaacaacatacattattgttttgctttatatattaaaaaggcattctgcaatttgcattttccccagccttgtgttttgagatttatccatgtggatgcgggaagctgtagagcacttcccctgctgtggggcagtttgttttctcgctggcggacattcagcttgttgacaaggttttgcaattacaagcacctctgctataggtattactgtacctgtcccttatacctgcgatagtgtctcccggcatacagccaagaatgggtgtgcacactcctcgacctgctcccttccacttcgtcagcctggccgggggctctttcaagaggtggggccgcttggtggcttctaagtcgtgcctctccctctgggtaataaacgccttgggggcagggactttgcagtcttgcttattgaggcgttttccaaaacagggaccgagggctctaacacccgtgcggagggtggccggcgggggcgggagtttggcagaatgcggctggagaaggtggggcgagggaagaaggctcctggcctgcaggggcctctcttccggctgtttttcctcccgaagacaaacactcccaacgcaggggcgcagagcctcggcttctttcctggccagctccctcaaggcagggcctagcatggcccggcccagcccctaggttcccccgcccgcggctcccgggcgcctccgcctcccgcggtgactcaggcggcggtgacggcagcggagggggcgatgacgggcgcgcgggcgtccgcggcggagcagcgcagggcggggcgcagcgggcaggcaagggcggccgagcgggcggcgggcatgagcggggcgggcagggcgctggccgcgctgctgctggccgcgtccgtgctgagcgccgcgctgctggcccccggcggctcttcggggcgcgatgcccaggccgcgccgccacgaggtgagtgcacacctcctaccgccgcccggccggctacgagcgcagcgtctcctctccgcggcgccgcccctatctccgtgcgcggcgccgagcgctaggccgggccggaaccgcccccgtggcctgggctgttgctgcgacttcgcggtcccgcgccccagaccggaggccggacttcggggtgctgcggccgggccccgcggaggcgggggagggggcggttcggaccgcggcggagtggaacctgggcgcccaggcggcgcccaccccagcggagcctgcgtcctggcgccttccgtctaaacagaggccgcggatcgggacgccgggaccccacaaactggcagccaggaggcgggccagccgaggatcgggggggctcggactccccctgcacccagtccactgttcggagggacttagagcagggtcccttccctgagggcctcgcccccgaggacgtggcgccggagccgtgcgacccattggcttcagcgggtgggaagcctggggccgggacgcgcgttcgccccgcgctggggttgaacctgcgtggatgtgcggcgggtgaggaaccgcggagaaggcggtgggggcgcggcctgcagcccggtcccgggcgagccctccgcgcgtctcccctcggcgcgttttccctccagggtgactgggaagccgccgccgccgccgccgccgcctgggaggggccgggctgggcgcttttgccccgggccccggaccccgggcgtttgtccggtgcgctggcttaagaggcgctcagctcataccgtgattgcacaactggcttgctctccgaactcggtggggaaaacggtgacaaatacagattccaggtctccatctagacccctgcaccggggagccccaggccctaggtccttcgcacacgcccctcccagaggggtcgggcaagcatcgcaaacccctttgggtaggagggacggtgggagtcacctgtctttcccctctcgcgcccttttcttggtcagaatacgaagttttagtgtctgtgtatggagttcaaacgacccctcctctccaagcagaagctggaggagaaaggcgttgtgaattttggaaaagcggctcagaggattacattttgtgcgatccttgatccacccaaccttcatctcctgcgctcccctcctttaaaattgcaaggaccccggggaggttatgtaatctgcctgatcacaatttgtcagggactgatcccgccgaacactctttgcattttagcgccagtattagcttatcaaagggcacttacttttagagagaggtggtttgtaaatagtaatcacacgtagtgaggggaagccgcgttgggaccgcaaggctttccctgtcacctggagcccatgtttgggccgcacagctttcctactaaaaacgtcatcatcttccttctttttgaaaattcagcatttgcttgaagaaaaaaaaaagtagactatgtctttaaaaatatgcccagcaaagataactcacgagcagagagctagaccagaaattaaatatttggaaaggaaataaaggtgtaatacacaagcagcacatttatccccgcaccattggaaggtgactttatttggtaatttgcccaccaagacgaggtagaccagaggagagagaaggaaataattgttcttttgtctgtaacgctctgggggtattgccctggaatttcttaggtcagctgctgtgtgggaaggtgacagctttttcttgaagctgaacatcaagctcagtttcgaggtcatatttgatgacttatttgatggcttagtaattgggtcctttggtcgtgtctgtaagtgatacagactgttattattatttttaaaaaccacattcaaataatgcaaagtgaaaaaaaaaggtgtcaaaatccgctggcgttactctgacagtctctagctgtggttccctagctgtggtcttcaccctcggctgcacactcgaatccctttgggaggttcgttgttttttgtgggaaattaaaaaaatcatgctgattgggcagagattctgatttaattggtctggaatggggccagggcattggtaacttttgtagtttttttagagcttcctcaggtaattttgacattcaatgaagactgagcccctctgcacattcccaaatagcatagttagtaacaatgacaatgaagagctttcagcctaaaattcgtgtggataatctaagtataaaacaagtaccttattccgcccaccaccaaaggcttagagaaacatgagtacacacagtacttattccatctacgaagggatgatgatgtgtggagaaattacgaaggaaaagctcatggcttcatggtctcttgggtatgatcaagtgtaggaaaaagtctacagagagtgactagaaatgtgaaaatggaagccattaaaactgaagaagggaaatgaaaaagaactattttaaaacgatgacaaattgacaaaggatttaatatttttgtctttaatgtagagaagttatgcaaatacctcagaaggtgtcagggattaaataaaggtggttaaataaataaatgattcaggaattaatatgaaagtcacatactgatggtaaacatttggaaaacatgttcaaacttgttaatcacaaattcaaaactaaaataattaggacgtgccattttctatccaccaggctaacatatgagggaaacatggaaaggctaatctggctgggcttatagggagggatctgttgaggctcaggagactggttagccgttatgtgcacagttagactgacctcagcttaaatcctggctgctagtaggtgactttgggcaagctgcttgacctcttcaggcctcagatgcctcatcccaaaatggagacaccaggagctatttctttctttcttttttttttttttgagacagagtctcgctctgtcgcccaggctggagtgcagtggtgcgaactcagctcactgcaagctccgcctcctgggttcacaccattctcctgactcagcctcccgagtagctgggactataggcacccaccatcacgcctggctaattttttttttttttgtattttttagtagagatggggtttcaccgtgttagccaggatggtctcaatcccctgacctcatgatccaccctccttagcctcccaaactgctgggattacaggtgtgagccaccgtgcctggcccaccaggagctatttcatagggctcttggggcctggtggttctttggtaagtgtggttctttgtattacctgggagatctcaaccatcacagttgtcattagaaatcagcacaactgaattggagagaaattttgtaatgcatatcagaagctattcaaaagcctgtttttggttaaagattttactcttgggcccggtgtggtggctcacgcctgtagtcctagcacttttgggaggtcgaggtgggcagatcacttgaccccaggaagttgagaccagcctaggtaacatggtgaaaccctgtgtctacaaaaaaagacaaaaaaaaattagctggatgtgctggcatgcccctgtagtcccagctacttgggaggctgaggtgggaggattgcttgaactcaggaggttgaggctgcagtgggccgagatcttgccactgcactccagcctgggagacagagcgagactctgtctcaaaaaaaaaaaaaaaaaaattttaactggatgttcccgatcctgaagaggctctgttggtctctgcattggttggatgtggcctggatcactgtaatgtctatgtgttgagcacttgtttctgtgccagccactttgtagatggtcaagtttagatttcccaacggtttcatgaggcacatactcttatgacccttaatttattggtgaggaaactgaggcaagttgggcttcagattcaagtttaacttgaatttatcccactatgtcatactccaggtcccaaacatcgcttccactgaaagctttccaggagaccaaagaacagaaaaaatgattgtgaaagctttctttggcctagagaaccaaaagctatagtggattattattattattattattttgctgaaagctttatttgttctcacttagggtaaatgaaaaatttcaagatttggctacaacttcattctttgaaaagtaatgttttacagaaagagaggttaggggtactggctctgaagacaaagcttagattcaagcccagcttcaccacttacaccagtcccctgattttgccgtttccttgtgatataaggcactcaggaacacaagccaggcacacagtaagtgttcaggaagtgctggcattatgaagttcaaacagcaccactggtaaatgaagttcagatttcagaggtggagactgtgtatgcagcctcacagctaagtggatgccatggtgaaatgtttagatcataggcctttgagaagaattatcagaatgttagaggaatgggcctcccttggcacccagaaataaacgttaaaggaggctatttcatcatataacaacttccgaacttctagaaaagtgaaaagagaggcttgggtaaggaagatgaaagccctcccaccaccctgcgtgctgacctagggcatccttccttctactctgttgttagatcctcatgatggccaaaaaaaagcattctttaacctaaagcatccccatggctcaatctctaccccttcatcaccaaggaaaagccagctctagtggattaagagttttatactgcagggcttgtcttcactgagagctaaataagggtaaagtaagataaacttaaaaatgagggattgaggcccggcacagtggctcatgcctataatcccagcactttgggaggccgaggcaggcagatcacgaggtcaagagatcgagaccatcctggccaatgtggtgaaaccccgtcactactaaaaatacaaaaattagctgggtttggtggtgcgtgcctgtagtcccagctactcaggaggctgaggcaggagaatggcttgaacccgagtggtagaggttgcagtgagccgagatcgcgccactgcactccagcctgggtgacagagcaagactccatttaaaaaaaaaagaaagaaagagggattgagctggctacgtgaagaattcatgattctgccattcaaatgagtgactagggagcccagaggaagctttcccattacaaaatagagaccgagttcttaccttcctcattgtgttattaagtagttccccatttttttcttttgggtaaatttactcagaggataaattaacttctcttttatataatatcatataaatggcccagttggttgacatgaaccactctgctttgacttttagacaagagcagttcactttatttttcctaccaaattggcacacgtgattttagaatgtgcgtcatctttctgtcatcctcagcacatcatctagtgaactggtgagctgtgtgagtttctggattggggcatgctcccaatccaggattcactgctcccaatccaggagcagtgagtttctctgcccttcagactgaggcttgtcttaaaactgtctgcttacccctctccgatctgccatggaaattaggatattccaaactccaaaacaaagtgatagaaagcagcacttctcaaactttcaagacacgtgcaccccgcccctgggcctcgctaacctgtctgactcaagcaggttctgcatttctaacaagctgcctggctacaatcgcagctcagtaacgtggtaggggagaaagcttgaactttagagtaatacaaattgggttcatatcaattatttcattgaaaaaccgtggtcacaggcagttatctaattcttgagaggcttaatttattcatctgtaaagtggggaaaatacctagctcataagattgtcattattatagggaaactactaaattcagtacatgtcacatcttagcactcgatgaatataagttccttacacgatcctttgatgcactagatttgagtggtgttgactgaatcctcttgtagtagagacatctgtgcaaaaggagacctgtgtgtgtgcacatgcatgcatgtgtgtgtgtgcacatgcatgcatgcacgcacatatatctgcgcatacacaaagtaatgtgtgagagaccccagaaatcccagagtgtaagcttttgagaagcactactggaagcaactgttcacacgaatgtactttgtctctaacacatctttcgggtgccttttttttttttttttaacttttcctaatttctaccagacttagacaaaaaaagacatgcagagctgaagatggatcaggctttgctactcatccataatgaacttctctggaccaacttgaccgtctactggaaatctgaatgctgttatcacgtatgtatcagttcacactcagttctgtttgctttggggcttgtttgatatgatccttaatgctctcatgtctaaagcccttcacaagttaatttcagttttgcagctaaagaaacaaagaagctatataaagagtcggaagaaatacagtcaggggaggatgcctaggaatgcacagcatctatttttatcttttcatctactcatcctttaaaaagccagttctcagggatgaacaaccttgatagactatgttttattttcctcctctctagtgcataaccctcttgctggaccagagaaggaaggagtgagacaccagggtattctccaggggccagcagagtggtgcaagttgagggagtggcagttattccagggccctgcctccctgatgataacaaatgcattttctctgaaggttttactcctattctagaccttgttgctttttaaggacaaggctattctttcatgtaaaataaaatattctactatgcaaccataaaaaaagaatgaaatcatgtcctttgcagcaacatggatgcagttggaggccaatatcctaagtaaattaacacaggaatagaaagccaaatactgcatgttctcacttctaagtggagctaagcattgggtacttatgaacataaaggtgggaacaggagacactagggactatttgggctgcagtacccaagcagtactgaaaaacttgggtactagagctgagtagtacctatagggctgaaaaattacctactaggtactgtgctcaccacctgggagacaggatcattcatgccccaaacttcagcatcatacagtatacccatgtaacaaacctgcacatgtgcccctgaatctaaaataaaaattgaaatgataaaatgtttttgccaggcacagtggctcacgcctgtaatctcagcactttgggagaccgaggtagggggatcacctgaggtcaggagttcgagaccagcctgaccaacatggagaaaccctgtctctactaaaaatacaaaattaccgggcatggtggcacatgacttgtaatcccagctacttgggaggctgaggcaggagaatcgcttgaacccaggaggtggaggttgcagtgagccgagatcgcgccattgctctccagcctgggcaacaaaagcgaaactctgtctcaaaaaaataaaaagaaaaaatttttattgccaaattgagagcttcgttatacctaccatcagaggttgaattttaatttatatttatatttaatttatattaaatttatattaaattcatatatatagtaatgctatatcaaggtgttatgctgtcgtcaaggtgttaggtgtagggcaagtaagaccattattagaataaaacaagtaggatcattggcatacaacagtgatgctgtggacaaattaaagaattaaaaaagaggccaggcatggtggctcacacctgtaatcccagcactttgggaggccaaggagggtggatcacctgaggtctggagttagagatcagcctggccaacatggtgaaaccccatctctattaaaaaatacaaaaaattacccgggcatggtagcaggtgcctgtaatcacagctacttgggaggctgaggctggagaatcgcttgaacctgggtggaggcggaggttgcagtgagccgagatcgcaccattgcactctaacctgggcaacaagagcgaaactccgtctcaagaaaaaaaaaaaaaaagaaagaattaaaaaacaggaagacaggccgtgcacggtggctcactcttataatcctagcactttgggtggcctagtgggcagatcatgaggtcaggagtttgagaccagcctggccagcatggtgaaaccccgactctactaaaaatacaaaaattagctacgcacagtggtgtgtgcctgtaatcccagctacttgggaggctgaggcaggagaatcgtttaaccccgggaggcagaggtggcagtgagctgagatcgagccactgcactccagcctgggcatcagagcgagactctgtctcaaaaaataaataaataaataaataaataaataaaggaattaactacacgagactgttttaagaaaaaaattgccgatttatttaaaagagcatggagataattatgtcaggaaaatgtataaagaagtgacacagggtttgtatttaatcatagtggtagaaaatatcccattattgcaaaaaagattttaccctggaaactggaaagacacttatgactcttttaactagagactgataaaattatgtctagacataaacttttaaattttgaaatttaatgataatttttaaaattttaggccgggcgcggtggctcacgcctataatcccagcactttgggaggccgaggcgggcggatcacgaagtcaggagatcgagaccatcctggctagcaccgtgaaaccccgtctctactgaaaaaatacgaaaagttagccaggcatggtggcgggcgcctgtagtcccagctactcaggaggctgaggcaggagaatggcgtgaacccgggaggcggagcttgcagtgagccgagatcgggccactgtactccagcctgggcaacagagcaagactctgtctcaaaaaaaaaaaaaatttttttttaaattttaagcagatgtagattataggagacacaagtatgcaaaaaatgcaaattataataacttcatacatttagtaaaccagataataaaaatctggggctgatggaaggatatctttaagatatttaaggtgaaggtatgcccaagagatcagttactagctgagttgaagaatttcctgttctgtttccctctttatctcacttccttaaagtagaaagaccttttattttatttatttatttattttaagacggagtcttgctctgtcgcccaggctggagtgcagtggcacgatctcacctcaccacaacctccacctcctgggttcaagcgattctcctgcctcagcctcccgagtagttgggactacaggcgcccgccaccgcacccagtaattttgtatttttagtagagacagggtttcaccattttggccacgctggtcctgaactcctgaccttgtgatccgcccgcctcagcctcccagagtgctgggattaccgacgtgagccaccgcgcctggccaacatttagttttttataagtaagatgttctcagtatggtaaacagttaatgtttctgtatctttaaaatattgctaaaaaaagaagactgagccctgcgaggtagttcacacctgtaatcccagcactttgggaggccaaggtgagaggatcacttgaggtaggagtttgagaccagctggggcaacaaagtaagtcctcatctctttcaaaacaaaacaaaacaaaaacaagactatacaatgtggaaaatacataaaaaagaaaagatattgtgagtatttaaaattgcttttggaggccaggcgcggtggctcacacctgtaatcccagcactctgggaggccaaggtgggcggatcacaaggtcaggagatcgagaccatcctggccaacacggtgaaaccctgtctctactaaaaaatacaaaaaattagccaggcatggtggtgggctcctgtagtcccagctactcgggaggctgaggcaggagaatggcgtgaacccgggaggcggagcttgcaaagagccaagattgcgccactgcactccagcctgggtgacagagcgagactccgtttcaaaataaataaataaataaataaataaataaataaaataaaattgcttttggaaagagaagagctatatatatatacattagtaaataaagtattaaaaactaaaatattgcactcataaagaatacaatgaaaacttgtactttttgatgaagtagatattagaataaaaggggctagttaagcatttgcataaatagtaaatactaatgctaaaatatgaacaccctaaataaaaaggcaccaaatttatgtgggtccccaaagtacatcgaaaataatggtagcagctaataatacaaaacaaagtcgtagtagagacaaatgataagatactcttaccagggcaaacattttgaaggtttcatcatagagctggtgaactgagctgaataatgtcagggagtgaggtggttaagagcttggattctgcagtccaagtgtctggtttgaatcccacctctgtcacttgtgttactttgggtatggttctcaccttctctctgcttctcttcccctgtgaagctggaaaaataacggaacctgccgctgagctccttgggagtgtttcgtgactgagtgtctgtaagctgaagcagagcgagacctctccacgtgtcagtgttactggcaatagaaataagtaacacgtgtggcagaaattaaatgaaaaaagtagataattaaaaaattcctgtatatattcgtttcacaaaacactcatcatatgttaagtcaaaagagactggataaattaaaaaaagcagggattatgtattctacctcatacttctgcacaacaaagaaacaaactaatataataagggttataatataaatacgagcatttcgttgaaaatctttagatcaggccaaagcaattcctatgaaaaaaatgcatgtaaatgttcataataataaagacgatggtaatagaaattgcagctactgtttcctgaggacttgttcagtgttttaggtctgtctcatttaacttacaacactccagtagagagattctatccaggagagaggatttgctggagatactgaaattaagagaaataaagtgacatttttctgggttacctagctgttaggtggcaaagctacaattcacccctccctgtagctttggaggttggtatttatgttaatcagaaagaaaaggggaggctggatgcagtggttcatacgtctaatcccagcactttgggaggcccaggtgggcagatcacttgaaggttgggagttttgagaccagcctgaccaacatggtgaaaccccatctctactaaaaatacaaaaattagctgggcatggtggtgggcgcttgtagtaccagttacttgggaggctgaggcaggagaatcacttgaacctggtaggcggaggttgtagtgagctgagagcatgccattgcactccagcctgggtgacagagcgagagtccatctcaagaaagaaaaggggaaatgcaaagctattcagtagggatctcaaggtttttgaaagcaaacagtgtaatcatccaaacaaaaagaaaaagaagcaataatattaataaatacataaggtagaaaatgatagcagaatcgaagtaagaacaagctgagaaatgattttttatttttgaggcagggtcttgctctgttgcccaggttggagtgcagtggtgtgtgatcatgactcactgcactctcaaactcctgggctcaagaaatccttctgcttcagcctctcaagtagctaggactataggcgtggaccatgacacccagctaattttttatttaaaaatttttgtggagacaaggtcttgctatgttgctcagactggtttggaactcctggcctcaagtgattctcctgcctcggcctcccaaagtgctagaattacaggcgtgaaccacagatctggatgaaaatgatacatttaaatgagaaaaataaaggttaagtggagagatagccaataaccattgatatcaagactaaacaggaaaaatatcagtgtttcccaagttaattaatatacttaatttctattaatatgtaaatagaattcattatatagtctacataaataatttcaaaattcatatgaaaaagtaaatgagtcagaggatcaaaagacggcccaaattggtctgagtattgtgggttattgttaagctgatttaatattgtctcccccgacaaccatgcttgactagcttaaaagaaaaaaaaaaaggcccaaaaggagattgggcaatgtggagacttgctgtattagataagatatattgtgaggccataatcgtttatgtagccaaaaaagagaaatgaagactaacagaccaatgtaagtgtgagaagtagaatctaatttatgtaagaacctagagtattataactaagaccatggggaaaggtatttaaaattactgtataccatgtatcaagtactccaagaggattcaagttaaaaagtaaacccacaaactaaaaaaaattttaaaaggcagaatacatttttaaaaagttttttttttaattgacataataatggtacatatttatggggtacagtatctcgaactgctgagctcaagtgatccgcccacctcggcctcccaaagtgctaggattacaggtgtgagccaccgtgcccagccaatgtacacgttgggtaatgatcaagttagggtagttaacatttccatcaccaaaacacttgtcatttctttgtggtgcgatggttcaaaatcatctcttcatctattttgcaatatacattacattattgttaactatagtcaccctactgtgccatgtgtcaccagaactgatcccattgtaactgtgacttttacacctgttgatcaacctccatatctcctctttcctactaacctctatttactctctacttctatgaggtcacatttttagcttttacatacgagtgagatcatgtggtatttgtctttctgtgtctggcttatttcacttaacataatgtccattaggcttatccatgttgctgcaaatgagaggattttattcttttttatggctgaatagtattcctctgtgaatatattgcacatttctttgtccattcatcggttgatggatagttaggttgattccatatcttggctattatgaatagtgctgtattaaacatgggagtacaagtatctctttgacaaactgattttcttttcttttcttttttttcttgaaggatgaaaatgagattgatctttattgtagaatccaggccagggggctgctttgaaggcaagaatttcatgctagaaattccttattagccacacaaacttcttgtagcaagatagacttgtattactttttttttctttattatactttcagttttagggtacatgtgcacaatgtgcaggtttgttacatatgtatacatgtgccatgttggtgtgctgcacccattaactcatcatttaacattaggtatatctcctaatgctatccctcccccctccccccaccgcacagcaggtcctggtgtgtgatgttccccttcctgtgtccatgtgttctcattgttcaattcccacatatgagtgagagcacgcggtgtttggttttttgtccttgcgatagtttgctgagaatgatggtttccagcttcatccatgtccctacaaaggacatgaactcatccttttttatcgctgcctagtattccatggtgtatatgtgccacattttcttaatccagtctatcattgttggacatttgggttggttccaagtctttgctattgtgaatagtgccgcaataaacatatgtgtgcatgtgtctttatagcagcatgatttatattcctttgggtaatccagtaaagggatggctgggtcaaatggtatttctagttctagatccctgaggaatcgccacaccgacttccacagtggttgaactagtttacagtcctcccaacagtgtaaaagtgttcctatttctccacatcctctccagcacctgttgtttcctgactttttaatgatcgccattctaactggtgtaagatggtatctcattgtggttttgatttgcatttctctgatggccagtgatgatgagcattttttcatgtgtttgtgggctgcataattgtcttcttttgagaagtgtctgttcatatccttcgcccacttgttgatggggttgtttgtttttttcttgtaaatttgacaaactgattttctttcttttggatctatacccagtagtgggattgttggatcatgtggtagttctattttaatttttaggaaccttcatattgtttcccacaatggctgtactaatttatattcccaacaacagtgtgtaagagtgcccctttctccacatccttgccagcatgcattattttttgtctttttgatagtagccaatctaaataactgagttgaggtgatatcttattgtggttttgatttacatttccctgattattagtgatgtgcattttttcacatacctgttgggatttttatatcttctttttttcccctgatacataatagttgtatatgtcttttgagaaatacctattttgatttattgcccatttaaaaaatgagccttttttttgctattgaggtgtttgagttccttatatattctgtcagatggtagtgtgtgaatattttctcccattctatagcttgtttcttcactctgtggattgcttctttcactgtgcataggcttttttactttagtataatcccatttgtctagatttgcttctgttacctatgcaccagtgtcatgcaatgtttcccccatgcttacttctagtagtttcatagtttcaggtcttacatttaagctgttaatccattttgagttggtttgtgaaagatatgagagataggggtctagtttcattcttctacatgtaaatatccagtttcccagcactatttattgaagagactgtcctttcctcaatgtgtgtccttttttttttctttttttaagatggagttgtgctctttttgcccaggctggagtgcaatggcacatctctgcttactgcagcctctgtcttccgggttcaagtgattctcccatctcagcctcctgagtagctgggattatagacacccactaccatgcccggctaattttgtatttttagtagatatggggtttcaccatgttggccaggctggtctcgaattcctgacctcaggtgatctgccagcctcggcctcccaaagtgctgggattacaggcatgagccactgtgcccagtcacctacttttttgatgtagacatttattgccataaacttctctcttagaactggttttgctgtattccataggttttggaatgttgtgcttccattttcatatggaaacaacatttttagttttaaatttctttttacattttctcaagaaaattttaaatttcttttaaattttttcttttctgagacagagtctcactctttcgcccaggctggagagaagtggtgtcatctcggctcactgcaacctccaccccctgggttcaagtgattttcctgcctcagcctcccacgtaactgggattataggtgcccaccaccatgcccagctaatttttaaaattttttcattgactcattggttattcaggaatatgttgtttaattttcatggatttgtacagtttccaaagttcctcctgttactgatttttagttttattccattgtggtcagaaaagataattgatatgattttgatttttaaactttgtttagacttgtttgctccctttaggtctattaataattcctttatatatttagttgttacaatgttgggtgcaaatatatttataactgttacatcttcctgctgtattaatcattttatatggccttttatataatggccttctttttctctttttacagtttttggcttaaagtctatgtcttttgtattagtacagctactcttgaccttttttgtttccattttcatagaatacctttttccatcccttttctttgagtctgtgtgttcttaaaattgaagggagtctcttgtaggcagcatacagttgggtctgttttttttaatcctttcaactattctatgtcagcagaatacatttttgaattaatgaagcaatagaagaaacaacaagccagattagtatggctatattaaaaatttaaaacttataattgaaaacataatatagcaggatgaaacagaaagcactagaatggagaaatatttgagagggttaaaagtttaatattatagtatatgaggacatatttctaagattatgtcaagggaacttggtatgtaaacagtgtttcacaccataggaaacaaaataacaaaattattgaattatttaatttgtgatcattttaaaatataatcttaatgctgtgatataaatatctagtaactgaacaaaaaatgattttaaaatcctagtaaagctggtgagaaataaatatattgctttaatttgatttatttaactaatatttggtcatttgtaacgggagctattaaaatgactatttttttaatccagtaatcttacccttagaaatctgctttagagaaagaattgaaaagaataagaaccttggccaggcatggtggcttatgcctgtaatcccagcactttgagaggctgaggcaggtgcatcacctgagttcaggagttcaagacaagcctgggcaacatggcaaaaccccatctctaccaaaaagtacaaaaaactagctgggcgtagtgatgcgtgcctgtggtcccagctacttgggaggctgaggtgggagaattgcttgagcctgggaggtgaaggttgcagtgagctgagatcatgccactgcactccaacctgggtgacagagtgagaccccatctcaaaacaaaaataaaacaaaacaaaaaagtaataagaacctcatgtgtaggtcttttaaaacacataatttatatagcaaaaacaataaatagattaaaaaagctttgaaaccagcctaaatactcaaagtatttgatggactgactagaatacatatattaagttacaaatatgcacattagataaaatcatggaaacttacttgttaatattaaatttatgcaagacttaatgcaagacttaatgtatgttctacttattgatttgtgaagtttacctatgaagattgtacaattccatagtgacacagtgattttttttttgttttgttttttgttttgagacagagtcttgctctcttgccaggctggagtgcagtggcgtgatctcagctcactgcaacctcctactccctggttcaagcgattctcctgcctcagcctcccaagtagctgggattacaggcatgtgccaccacgtccagctaatttttgtattttttagtagagacagggtttcaccatgttggccaggatggtcttgatttcctgacctcctgatccgcctgccttggcctcccaaagtgctgggattacaggtatgagccactgcgcccagcccagtcattgttttagtacaaaataataggtaaatttaaattattgaaatgtagaggtttttttataagtatgaaggaaaagtcatgtcaggatctccagttggatatttatgtcctccagcaatcaacagatgttgaaaaacctctggcggttgacctgttgtgcttttatttacagtgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggtttgtgcctgctttgttgtgatctaagtgaagtctgcattttctctttttctattttggttttagctttttttctctttacagtatttttctttatcttttctggtccgtacccaggaacatgtattattctgcctccatgatattagcaaaatccaacttcttattttctaatctaaccacttgtcttaattttacctaatgtttgtaggttggaatacagatttggagaatttggaaactattctctcttggtaaagaacatccataatggagttagtgaaattgcctgtgacctggctgtgaacgaggatccagttgatagtaaccttcgtacgtatatgttctctgctgattttcacatttgcattttcagaggtttcagtttttgagtactgtttgtaaagcaaagcagtccatgacgctttctgtagttgaaaacctaaatcttaggtcattgatgagcaccactccccccaaaaaatccacataaattataggttatttctacttagttatgatgtatttaaaatatgtttattgtattatctgtatataataatacaattatgtgacattaaaaaattatttattggcctggcatggtggctcatgcttgtaatcccagcactttgggaggccaaggcaggcagatcactcgagctcacaagtttgagacgagcctgggtgatgtggtaaaaccccatctctacaaaaaatacaaaaattagctgggcctggcgatgcgtgcctgtagtcccagctacttgggaggctgaggtgggaggatggcttgaacctgggaggcagaagttgcaatgagccaagattgtaccactgcactgcaacctgggtgatagagccagaccttgtctcaaaaaaaattatatgatatatcaatacattctcatagtttttagtttaattatgaagcattaataagccaaaaatgttaatgcagtggaaagaaactagaaatagggtaattgactgtcaaatatctctccttgttttaggagtgagcgtatagtatttcctgtatatcttctgctgccagtccagagatcctcttaggttaaggagggatcattcattatctaataaccccactgaagaaaatctgccattcggaactccctattaggtaacaatgtatgtgctgccttttgaaaggcagtaacaaatccctgtggtgtgaacaagtactgttcacagggaagctattaaagactatgaggttatatcaaaagaacgcaggagccgatatgaaagggccaatgtaggacaatttaagcattaagaagaataatatatgtagtggaagaaaaataatgaatgtataaaaaccatgaggtcatatgaaactaagatgagcaaggcctgccttcccaaagaaaacaaaaacaatgctttgtctttataggtaatcagggcacctgatgttaactgtgtgatttaaaattgtcagttgaaaggagagatttaagcatttattttgcccgttttaactgtaattcagggtaaccaaagatagtccctgttgagggaaaattctgtggagaagaattccaggtaataaatacagcaaaagggcaggatatgtcgcaacccttaatgaagtaagtgattgtgattcaggcatatactatatgagtggatgaaaccacgaggtgaaggggaatttttaccagctgaacacatccaccagtcatggggcaaccgcaacaggtacactttcagtgttggccaggaagttattgttaatttcatatgacattgtgtttatataacaaaaggcccatttcaaagatacttttagttttgaaatagttttagatttgtagaagtgttgcaaaaagagttctcaaatatccttcacttagcttcccctaaaccctaaactgtaaaatcacagtgtaattatcccacatactattactgaaaccagcaacttaacattgttcttaacattgaacataatattgatacagtactgattggggttatttaaatttctctaaatgtcccttttaatatccttctccggtgctggatttgaggtaggatcccacactgcatttagctttcagatctcctttgtctcctccagtctaggacagttcctcagtctttctttgtctttcatgaccttgatggtttgaagggtaatgtctggttgttttgtcaactgtccttgatttggatttgcttgatgtttggtgttttctcatgaataggtagaggttttgcattttttactggtatacagcaaaagcgaggctgggtccttctcagtgccttgtgtgaggaggcacacagtgtcaggctgtctttacaagggctttagagacacatcctgaagtatgtagggatgaaataacatgatgtcttggattcctaaagaaatagtttagccagaaaaagcaggacatgggggtgggtgggtagttatagatgaagcaacagggacaatatcttgataattctaggatctgggtgatggattatatatagggtgatggtaccattctctgtgcttttgtttatgtttgatattttttataatgacaattatcactcccttcagggtgagcataggaaattcagcatgagaatataggcttcccctcactggttttcatttatagataaatgtaatgatgtgatgtctttgatgttcatgatgacatttttgggggctaatgtgttttcttctctttttctagctgtgagcattgcattccttattggtcttgctgtcatcattgtgatatcctttctgaggctcttgttgaggtaagatatttggggaggacgccactggaaaggcagagtatagaaataacacattcagaaggggcagctgtcaccctcaagtggccatattcttcgatgatatgaacatttctgtgtcccccatgtccatccagtgctaggcttcagggactcatgtagactaagacgtggtctctgactttagggaagtgatattaaaggtgcttgtggattttttccttccttcctcccacatggctgaagaggaagaaaatgcttgagaaatcattatttcctaaagcatccgactttttaacgagcagaagtggctcatgacaattttaggaggaggtcgctgcactgaactcccttccccctctctggccctgagccctgaggcaccttctagtccagctgcccaacctctgccagcccaggcatctggtggcacagatgtatgcctggtggctgttcttctggacctcgcacggactccctgtcccttggttagtttgttagccaatgtggagaagggactggtcctgctctgcgtggtgaatagcgattctggtaagagtgaattagtagactagaacaagaaagtaaaatagatccagttttaattaactttcaaaggaaagtttttttcatgttttaaaaagaataagagtgaattttctcatgcttatcttgttagggtctcaagaagaaccacaaggttttattgatgagcaatatccaaactgaaagaatgaaaacctaacctctaagtcggctagcttgggaaaccctgaagctttggggaatttctgcactgtgatactctagctttgtacatcttagaaatagtataattccatgtgtgaggaccccaactgtgtatagggtaaaagaaccacatgttgcccagaagccggtgtgtaacctgttttttagggatagaggaagattctagcagtggagtttcatttctttgagttaaggtattatctcatcaaccttttgataaaatgcaaatgctatttcagtatatcaggatgcttttcacgtaaatggatctattatggattttttttttttttgagacagagtctcactcttgtcatccaggctggagtgcagtggtgccattatggctgactgcagccttgacttcctgggctcaggtgattctcccacctttgcctcctaagtagttgggactacaggcatgcatcaccatgcctggctaatggtttttttttttttaatttttgtatttttagtggagacggggtcttgatatgttgcccaggctggtcttgaactcctcgactcaagtgttccatctgtctctgactcccagagtgcagggattataggcatgagtcaccacacctggtcatattacatgactttttaaagtaattggtagctaggccgggtacggtggctcacgcctctaataccagcactttgagaggccaaggcagatggatcacttgaggtcaggagtttgagaccagcctggtaacatgatgaaatcccatctctactaaaaatacaaaaagtagctaagtgtgatggtgggtgcctgtagtcccagctactcaggaggctgaggcacgaaaatggcttgaggttgcagtgaggtgggagggaggttggaggttgcagtgatctgagattgtgccactgcattccggccggggactctcaagaaaaaaaaaagtaattgatagctgagatcaagcattttcaaagggaagagattccaccttgccccatgtggaactgaaactactctttgcacatgatgctgcccttccagcctgcgggcagaatgctcttcttgacaaagcaggagtcccttattccttgccccctcgctttccaacatacccagggaggttcagatgactgtgagccaaaaaacaaccagaaaaagtcgagagaataaagagcccctctctttttcacttaggcaacaagcatgaacaagaaaattaagtatttttgttttatttttagaaatcttaacttctccttttcaccctttttttttttttttaattttttgaggtggagtctcactctgccacgcaggctggagtgcagtggtgcgatctctgctcgctgcaacctctgcctctgggttttaagaaattctctgcctcagcctcccaaatagctgggattacaggcacgtgacaccatgcccagctaatttttagtagagatgaggtttcagcatcttggccaagctggtcttgaactcctgacctcgtgatccacctgcctctgcctctcaaagtgctgggattacaggcgtgagccaccatgcctggccacccttctttagatgtgtctattttaacattttacatgtgatggtgatgttatccatgttgaataaactagaaatcagagttgagttgtgagggaaaaagagaaattgcaaatgtatgccttgggcatatggatcatatttggatactgaattgaaccactgaactataaaaacatgttatgaaacagggaaactgcactggctatgtgacggtattaaggaattactgctaacatttaaaaatgtgataagggtattgtggttatgtttagaaataaaaatagtccatatccattagagatacatactaaattgtttttgcatgaaatgatatgatgtctaggattttctataaaacaatccgaggcaggaatgagggacagtgggtgagaggacatatgaagtaagattggccatgtgtcgacacttgttgaagctggatgatggaggtccattattcaggcaaaccctgtgttattgtgctttgctttattgcacttcacagatattgcatgttttacaaattgaaggttcgtggcaaccctgcatccagcaattcttttttttttttgagacgtggtctcattctgtctcccaagttggagagcagtggtgccatcacagctcactgcagccttgacctcccacactgcagccttttgatttaaagcgagagacgtgcagccggacaccatggctcacacctgtaatcccagcactttggggggcctaggcaggtggatcgcttgaactcaggagttcgagaccagcctggccaacatggtgaaacccccatctctactaaaaatagaaaaattagctgggcgtggcggcgcacgcctgtaatcccaggtactcgggaggctgaggcaggagaattgctggaacccaggaagtggaggtttgcagtgagccgagatcgcgctactgcactccagcctgggtgacagagtgagactccatctcaaaaaataaaaaataaagtgagagacatgcaactctttcttttactcaaacgcttagaagccattgtagggcaattataattggcctaatttcaatattgttgtatctgaatgaatagagaggcccaaagagagggagggagatggaggaacagtcagaacatactcaacgcttattgaccttattgacctcccaggcacaagcagtcctcccatctcagcctcccaagtagctgggactagaggcatgtgccaccatgataatttttttttttttttttttttttttttagtagagatgaagttctcactgtgttgcccaggcttgcattgagtaattctgttggcaccatttttccaacagcatgtgctcacttcttgtctttgcattacattttggtaatcgttataatatttcaaactttttcatactattatatctgttatggtgatctgtgatcaatgatctttgatgctcctactgtaattgttttgggatgccatgaaccctgcctgtataagatggtgaacttaatcagtattgagtgtattctgactgttccacccactgactgttcccccatttctctccctctctttgggcttctctatcctttcagatacaacaatattgaaattaggctaattaattatcctacagtggcttctaagtgagtaaaagaaagagttgcatgtctctcactttaaatcaaaagctagaaatgattaaacttagtgagaaaggcatgtcgagagccatgataggctgaaagctaggcctcttgtgcccaacagttagccaagttgtgaaagttcttgaagaaaattaaatgttctactccagggaagacacaaatgataagaaagtgaaacaggctgggcttagtggctcacacctgtaatcccagcactttgggagcctgaggccagattattgcttgaagctaggagttcgagaccagcctggccaacatggcaaaaccccatctctactaaaaatacaaaattagctgggcatggtgttgcatgcctgtaatcccagctactctggagcctgaggcaggagaattgcttgaacccgggagtcagaagttgcagtgagctgagattgctccactgtactccagcctaggcaaaggagctagactctgtctcaaaaagaaaaaaaagaaaaagaagaaaatgaaacagccttactgctgatatggagaaagtttgaatggtctggatagaagatcaaactattcccttaagccaaagcctaatccagagcaaggccctagctcttttcagttctgtagagactaagagaagtgaggaatctgcagaagaaaagttggaaactagcagaggttggttcagaaggtttaaggaaggaagccatttccataacataaaagtgcaaggtgaagcggcaagtgctgatggagaagctgcagcaagttatccagaagatccagctaagataattgatgaaagtggctacactaacaacacagtttccatgcagatgaaacagccttctattggaagaagatgccatctaagacttttaatagccaggaaggagaattcaaagcttcacaggacaggctgactctcttgttaggagctaacgcaactggtgactttaagttgaagccaatgctcatttaccattctggaaatcctagggtccttaagaattatgctaaatctcctctgtctgtgctcaataaatggaacagcaaagcctggatgacagcacatctgtttacagcgtggcttactgactattttaagcctactgtcgagacctactgttcagaaaagaatatttttttcaaaatattgttggtcattgacaatgcagcaagtcacccaagagctccaatggagatgtacaagcagatgaatgttgttttcatgcctgtaacacaatatccattctgcagcccatggatcaaggagtaatattgattttcaagtcttactatttaaaaaataggtttttataaagccgtatagctgccatacatagacagtgatttctccaatgaatctgggcaaagtccattgaaaaccttctggaaaggattcaccattgtagatgccattaagaaatttgtgattcatgagaggaagtaaaattatcaacattaacaggagtttggaggaagttgattccagccctcatggatgactcgggggtttaaggcttcagtggaggaaataactgcagatgtggtggaaataaaactagaattagaagtgaagcctgaagatgtgactgaattgctgcaatctcatgacaatacttgatcagacaaggagttgcttcttatagatgagcaaaggaagtggtttctcaaggtggaatctactcctggtaaccatgttgtgaacattgctgagatgacaacaaaggatttagaatatcacataaatgtagttggtagagcagaggcagagtttgagacgattgactctaattttgaaagaaggtctaactgtgggtaaaatgctatcaaacagcatcacgtgctgcagagaaatcttgtgaaaggaaaagtctgtggcaaactgtattgtcttgatttcggaaattgccacagccacctcaacctacggcagccaccaccctgaccactcagcagccatcaacatggaggccagatcctccaccagcaaaaagattagaacttgctgaaggctcaaataatcattaactttttattagcaatacatttttaaattaaggtatgtaaactgtctttttgtgcataatggtattgcacacttaatagactatagtatagtgtaatatataacttttatatacactgggtcacagaaaatttgtgagagtcactgtattgtgatattggccttattgtggtggtctgggaccaagcctgcagtgtcttgagctatgcctgtactggtttctctgcttctgtgtaactgttcatgaccaaaaaataaaaggggaaaaaatcctatgcactggataatttgtttatgccagggtagggtatacttttcaaaagatttcttcccaggtagaaatctcattttaaagaaaaaccagttaatatatttatcttttgttagtcatgtaaatcaatttaatgttatctggatatctttcttttctttctttctttttttttttttgagacagagtcttgctatgtcacccaggctggagtgcggtggcaccatctcggctcactccaagctctgcctcccgggttcacaccattctcctacctcagcctcctgagtagctggaactgcaggtgcccgccaccatgcctggctaatttttttgtatttttagtagagacagggtttcaccgtcttagccaggatggtcttgatctcctaacctcgtgatccgcccgtcttggcctcccaaagtgttgggattacaggcgtgagccaccgcgcccagcctggatcattttgaattaaagcaaccatattcaaaaagaacccagtacattaactatttgaatcaccccaaagttgctttcaacttttcccagtgtgcacatatgcatttttgtttgtaattgaatgtaaatgttaggtttttgctttttgtatttaatagttgatctttttttttttttttttttttttttgagatggagtctcgctctgttgcccaggctggagtccagtgggcgtgatctcggctcactgcaacttccctccgcctcctgggttcaagcaattctcctgcctcagcctcctgagtagctgggattacaggcgtgtaccaccacatctggctaatttttgtatttttagtagagacatggtttcaccatgttggccaggctggtctcgaactcctgacctcaagtgatccacccacctcggccccccaaagtgctgggattacaggcaagagccaccatgcctggcctaataatttatatcttcatcttaatgtttctttgtgtgggcagagcccacattcttttgctttcatgactgtatcacatcctatcacacagctgtcatattctgtgtttagtcatccttgttttgagtaaatttggttgtttccaagtttttgctattttaattttaatagtattattagtgagaatcccagccacggggaatagttacctcatttaccttctgaagtctttaatgaaagctctgtcatcattcctgttttattgatgaggaaactatgctgtcagagttgagtatttataagtagagctgctgaaaattgtgatttctatttttatattgttaaaaaatgtttagaatgtttaattacttagtaatatagaatatgagctttaattttatttccatataatatccaatcatttaaaaaattctgccaatgaaaataaattaattgagccctttatttattttcagtttggatgactttaacaattggatttctaaagccataagttctcgagaaactgatcgcctcatcaattctgtaagttatgagatgcatagtgtattgcccaggtggttttctaaacttggaatttatagtttcttatttaatcattattgtccagttttatgtttatattgaggaaggccaggttgtagctcccgtattcctaatagagagcagccctctcttcagctgctgggaagggctccatcccttctcttgcttcagtgacattggaacgttccgctctatcaggatacctgaggtagagacatttttcactctgcaggcagcattgttgaatcaatccagttaagtagagagtgtcaaagttaaaacaaagaaataagagacaacaatattaaatctataaatgctgatggcctcctctaatgatttaaatatgtcattaaatttttgttaataaattcaggctcatttatggggatgttggcttctgtgcttgtgctagatgcacttacgactagtttttttggtgtcatttatcaatgtggccactggcaaactcagtaaaaggcaggaaaagctgataaagtacaaaaccagacctctagatgggatctttacaaaagcaaatccaagtattgtttagaaaaacttttttattttttgagacaggatcttactctgttgcccaggctggagttcagtggcgtggtctcaactcgctgcagcctcaacctcctgggctcagatgatcttcccacctcagcttcccaagtagctgggactacaggtgtgtgccactccacctggctaatttttgtattttttgtagagacagggtttcaccatgttgcccaggctggtctcaaactcttgggctcaagagatttgcccaccttggcctcccaaagtgctgaaatcacaggtgtgagccactgtgcctacagaaaaactattttttagctttctaaactatttttagatttctactatatcacattctttcctaaagaaataaaaaattgatgccggttgcggtgactcacgtctgtaatcccagcactttaggaggctgaggcaggcagatcatgaggtcaggagtttgagaccagcctgaccaacatgatgaaaccccatctctactaaaaatacaaaaattagccggacgtggtggcgcatgcctgtaatcacagctacgcaggaggctgaggcaggagaatcgcttgaccccaggaggtggaggttgcagtgagccaaggtcttgccattgcactccaggctgggccacagagcgagactctgtctcaaaaaacaaaacaaaacaaaacaaaacaaagaaatcaaaaaatgacaaaatgaaatttaccccttagcattatgagttgtcatctttctccctttttttctgaaggagctgggatctcccagcaggacagaccctctcgatggtgatgttcagccagcaacgtggcgtctatctgccctgccgccccgcctccgcagcgtggacaccttcagggggtatgtgggcctccctgtagcacagtgggtgcaggtagtcacaggactacataattgtacatacacacacttttagcttttaaggacttttacatatcttttactttctaggctaggaaggatttcttggatgtaaaagtaaactctgcagcctctccagtctggaagaccatcatgatcctcagtgtctgtattgacagaggagtagtggatgaggccagagccagtgtccacttggatacgtggtctgctgagtgaagggcatttttatttgggcaagtcgctgttacttggggctgcagactgtatcccatgtccagtcagtagcttgacggctcagaagatgcactagtctagcaaggaaacaccagcatgtggcagagggagggctgatcctgcgctgctagcagagtgacttgagtatcaggccctcgtgctagcaaacccatagccctggtagaagaacaagggccaggactgaaatctgaaaataaagtttaaaaactgtatagcgaagaataaatacacaggtatcagctcttttatttctacatactgaagccttctgaactctagtgacaaccctataactttgccccagtctcaccagagccctgagtgccctggcaggtagattggaagcaggtagtaagaacaatatgatcataatgaaacttgctaacaattctggagttctcataatgtgccagtcactgttctaactcgtcttaatttatttaatctcttagtaatcctatgagatatatacttttaatgtgcctgattcacattaaaagtaaaagaaattgtgctgctgagtgaagtaacttgcccaagctcactcaggtaccaaataggaaagccagggtttgatggcaggcacttgggttacagagtctcccaaattagtctgttgacacctaaggtcagcaccctcagcattctgcacagttagcctcaaacagtagcacatccggaatctattactctgtcttttagatttccattgctacttttggagataagatggtcacagatagacaggaactaacatttattaagtgtctaaaatatgctgggcactggttagctgctgtaaaatacatcattctccttaaaagtcacatgtggttagggcactttcttttacagatgagcacactgagtttactgatgagaaccttgcccagggtcttatggctaatgacagaaaaggatctaagattggaattctgagctcgctgactcagctggctgtgtgccttccaccagagttctttaacccgagacatctaaataattagcacaaaactgagttattggaaatattttgcaatgttttcaagttacatagtttaagactgcagtatacactttggttaagacatcatgttggcagtgttggcaatggtcctaactgtagtgcatggtcctaattgcgatgactagaaaataatcgcttcttggccttgatgtctcatcttgtgtaataaaatgctcagtagaattgcattgttgcatgattgcaccttgtgagtataaatgtgtcttcagttcagcccttccttttcacatagcaaaccctgaaaggcttctctttgttggcttcttctaggattgctcttatactcatggtctttgtcaattatggaggaggaaaatattggtacttcaaacatgcaagttggaatggtaagatatttcctaaaagtaatgttgcttatatacgtccttcacagagcttcagggcaggagaatcactcagcattctccccagaaactccagaaatgagccccagcagcctcctctgagccactgagctcctgctccctcctagggtgacctgtagatgattctgcgagccctttagttttgttcctccttttgtgtgctgtgaatctgtaaagcttcactgtaataacagactctagaagtttctgctgtgggactgagggactctgcagaatatgttatggatttggttgtaaatgatcatggtcatattctagatatgccttctattacagccaccatgctcttgggggctctgtcttctaggacttatggtcctttttgagatggcgttgaactaggattggtctgagtggtggtgaataatatctgtaagtctggcttggtagttgctttacaaatggattagtgcttcttaaacataacaaacgtgtctacatatttctagtttggttttcctgtgtctagttatgttcataggaagtgtcccagccaggtccagtgcttggttgcagagtctcaaggaagagtttgtgagtttactttctttttttaaaggcagagtcttgctttgtagcccaggctagattgcagtggtgtgataatagctgaccacagcctcgacctcctgggctcaagcaatcctcccacctcagcctcctgagtagctgggactacaggtgtgtgccaccatacatggctagttttttaaaacaatttttagtacagatggtgtctcactctgttgcccaggctggtctcaaactcctgggctcaagcgatcctcccaccttagcctcccaaagtgctgggattacaggtgtgagccacaccacacctggcctatgagttttctttttctttttcttttttttttttgagatggagtttcattcttgtcacccaggctggagtgcaatggcgcgatcttggctcactgcaacctctgcctcccaggttcaagtgattctcctgcctcagcctcccaggtagctgggattacaggtgcccgccaccacacccggctaatttttgtatttttagtagagacggagtttgatcacgttggccaggctagtctcgaactcctgacctcaggtgatctgctcgcctcggcccccacaaagtgttgggattacgggcatgagtcactgcgcctcccctgggtttactttctataccagtgtgtaatgaagtccacactagatttaggaggtatttgtattctagagtccttttgcttatgctttgtacttgttctgcagggctgacagtggctgacctcgtgttcccgtggtgagttgccggtctgccctcttctcttccacgggttgactccaatctcctgtttttcagatgatgctggagcctctcttctgagacgggcatgtgttatgtggttaggaagtccttccaaaagtcctgttactggatagttctcatacttgacccagtgcctacacgtgtgtataaaagagtgatttggggccgggcgcggtggctcacgcctgtaatcctagcactttgggaggctgaggcaggcgaattacctgaggtcaggagttcaagaccagcctggccaacatggtgaaactctgtctctactaaaaatacaaaaaattagctgggtgcagtggcacgtgcctgtaatcccagctactcgggaggctgaggaaggagaatcacttgaacccaggaggcgggggttgcggtgagcagagatcacgccactgcactccagcctgggcgacagagtgagacttcatctcaaaaaaaaaaaaataaaaaaaataaagtgattttatagggaatattttgttagtgtagatatggtatgccagatcctgaaaccttgtaggaaattatacattctgaacatgtagttcagttccattaatcctgaaaatacttataaaatcctatttcctgaagaattacagtatattggtatcagtgaatgctaataaatatgtaggtgggcaatgatagtcataaactaaaatttaaaataacagttgagtagctcaattctgtctctgatcattcatagcttcttattcttgtgaagggacattgcctatgtgatgtggaatttgtatctttgctatggtgtattaagtgacattgctccctcattagcaggtagtaccagccttattattgttattttttatttcaaattttaaatttttgtgggtacatagtttatatagtatggtagatatgagatattttgatgcaggcatacaatgtgtaataatcacatcagggtaaatggggtacccaccccctcaggcatttaccattttgtgttataaacaatccaattataattttttagttatttttaaatgtacagtaaattattgttgactgtagtcaccctgtcatgctatcaaatacttgatcttattcattccatccagctatatttttgtactcattaaccacgccccctccttccctccccactacccttcccttctggtatccatccttctatcgccctgagttcagttgttttaatttttagctccacaaataattggaacatggcttatttcacttaacataatgtcctcgagttccatccatgctgttgcacatgacaggatctcattcttttttatggctgaatagtacttcattgtgtatatacaccacattttctttctaagtgtctgttgatggatgcttagtctgcttccagatcttggctattgtgaatagtgctgcaataaagatgggagtatctcttcaatatactgatttccttccttttgcatatatacccagcagtgggattgctggatcatatggtacctctacttttaggttttgaggaacctctaacctattgtccatggtgattgtactaatttacattcccaccaacagtgtacaagtgttcccttttccccacctcctcatcagcattggttattgctgtcttttggataaaaaccattttaactggggtaagatgatatctcactgtagctttgacttgcatttctctgatgatcaatgatgttgagcaccgtttcatattcgtgtttgccatttggatgtcttcttttgagaaatgtctgttcagatcttttgtcctctttttttttttttttttttttttttcaagatgaagtcttgctctgtagcccaggtgggagtgcagtggcatgatcttggttcattgcaacctctgcctcctgggttccagcgattcttctgcctcagcctcccgagtagctgggattacaggtgcgcaccaccacacctggctatttttttgtatttttagtagagatgaggtttcaccatgttggccaggctggtcttgaactcctgacctcaggtaatctgcctgccttggcctcccaaagtgctaggattacaggcgtgagccaccgagcccggccttttaatccatttttaattggattattagattttttttcctatagagttgtttgagctccttatatgttctggctatttattgcttgtctgatggggagtttgcaaatattttctcccattccatgggttgtctcttcactttgttaattatcttcttttctgtgtggaagctttttacttgatatgatcccgtttgtccatttttgctttggttacttgtgctgtgtgaagtgttaatcaagaaatcttcacttagtccagtgtgctggagtgtttccccaatgttttctcttagtagtttcatagtttgaggtcttaagtttaagtctttaatccattttgatttgatttttttaatatgatgagagataggggtctaggttcattcttctgcatatgaatatccagttttctagcatcatttttttgaagagactgtcctttctccaatgtgtgttcttggcacttttgtcgaaaatgagttcactgtagctatatggatttagctctgagttctttattctgtcccactatctatgtgtctgtttttatgccactaccatgctgtttttgtttctatagctctgtggtataatttaaagtcaggtaatgtgattcttccagttttgttctcttgctcaggataactttggctacgctgggtcttttgtggttccatataaatttcagcatttttttttctatttcagtgaagaatgttattggtattttgatagggattgcattgagtctgtagattgctttaggtagtgtgaacattttaacaatattaatttttctaatgtatgaacatggaatttctttccattttttggtgccctcttcaatttctttcatcagtggtttatagttttcattgtagaaatccttctcttctttggttaagttaattttgaggtactttattttatttgtggcaattggaaatggaattcctttcctgatttctttttcagattgttttctgttggcatatagaaatgctactgatttttgtatgttgatttgtatcctgcaactttactgaatttgttgatcagttctaatagttttctggtggagtctaggtttttccaaatataagatcacgttatctgcaaacaagggtactttgacttcctcctttccaacttggatgccctttatttgtttctcttgtctgactgctctatttttgtactcattattagtgccatgttgaataacagtggtgaaaagtaggcatccttgtcatgttccagatcttggaggaaaggctttcagtttttcctagagacaccaaggaatgcagcaagagcaaactttcatctctgtgatcccttgccaagtaattagaaaaatcagtattctaacttttttttttttaaagagataatttagggccaggtgtggtggctcatgcctgtaatcccagcacttttgggaggccgaggcgggcggatcacaaggtcgggagattgagaccatcctggctaacacggtgaaaccctgtctctactaaaaatacaaaaaaaagaaaattagccgggcacggtggcgggcacctgtagtcccagctactcaggaggctgaggtgggagaatggcgtgaacccaggaggcggagcttgcagtgagccgagatcgtgccattgcactccagtctgggcaacagagcaagactccgtctcaaaaaaaaaaaaaaaaaaaaagagtaatttagtaatttagtatggtcaaagaaaagaaaggaaatgtgtattacttagactaaatggagagagaaaaagtaagctttcatttttctttcaggtgcagaagggtgtatagaaatgattgaaatgtctgtgtttcaagggctttgagggtgtgcttgtgaatgtcaagttatttgaagacattactgtggcttcgaatcatcatttctttttgataacgaaatgggagggttgtctttggaaattccatttaatattaaagaaattttctcctaagacaggacttgaaggtgcactgtcaaaaaccttccagccccatggggctatattctgaactcttcctctactgttagctcagtattatttcagtaattggctactttaaacaaattatggttgcttctcttttatagcatattataaaatgttactgatatatagacaaaaaatttggaaatggccacctattaataactagattctttttaggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccatgtaagtactttttccctctgttatatatattcaggttgaaatatggaaactatatgttgtaatttgagagaaatgcaattcctccatctcaggtgcctgcaaatagaataatcattaggaaagtatatacaatggttgtctaactgtgagcattattattattatttttgaattttagacctgggaggagcctctgagactactcaaacccttctcttgtgcagaggaaaagtctgaggccaagagcgattgaaggttttctctggattatctgagtgtagtgagaggcacagcagggaccagaccaggccgccttggtctccaactttgccccctgctaatgtgatttcatcagctttcttttttttttttttttttttaaatttatttatttattttttattgatcattcttgggtgttgggatttggcagggtcataggacaatagtggagggaaggtcagcagataaacaagtgaacaaaggtctctggttttcctaggcagaggaccctgcggccttggccttccgcagtgtttgtgtccctgggtacttaagattagggagtggtgatgactcttaacgagcatgctgccttcaagcatctgtttaacaaagcacatcttgcaccacccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcggctggccgggcgggggctgacccccccaccaccctcccggacggggcggctggccaggcagaggggctcctcacttcccagtaggggcggccgggcagaggcgcccctcacctcctggatagggcggctggctgggcggggggctgtcccccccacctccctcccggacggggcggctggccgggcagaggggtcctcacttcccagtaggggcggccgggcagaggcgcccctcacctcccggacggggcggccggccggaaggggggctgaccccccccacctccctcccggacggggcggctggccgaccccccccaccgcctccctcccggacggggcggctggccggacagaggggctcctcactttccagtaggggcggccgggcagaggcgcccctcacctcccggacggggcgactggccaggcggggggctgatccccccacctccctcccggatggggcggctggccaggtggggggatgacccccccacctccctcccgggcggggcggctggccgggcagaggggctcctcacttcccagtaggggcggccgggcagaggcgcccctcacctcccggatggggcggctggccaggcggggggctgatccccccacctccctcccagacggggcggctggccgggcggggggctgaccccccacctccctcccggactgggcggctggccgggcggggggctgacccccccacctccctcctggacggggcgtctggccgggcagaggggctcctcacttcccagtaggggcggccgggcagaggagcccctcacctcccagacggggcggctggccgggcggggggctgacccccccacctccctcccggacggggcggctggccgacccccccccccaccgcctccctcccggatggggcggctggccgggcagaggggctcctcacttcccagtaggggcggccgggcagaggagcccctcacctcccggacggggtggctggccgggcggggggctgaccccccccacctccctcccggacggggtggctgctgggcggagacgctcctcatttcccagacggggtggttgccggacggaggggctcctcacttctcagacggggcggttgccaggcagagggtttcctcacttctcagacggagcggccgggcagagacgctccccacctcccagacagggctgcggcccagcagaggcactcctcacatcccagacagggcggcggggcagaggtgctccccacatctcagacgatgggcggccgggcagagacgctcctcacttcctagatgggatggcggcggggaagaggcgctcctcgcttcccagatgggatggcggccgggcagagacgctcctcactttccagactgggcagccaggcagaggggctcctcacatcccagacgatgggtggccaagcagagacgctcctcacttcccagacggggtggctgctgggcagaggctgcaatctcggctctccgggaggccaaggcaggcggctgggaggtggttgcagcgagccgagatcacgccactgcactccagcctgggcaccattgagcactgagtgaacgagactccatctgcaatcccggcacctcgggaggccgaggctggcggatcactcgcggctaggagctggagaccagcccggccaacacagcgaaaccccgtctccaccaaaaaaaaccgaaaaccagtcaggcgtggcggtgcgcgcctgcaatcgcaggcactcggcaggctgaggcaggagaatcaggcagggaggttgcagtgagccgagatggcagcagtaccgtccagccttggctcggcatcagagggagaccgtggagggagagggagagggagagggagagggagagggagagggagagggagagggagagggagagggagagggagagggagagggagagggagagggagagggagagggagagggagagggagagggagagggagagggagagggagagggagagcatttcatcagctttcgatagtgtgcggcagttcacgaatccaccttcactggcacttgtatggcagctgggtttctggaaggagtaatatctttgtcattagtttagtggtgcgcagggacagcagagctgagggaaggcttgtgagccctctgctttgaatgagtatcagagtcgggagggcactagtcactgtcctcaagggccttgcaactgtcgttagcagaagaggacacaaacatctagacaatggccaaatggagccctcaggcaatatgtactttaataggcactagcaagaggtggaggtcacttctagatggtgtttcatatgaatgtggacttggtggatctccaaaaagggagccactgcttccagtaggattcattttagggtttgttgtcaggtctgttcttccggtcatacggttgggtagcagatagggcagggagggtcagtcagtggcgttcttggggtgatacagctgggtagtgggtagggcagggagagtggcttgtgttgggcctgcaaggtcctagcagacgtgcgggttgattgcaaattcctaataggaaagagccagggtcaggcacaggcctggctttatccccacacctgagtaagacgctttggttcttatcccagtctctcatctggccagcttcctgttttgagtttgagccatgtccctgactgaccctccctctattaagagggattggcctgtttttggaagctgggctgagcccatgtctcttgaccgtatatatttccatgtccaagagcttaaaaaagacttacttagatgcaatataggtatgtcttcccctttaggaaacaaataatgttgtcctgggatgagaggagaagtcctggctaacacttgacctaacttgtgtcttttgcagtgtcttgggacaaggtgcgcattcctggtgtgctgcagcgattgggagtgacatactttgtggttgctgtgttggagctcctctttgctaaacctgtgcctgaacattgtgcctcggtgagaaaccatgttttaattaagaaaaactttttttaaattaaaaaaaatgtattgtgtggtgatacggtctcactatgttgtccagactggtccctcactcctggcttcaagtgatcctcctgccttggccacccaaagcgccgggattacaggtgtgagccaccatgcctggccagaaactgtgttcttgttgttgttgatacagggtcttgctgtgttgcccaggctggggtgcagtggtgtgatcttggctcactgaagcctcaacatcccaggcttaagcgatcctccctcctcagtctcctaattagctgggactacaggagcgcaccaccatgcctggctagttttatttattcttttgtagagacaaggtctcactatgttgtccaggctggtttcaaactcctggactcaggtgatcttcctgcctcggcctcacaaattgctgggattacaggtgtgagccaccatgcccagccaaaacagtgttttttaaaaaaagggagaacaaagggggatatggtttttagaacttctaaaatttctgcatgcaatactgtacatctgctaatcaaatacattctgattttcactttcattagttatttttaatctttatgtcaatttttttattataaaatacacgacatgagatctatcctcttaacaaatttgtcagcagacagtaatcacatgcattcttttttcctcttatttttagttgatatgtaatacttgtacatatttatgaggctcagagtaatattttgatacctgtgtatcatacagtgtgtaacgatcaaatcagggtaattagcatattcatcacctcaaacagttattatcatttctttgtgtcaggaacatgcacaatcctctctgctagtttcaaatgcattctgttttatttacttcttggagacagggtctcactctgttacccaggctggagtgcaggggcacgatctcaactcactgttgccttaacctcccaggctcaagcgattctcctacctcagcctcctgagtagctgggactataggcatgcactaccatgcccagttaatgattgtatttattgtagagacgaggtttcactgtgttgcccaggctggtcttgaactcctgggctcaagtgatttacccacctcagcctcccaaaatgctaggactacaggtgtgagtcaccatgcctggcctcattttttttttttttcttttgagagggagtcttgctctgtccgccaggctggagtgcagtggcgcgatctgggctcactgcaaactccgcctcctgggttcacgccgttctcctgtctcagcctcctgagtagctgggactacaggcgcccgccaccactcccagctaatttttttttaaattatcctttaagttctagggtatatgtgcacaacgtgcaggtttgttacataggtatacatgtgccatgttggtatgctgcacccgttaactcgtcatttacattaggtatatcccctaatgctatacctcccctttccccctgccccacaacaggccccggtgtgtgatgttccccaccctgtgaccaagtgttctcattgtttaattcccacctatgagtgagaacatgtagtgtttggttttctgtctttgtgatagtttgctgagaatgatggtttccagcttcatccatgtccctacaaaggacatgaattcatccttttttatggctgcatagtattccatggtgtatatgtgccacattttcttaatccagtctatcattgttgggcatttgggttggttccaagtctttgctattgtgaatagtgctgcaataaacatacgtgtgcatgtgtctttatagcagcatgatttataatcctttgggtatatacccagtaatgggatggctgggtccaatggtatttctagttctagatccctgaggaatcgccatactgacttccacaatggttgaactagtttacggtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcataaatgtcttcttttgagaagtgtctgttcatatcctttgcccactttttgatggggttgtttgatttcttcttgtaaatttgtttaagttctttgtagattctggatattagccctttgtcagatgggtaggttgtaaaacttttctcccattctgtaggttgcctgttcactctgatggtagtttcttttgctgtgcagaagctctttagtttagttagatcccatttgtcaattctggcttttgttgccattgcttttggtgttttagacgtgaagtccttgcccatgcctgtgtcctgaatggtattgcctaggttttcttctagggtttttatggttttaggtctaacatttaagtctttaatccattgtgaattaatttttgtataaggtgtaaggaagcgattcagtttcagctttctacatatggctagctagttttcccagcaccatttattaaataaggaatcctttccccatttcttgtttttgtcaggtttgtcagagatcagatggttgtagatgtgtggtattatttctgagggctctgttctgttccattggtctatatctctgttttactaccagtaccatgctgttttggttactgtagccttgtagtatagtttgaagccaggtggcatgatacctccagctttgttcttgtggcttaggattgtcttggcaatgcaggctcttttttggttccatatgaactttaaagtagttttttccaattctgtgaagaaagtcattggtagcttgatggggatggcattgaatctataaattaccttgggcagtatcgccattttcatgatattgattcttcctatccataagcatggaatgttcttccatttgtttgtgtcctcttttattttgttgagcagtggtttgtagttctccttgaggaggtccttcacatcccttgtaagttggattcctaggtattttattctctttgaagcaattgtgaatgggacttcactcatgatttggctctctgtttgtctgttattggtgtataggaatgcttgtgatttttgtacattgattttgtatcctgagactttgctgaagttgcttatcagcttaaggaaattttgggctgagatgatggggttttctaaatatacaatcatgtcatctgcaaacagggacaatttgacttcctcctttcctaattgaataccttttatttctttctcctgcctgattgccctggccagaacttccaatcctatgttgaacaggagtggtgagagagggcatccctgtcttgtgccagttttcaaagggaatgcttccagtttttgtccattcagtatgatattggctgtgggtttgtcataagtagctcttattattttgagacaggtcccatcgatacctagtttattgaaagtttttagcatgaagggctgttgaattttgtcgaaggccttttctgcatctattgagataatcatgtggtttttgtttttggttctgtttatatgatggattacatttattgatttgcatatgttgaaccagccttgcatcccaggaatgaagccgacttgatcatggtggataagctttttgatgtgctgctggattcggtttcccagtattttattgaggatttttgcatcgatgttcatcagggatattggtctaaaattctctttttttgttgtgtctctgccaggctttggtatcaggatgatgctggcctcataaaatgagttagggttgattccctctttttctattgattggaatagtttcagaaggaatggtaccagctcctctttgtacctctggtagaatttggttgtgaatccatctggtgctggagtttttttgttggtaggctattaattattgcttcaatttcagagcctgttattgttctattcagggattcaacttcttcctggtttagtcttgggagggtgtgtatgtgtccaggaatttatcaatttcttctagattttctagtttttttgagtagaagtgtttatagtattctctgattgtagtttgtatttctgtggaatcggtggtgatatcacccttatcattttttattgtgtctatttgattcttctcccttttcttctttattagtcttgctagcagtttatcaattttgttgatcttttaaaaaaaccagctcctggattcattgatttttttgaagggttttttgtgtttctatctccttcagttctgctctgatcttagttacttcttgccttctgctagcttttgaatgtgtttgctcttgcttctctagttcttttaattgtgatgttagggtgtcaattttagatcttttcctgctttctcttgtgggcatttagtgctataaatttccttctacacactgctctaaatgtgtcctggagattctggtatgttgtgtctttgttatcattgatttcaaagaacatctttatttctgccttcatttcgttatgtacccagtagtcattcaggagtgggttgttcagtttccatgtagttgagcagttttgagagagtttcttaatcctgagttctaatttgattgcactgtggtctgagagacagtttgttataatttctgttcttttacatttgctgaggagtgctttacttccaactatgtggtcaattttggaataagtgcaatgtggtgctgagaagaatgtatattctgttgatttgaggtggagagttctgtagatgtctatcaggtctgtgtggtgcagagctgagttcaattcctggatatccttgttaactttctgtctcattgatctgtctaatgttgacagtgggttgttaaagtctcccattattatcatgtgggagtgtaagtctctttgtaggtctctaaggacttgctttataaatctgggtgctcctgtattgggtgcatatatatttaggatagttagctcttcttgttgaattgatccctttaccattatgtaatggccttctttgtctcttttgatctttgttggtttaaagtctgtttaatcagagacttggattgcaactcctgcctttttttgttttccgtttacctggtagatcttcctccatccctttattttgagcctatgtgtgtctttgcacgtgagatgggtctcctgaatacagcacactgatgggtcttgactctttatccaatttgccagtctgtgtcttttaattggagcatttagcccatttatatttaaggttaatatcgttatgtgtgaatttgatcctgtcattatgacgttagctggttattttgcactttagttgatgcagtttcttcctagcattgatggtctttacaatttggcatgtttttgcagtgtctggtaccggttgttcctttccatgtttagtgcttccttgaggagctcttgtaaggtaggcctgctggtgacaaaatctttcagtatttgtttgtctgtaaagtattttatttctctttcacttatgaagcttagtttggctggatatgaaattctagactgaaaatccttttctttaagaatgttggatattggcccccactgtcttgtggcttgtagagtttctgctgagagatctgctgttagtctgatggacttccctttatgggtaacctgacctttctctctggctgcccttaacattttttccttcatttcaactttggtgaatctgacaattatgtgtcttggagttgctcttcttgaggagtatctttgtggtgttctctgtatttcctgaatttgaatgttggcctgccttgctgggttgcggaagttctcctagataatatcctgaagagttttttccgacttggttctgttctccccgtcactttcaggtacaccaatcagacacagatttgatcttttcacatagtcccatatttcttggagctttgttcatttctttttactcttttttctccaaacttcttttctcgcttcatttcattcatttgatcttcaatcactgataccctttcttccacttgactgaattggctactgaagcttgtgcatgcatcacgtagttcttgtgccacagttttcagctccatcaggtcatttaaggtcttttctacactgttgattctagttacccatttgtctaatcttttctcaaggtttttagcttctttgagatgggttcaaacatcctcctttagctcggagaagtttgttattaccattcatctgaagccttcttctctcaactcatcaaagtcattctccaaccaggtttgttccattgctggcgaggtgctgcgttcctttggaggagaagaggcgctctgatttttagaattttcagcttttctgctctgttttctccccatctttgtggttttatctacctttggtctttgatgatggtgatgtacagatggggttttggtgtggatgtcctttttgtttgttagttttccttctaacagtcaggaccctcagctgcaggtctgttggagtttgctggaggtccactccagaccctgtttgcctgggtatcaccagtggaggctgcagaatggcaaatgttgctgcctgatccttcccctggaagcttcgtctcagaggggcacccagctgtatggggtgtcagtcggtccctactgggaggtgtctcccatttaggctacttgggggtcagggacccacttgaggaggcagtctgtccgttctcagatctcaaactctgtgctgggagaaccactactctcttcaaagctgtcagacagggacgtttaagtttgcagaagtttctgctgccttttattcagctatgccctgcccccagaggtggagtctacagaggcaggcaggccttcttgagctgcggtgggctccactcagttcaagctccccacctgctttgtttaccttctcaagcctcagcaatggcggatgcccttccccccagcctcgctgccaccttgcagtttgatctcagactgctgtgctagcaatgagtaaggttctgtgggcgtgggaccctccgagccagatgcaagatataatctcctggtgtgccgtttgttaagaccattggaaaagtgcagtattagtgtaggagtgtcccgattttccaggtaccatctgtcatggcttcccttggctaggaaagggaattatccgacctcttgcacttggggtgatgctccaccctgctccgtgggctgtacccactgtctgacaagccccagtgagatgaacccggtacctcagttggaaatgcagaaatcatctgtcttctgcgtcgctcacactgggagctgtatactggagctgttcctattcggccatcttggaacctcctccacgcccagctaattttttgtattttttagtagagatggagtttcactgtgttagccaggatggtctcgatctgacctcgtgatctgcctgccttggcctcccaaagtgctgggagtacaggcgggagccaccgcgtctggccgcctgaccccattcttgatagtattaaataataccaccagcatccagtttgctggttcagtctcttggggcattattgcgattttttcaatttccttgtagcataacatatatatgtgtaaaattcatgtaacgttttggtatctgttcaaatgctgtaaagttcaattttgaggataatccccaggtagggcatgggagagtgatggtattgtgcttggctatttgcattgcttctttatcagaagcatgtcggagtcccatctcatttgtgattacttcctctcttactataaattgctaggtggagttcactcaggtgacagttacttctttcccccacccaccattagtgacaaaaattccgacggaaatgtttaaattcttccatttggggtcctattcaacaatcagttaataaagccgtgttgtcttctagcttctttcaagatacgtaactagcaagttcatcactgaatctcactttctctgggtgcttcctacaatgttagttatctagtttggggggcgttttagtcattgttactctttccccctctgcccttgtcattaatgtgtcctctggctgtggatttccttagggtgaaggacaggcgagacgtgcctgagtgggcacagagcttggtcagccatggatatgaaagctgctattttcagcccttctgtgggacctgagggtccgcggaggtgcatcctgggccatcaccatagggtcaggggttcagtgggacactaagaacaggtgggctgcaccctttcttccttcaaccacagagatccaaaagtttgaatttcgttagtttacttattttatttttaaattttaaatcacaggtatattgatgtataatttacgtaccataaaactcccatgttgaaagtgtacaatttgatgatatttgctctattcagagttgtgcagctgtcaccagtctgtaattctggaaggttttccttaccccacgaagaaccctgcactaaccgccagtcactccccacatcacaactcccccagccccaggcaaccccagcctacttgttgtctctacacatgtacctgctctagacagtccgtatacatgaagtcatataacgtggctttttgtgcctggctgcttccacttagcatattttttgaggttcatccatgttgcatatgtcagcacttccttccaaaattgctgaattagattccgctttagggatacaccacattttgctcacccatttattagtcagtgaacatttgacttgtgtccccttttttgctgttgtgaacaatgctcctatatgtatgtgtacaagtttttgtgtgaacatatgttttcagttctcttgggtataggaatagaattgtctgctgatttcttttgaatgggtgttttgctgtgagatttcatggagagggaacatctggagaacctaacgtagtcagtaagtttttgtattactgccaaaaaggccaagaaatgagtcaccgggaatttcctaaagacatgtgcttagttcccttctatttgcatttagttcacccgtgttttatttttctgcccccactcaggagaggagctgcctttctcttcgagacatcacgtccagctggccccagtggctgctcatcctggtgctggaaggcctgtggctgggcttgacattcctcctgccagtccctgggtgccctacgtaagcgaacccctgggggtcatcccttgtgcatgtcctgttctgcccagtcagaggttctgggctttcacaggtctcgagtcagaggaattctctttccctcttccttctcctttgaggcctgctttgcatggggagaggagattggcacgtgtccagagtgatttccctgtgggtggtgtgagggtcagcttgaatagaattcgggcctcccaccttcatagtgtgggagcagtttgtcagtgagcgtgcatgagccagaaggacgttttagctggctcatgtttggggctctctgaattgggctgcatacatagccaatataaaccatgttttttttttctctttttggagatggaatcttgctctgtcgcccaggcaggagtgcagtggcatgaactcggctcactgcaacctgcgcctcccaggttcaagcgattctcctgcattagcctcctgagtagctgggattacaggcgcacaccaccatgcccggctaatttttgtattttaatagagacggggtttcaccatgttggccaggttggtctcaaattcctgacctcaggtgatctgcccgccttggcctcccaaagtgttgggattacaggcgtgagccaccgtgcccggcctgaggtttttttattcttgtccctctgttcgcccttatgaggtcttgtcatttacatatgcttttcaccttcctagtggttatcttggtcctgggggcattggagattttggcaagtatccaaattgcactggaggagctgcaggctacatcgaccgcctgctgctgggagacgatcacctttaccagcacccatcttctgctgtgagtgagactcgagttcgcttagaactggaactcaggctttcagaagtgaaggaaagtagaaagagccagcaaacgttaaaccatgcccatttaagaaaacacactgagaactgatgattatttgaaaagtcagctaacttaatgactttagggatcactgtatggcagtgtgtaaacattattttggattttaaagtgagaatgtggagctggacacagtggctcacacctgcattcccagctactcgggaggccaaggtgagaggattgcttgagcccaggaatctgagaccagcctgtgcaatagtgagaccccgtctctgtaaggaaaaaaaaaacaaaaaacaaaaaaaaaagcaagtgagaatgcattgtgtaaatgatcatagcacagtgcttttctgtacgtctcaggtcggatttcctggcagcagaccctgagacagagggtcacatgcaggaagtggatcaggcagtccttgcgggggaataaaggaggcaggaccgtgcagagggagaagttgacctgcacggtcaactttgtaggtagccccagcaaaggccccagccaatcttgggggcaccggggtggcgctgcagaattgttctgaattgaggcaaaggtttgggcccttcctacccctggatggtgcggaaggccccctgcagaaggctgatccctggagaggtagctctctttagtcaagggcagatccagaagaggcacctgtctgagagctgtggtcatgaatacttccagcagctggaggaatgaaggttttgtgctgaaagggttggagggctctgagggtgtgtgacagcacctaattacactgttcatttccagatttctacaatttctgcagtaacatttattttataataaaaaaagaaacatatttaaaaatgttatttgccttaaaagaagataggaagctgttgttgctacagtagggttgaccaaaaagaataaatctggaaattaggaaggtaccgtgcattgcatttgaagctggtcaggaaggcgtcatgtcacaaggcctggagccagcgctgtttgctgcccccgctgcaatcacagtggctgctggactgtgacttgtccctgggagtctctgttccctgctgagtgtccacactgcacactttcttagccggaagcattctgcctgttatccctataagttggcaatgaatttctgcagcaaaaacagaaaaccatgacatactggagtgtattcaggtttgtatttggtctaggagctgtttgtacgtgttttcagatcagtgagtgagtgctgccttctgcttctgtttgttaaggtactttaccacaccgaggtggcctatgaccccgagggcatcctgggcaccatcaactccatcgtgatggcctttttaggagttcaggtatttgttcatttcattaggttactttttctgacaatttatgatattttattcactcatttaaaaaccatttcattaaaataattggaagcatattctctcttgtgctatgggcctaatatattctgttatctttgacagattgtgcagaaccaaaagttactgaaattcagcacattcaagtaattagatataattcttatattctcaaaaaaattcttacttatatggcttatcttagcacggcagtttctagataaaaggtttcccttgccaagctgcagtggctcatgcctataacgccaacattttgggaagccaaggcaggaggattgcttgagtccgggagtttgagaccagcctgggtaacatagtgagaccctgtctctacaagaaattaaaaatattagccaggcatgatggcacacacctgtagtcccagctacttgggagctgaggtaggagtatggcttgaaccaaggaggttgaggctgcagtgagccttgattgcaccactgcactcctggctgggcaacagagtgagaccctgtctcaaaaaagaaaaaaaggttttcctgatggagtgtgcagagtgtgtgggtattggtaacattgggaagtcactgtgtcatttgtcacacttctttcatgtacactcatattagtctgtgtgtcctgacctaacaaaatacccgagactgggtaattcataaagaacagtaacactgcaggttcatttgtctggtgagggtctgggctctcctcccaaggtggcaacttgattggggcatgtccttcaggggggacaaatgctgtgtcctcacacggtgtccccaccagctggtgaaagggcagagacaggacttactgcctcaagcccttttctaaggccattcatgagggtggagccctcacgctgcatcccgtgaatgggattgttgcccttatgaaagagaagccccagagacctgccttgcctcttctaccatgtgaggacagaacaagaagtcgccatctatctgaaaacaggccttcaccagataccgaatctactggtgccttgatcttggacttcccaaccttcagaactgtgagaaataaaattctgtttttcagaagccaacaaaaaattttttttctcctctgtgctatctagtgggacagtccctagccagggtcgctgttgagcatttgagatgtggggagtgtgactgaggaactgaattttaaattttacttaatatgattttaaatttagatggtcacttgtggctagtggttcggctgttgggtagtgcagatctgaagcatacacaggtgaccctggaacacctcggggcatggggacactgtccccccatgcagtggaaaatctacagaggacttttgactcccccaaaacttaaacactaatagcctgctgtggacccaaagccttaccaataacatcaacagttgattcacacatattttatataaatattatatactgtgtttttacaataaagtaagctcaagaaaagaaaatgttattaagaaagccataaggaagagaaaatctagtcctattcattaagtgggagtggatcatcatgaagatctgcatcttcatcatcttcatgttgagtatgagtagtaggaggaggagaaggaagaggaggaggaggaggaggaagaagaggaggaagaggaggagggagtagaggaggaggaggatgaggaggaagagggggtggaggaagaggaggaggaggaagaagagaaggagggtgtggaggaggatggggtggaggaagaggaggaggaggggctggaggaggaggagggtgagggtgtggatgaggaggaggagggtgtggaggaggaggaggaagaggaggagggggtagaggaagaggaggaagaggaggaggaggggtagaggaagaagaggaggaggagggtgtggaagaggagtaggggtcggtcttgctgtctcaggggtaacagaggcagaagagaatccgcatataagtggacctgcgcagttcaaacctgtgttgttcaaggatcagctgtacattttggtgatgaaataattttgtatttagaaatacggcctttatctctgtagcactttctagttgatattgtgcttttccatatattccgtatattcatgtaatccctacatacactttctaggtagatcactggagcggtcagtccagtggggaggctaggagtgcagacctggagccacgctccctgggtttgtgtccagctctgccacttcccagctgggtgacctcgggcgtgtggctgactccctcttgtgcttcaacagcacctacttcagaagggtgttgcaaggattgaataagttaattcatgtaaagttctaagaactggcacataaaaaatgttgattaatattagctattactataaattatttttaaagcttctcatcctttgatgttttcaaaaatgaatacctaatttcagagggattgtatgtgaagtccatatttcactgtttttaaatgtttccctgcctcccccaccctgcctctggttccaccctgtcccggtccctcttcctagtgctgcccagactgggtcaccaaacaggcctgtctgacggaacccttgtcacctttgtggagaattctctttgggccctgcctggaagtaagagccacggagcctgcccaggtgccccttctcctcctttccccatgacctgggcttctgcattccctgcagcagtggagatgtggtgtggctaccatgcttcccccgagctctgtgcctgctgccccattctgctcaggagcctcttcctgcggggaccctctggtgctctggcctcacctctgtggctcgtcctctctgatgcctcctcctccccagagagggcgttcatctctggtcccatgctcctctgttagtctccactagtcaaaggcagaggtgatgtttcccgcctccctgtaatcccagcacctagtagcgtgcccagcaagtgaatctctttgtcaggtagttaagacagtggattaatatgaaataaaaatatccctttggcgattcttttggtcacactgtgttatctcctccaggcaggaaaaatactattgtattacaaggctcggaccaaagacatcctgattcgattcactgcttggtgttgtattcttgtaagtaagcagcattcctcgctaaaattcctttccttcacatgtatagatatttaaaaggaataaaatgtttagcaacactgagctagccattgtcaccacatggcagcaggtaccattttcttcacttgaataacagagaggaacaaatctttccacctaaatgcacagatttattttcttaggaaaatgtctttatcaataaggcagtgtttgccatcagatagccaggaatgcctgaagaaatgtgaggtatgggctctgtgtggagaggcgtatcagagagactgggcaaatcagaccaggttgcagacatcaacttccagattatatgggaaagagagttgcaaggttgactgtttgttcatttcatcctgaccgcagccatgcctcctcttcagagtcactgtcatttaatcagtaagcttaccctcttcaactcagtagaatggtgaagagattttgggagagtatttttcagttcatacatttaaaaaaatatgtttccatttaaaagagaaaaatataaggcacaagtttcagccctctctacgtgattaaataactaatatatattggtgttgaaaccaagtgttttctgagataataatataaaatgttaacatccttctcttccccattacaggggctcatttctgttgctctgacgaaggtttctgaaaatgaaggctttattccagtaaacaaaaatctctggtatgtatggaaaaagcatgattttatggatgactgttcatgctgaaattggatttgttccgtacgagcactgaaacgtctcctccacccctcccaggtccctttcgtatgtcactacgctcagttcttttgccttcttcatcctgctggtcctgtacccagttgtggatgtgaaggggctgtggacaggaaccccattcttttatccaggtaagtcacctccaacctcaaacagagctgggatggtgaccaggaggcaggcccagggacctctggagcatccttggtgctggggtcttgagccactgccctagcggcaggtgtccaaaagccaggctgagggaggaagcagcagggcccacattgtcccagcccacaccagatgtcactggcctgctccagagcagtccaccccattttcaccgtgtaggttgtggagtcgttgtatgacagtttgtgactccacctgtttcttcaggctataccaaattgtggaggagcggaaatgattcagggcacattatccagtttctggttctttttttttttttttttttttttttgagacagagtcttgctctgttgcccaggctggagtgcagtggtgtgatctcggctcactgcaagctccgcttcccaggttcacgccattctcctgcctcagcctcctgagtagctgggactacaggcgcccgccaccacgcccagctaattttttgtatttttagttgagatgggatttcacagtgttagctaggatggtcttgatctcccgacctcgtgatccgcccgcctcggcctcccaaagtgctgggattacaggcgtgagccaccgtgcccagcctctggttcttaataatggtgctatgcttgctttcttaatataaatccactactatagagattgtgcattagaagaaatagcaagaggtgatatcaagggataaatggaatgatttagatgcagttccaaccgaggacttagaaacacatcagatcatttcaatgcctcatttcagccctttgattcgaggaatagttacattctttggacctcagattttctgcctagaaaatataagttattaataataattttagctttcctttcagatttagttttcaagaattgtactgttataaaatgaatattatctaataccttttttgtgtttttgagacacagtcttgctctgtcgcccaggctggagtgcagtggtgtgattttggctcactgcaacctccgcctcccaggttcaagtgattcttgtgcctcagcctcccaagaagctgggattacgggcacaccccaccacgcccggctaattttgtatttttagtagagacggggtttcatcacgttggccaggctggtctcgaactcctggccttaagcgatccacccgctttggcctcccaaagtgctgggattatagtcgtgagccactacaccaggcctttcaataatttttgatatggtttatatttaaatacctaagatatgcattacttatttttggcagtagccaacaatggaagtgcacactttctgttttttcattgaactggtttcaagaattaaatagatggttagatgtgactcatctgtgagaaacatgatcttctgtatgtctctctccttaaggaatgaattccattctggtatatgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctctctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaatgatgtggatttttaaaataaatatttaagtgctggtaagatgagcatgtatccggggtgcccatgaaatgttcttggggccgtgtggggacagtcgtcattcctcctcctgccacccttttctttcagtgagtcactgtggatggtcccagctgtgtcatcccaaagttcagcagggaaagctgagctgggcctctccaggtgagttttctagaagcatttctcaaactgtgggttacatcaacttgggtgtcttgagctgtaaggaaggaactccggagtcagctgggctacaggggagcttctctaagtcctgcgggaggccagacccagcctgagcttgctgttagctagcggaggcagctgctggtggcccaggtgctcgacaccaggcatcccctctcctcccacgaagggtgtgccataatccccttcaacaggaaatgcttcccagaagcctctcagcagcctcccctcctgtcctatcagctagaagcgcctcgcttgtcccaagaccagcagggacagggaactgtccgagcccgtggctgtgtggaggaaggcgacccccagcacaagattggtttcctttgggaagggaagagggagtgtgttggggtaaggggtagagcagaggaatggtcagggggcaacaaccgctgacagctgcaacaggtgcatggcatctcacagggaggcagggaggtgcgagctcctaagtaatggagcaaaaaaattctattctgtagaatggggagagaaaatgtgacattttaatttttttttgcatttatattcctaattcctacttaaagtgaatatactgccgctgtagatcataaaatgtatcttttccatggccaacaaggggcatcttttataaatgcataataacccagtttgtatcaaagggtatcgacttaagtgaaatttcaacatgctgttactttttccttttaatgtaattctgttttccaaataaatgggggagacaaatggactttgagtaaatttcttagcatatcaaactgcctttcacaaacagatctttgtatggattctaagaagactaggagtaactgggtgcagtggcgtgtgcctataggcccaggcactcgagaggctaaggtgggaggatcccatgagcttaggagttcgaggctgcagtgagctatgattgcacaactgcattccagcctgggtgacagagcaagactctgtctctaaagaaagaaagcaaaacaaaattagggatagagttttaaaagtgctaagcaatacaccatataatccatgaccctattaataatgaagcttctggcataattccagcttttaaagtctttatcacacctcttggtaagctttgaaattaagtggggaaacttaccagttacatatttgtgtaatctatcagttttcactagaatgtagtaagccagcatttttcttttagtaataggtttctgttgagcattcattttaaaattgttcttcaagctacatgcatttccaaattcaaagtggatggaaatgcttggccaggcgtggtggcttacgcctgtaattcctgcactttggccaaggtgggtggatcacttgaggtcagaagttcgagaccagcctggccaacatggtgaaactgcttctttaccaaaaaatacaaaaagtcaggcatggtggcaggcacctgtaatcccagctactctggaggctaaggcagagaattgcttgaacctgggaggtggaggttgcagtgagctgagatcacggcgctgcactccagcctgggtgacagagcaagactctctcaaaaacaaaaaaaacaaaaacaaaaacaaactaacaaaaaacaaagttaatggaaatgctagatgtttgcattatgccataaaatgcctcggacttcataaatgccttatctaattgtgtttgtcaaaagactgtaataggcaaaatacgccatcacctgctggctgttctttccagaattccatccaaagtgctagatgtgaggacagctgtcttgcccactgtcaggaggagcttgtggcttcccacagtgtccattaccatttgcggttcggtggaatcctactctgactactggaaatttttctgtagaaatcagttctttttctgattttccacctttcatggtcagctgttcttgtattttatcgtatatgtagtcacacctatacttccataaacgagagtttctattctgatatttggtcacagtctgagtgtcatttggctacaaactggtgcctccctctccctacatcctatgcggctctgtccaggtcacagctggttgagcagaggtacagcccggcagtgtgacaaccccaggtgatgctttcctgtcaaaggacactaagaggacactggccactaacactgtcacagcagggaggtgcagcgtgaatggagagcaaagactggagacgtcttaaagggcggggtgcgtcaccgaggaggcactgagcgggatggctgtccttgtgaccacgccacctggattctgttcattggcgttgtccgggggagaaacaaaccgtctgtctttgtaataggaggcagcgatgcaagttgtaggaagacgcccactgaattgtggcttgcacaggcaggagggccctggcgtgaggggtggccagggagagcccagtgagggacgcagctctggggccccgcgcccctggaggttgccccggaggcagggcctcgaccttgacccacagggctgggtggggctgaaaatgggctcccagaccagcgcgaggagctgcgcccaggcctagcaggcggtttggccgcggctgcagcttagcgtctaggccacgccaggcaggctcccggagccgtccactgccccaccaggaacgttccgggctcttctgctgcgcgcggaagcaagtgaaatccagcctcaaagactctgatggaagaacacctgtgaataccgcgccctctaggcgtccgccacaccccacggccccccagacggggtcttcttttgttgcccaggctggagtgcaatggcgcagttatggctcaatgcagcctcgacctccctggctcaagccattctctcgccttagcctcccaggctacaggcgcgccaacacgcctaatttttttaaactttttttttttttttggtctagcgacggggctcactctattgcctagggtggtctcaaactcctggactcaagcgatcctctggcctcggcctctcaaagttctgggatttcaggcatgagccaccgcaccggtccttgagacttttgacctccgtgcccgcccctccggaatgcccaccccagccaaactcctctctctcctccagctggtggctggggcacggccctctccaacacctctgcccctccgctattgaacttcacatccaagtttatgtcacttctctgtgcccaggccatcggatggccccagctgacagtggcatcccgtccctacagtttggggcttcacccatattcacaaaggaccaggggggtaaggacccccaaccaggcacccacgttggtgaaggctccccacttcctccatcagaatccaccgctggggaaccctggccattcgcgggagctcccaatattccccagtaggcgccccgcccaaactacatcccttctctccactagacctgggctactctctgggagaatgaaatggcctctgccagacagggactcacccaggacacaacccctcatcccgttgaacagactgcgtatgtcctctaggctcaaggaaacctgacttgctgggcctggggcccttaggcctgctcttattcagtattcataagaatcagcaaagcgtttcatagagtccacagattcatgcaaaaagaggagaaaagcacaaacacagcagcacacatgcacaagcacacacacacatgcacacacacatgcacacacatacatgaatacacacaagcacaatgcacaaacatacacgtgcaaacacagacaagcacacacaccacacacacaagcatacacatatgcatacatgcacaagcacacacatacatacgcacccaagcacacatgcaaacatgcacacatgcaaatacaagcaaacatgcacaagcatacagatataagcacacacaagcacacacacacaagcacatatacacccaagcacacatacaccaagcacacacacaaacacacgcacaagcacacatgcacaagtgtgtagaaacacacacaaggacatacgcacaagcatgcacatgcataagcacacacaagcacacatgcacaagtgcacacgcacaagtgcacacaagcacacgcataaacatgcacgagtacatacgcacaaatgcacacgtgcaaggacacagacacgagcatacacatacgcacacacacacacaagcccgcatgcacagagaccttcaaggggctcccccccggcccaagaggaagtcattccgacttcctgcctaggtcctgcagccagagcagcagcaaatgccccaggagacggtcctttcaacttcctgcgcccctcggctctctgacaggcccaggccaggccttattatccctcagtgtggagcccagtgcaagcgccatcacctgctggagggagccgggactccgcacccgggcctgcccgtagaagcctcgtgcgctcgtggctttagtgtgcccttttcctccatgcctgcagtaagagctgaggcttgaccaaacattccgtttgtttcgagcattggtaaagagcaggccaaagggcccgaggccccacgttggcggctgccttgggactagcaggcacgctttgcaggatgggtccagtaggtatagagatcgtttgcgttcttggtccatctctgtcattcccctagagagcagggtaggcctagcccccatctctgtcattcccctagagagcagggcaggcctagcccaaggaaggtctattcggccacaggtttgggccacagcccctggtttggcgaaaaggggggtgcatgcggctggcctgggcagaggacataggcaacctttgccgatgggttcctgggccccgggtcctgtccacccgtggtcatatgtggacatgggtgaagctccaaactgtagggatgggatgtaactgccaacaggggtgagaaggtcctgggcggggaccgtgacagaggctcctgtgtgagatgtttgacagtggaggggcaggaagtgatggagggggccgtgttcaggccatctgtaagaggagagagagaggcagctggcagtgggtgtgcagtaggggtggccacagagagcctagaggccccctattcccagacagactcccatccaaatccttggagaaccccattagtacagccgggaggggaaacggtatggaggttcttcaaaaaattaaaaatagaactgtgatatgatccagctgtgctaagtatttatctaaaggatatggattttgcatattgaagagatatctgcattccagtgttcattacagcattgttcataagagccaaccttatgaagtcaacctaagtgttcatgaatgaatgaatgaatccagaaaatgtggtatatattgacaatggaatactagtcagcctttaaaaatagaaaagggaatcctgtcatttgtgacaacatggataaacctggagggcattaactgaaataaactaggtacagaaagacaaatcccacatgatctcacttatgtagaatccaaaaaaggaattcacagaagcagagagtagaatggagattgtcaggggcagacgagttgattgaggagatgtgggtcaaaggatacaaaagtccagttagacaggaggtataaattgaagagctgcatagtgcaacatggtgactagagttaacaacaatgtgtttacgtctgtgaacctgcagagagaagtcacttgagaactgctgagacagtagattttaagtgttctccccacaacaataaaagtttgttaagtgaggattatgtgaattagctggacttaggcattctacaatatatacatatatcaaaacatcacgttgcgcacatacatatatacaatttttatttgtcaattaataaaactttgataacagaacaccattatgatattgactattgaagcttatactttgaaaattttctaatagcaacattgtgtatttacttcatactttatattactgtattcagtttactgggttcttatgaaataaaataatgcagcaaaaacaaaacacatcatcttctttgtacatttctggcaagacatctgcatagtaagtaatttggctttgcccaaagagaggtctggccccttctgttgacttcagggaggtaacccatatcacacctgacagagtgtccttgtgtagagccgggctgaccacactggatctaatggagaggctgcccacacctaacagtctcagggtatggggtgattatgccagaaagaccaatcatgtaacctagggtagtggctttggtcccctgatatgagtttgtttacctgatgactgacttgacccatgtgagaaatcatcagtcagtcagtcatgtctacataggaaagccccggtcagatctctggacagcagagtgtgggtgggcttccctagctaaaaatactcctagtgtgttgttgtgtatccatgcaggtaggctaacacatccggaggacagtggaagctttgcatttataaatctcccagactcagctctgtgggtctcctcctttggctgatatgagtttgtacccttgccctgtaatacactataaccatgagtataatagcttccactgagctctgtgagtccttctgtgaattactgtatctgacagtggttttgtgaacaccccaagcttgcaaaggcagtcttaaggaatgtgccatgagactttgcagtttggctacttctggggagtactcaacagccaatctcctagcatactattattctataatatgcatcaggattaatcaatatgcacttgggcttagctgtaaatttatgaaaaataattaaaatatgtatctggtaaaataaataccagtagctgtatgcattcggccctaactaaatgctaggtactagacaagtattatttgcttggtttatcacaccaacctgtgagatacatagttatgcctaattctaaggaagaagagaaataaaaaatttaaaaaaaacccagttgattagaatgctactcacacactgtgttgggagaatgttattttaacagtatagacatggtgactataacatgtttaaaagctgtttcttagaatgctttctatacactatgttgcaaatagttttatttcagagactggatatggtggtaacacaataatgcctatagtgtaaagacatatttaaagatgtttctgagaaagctatgtacacactatgttgagatcagtgtcatttccaagaatggatgtggtgagcactctgtatgtagcgttaaaagacacatgtttacagatatttctaagaatgctacacgtacactatgttgtcgtagtcttattacacagaacggatatgaaaacccccaagtaatgcatgaggtggatgcagagacacacatttcacagctgtttgtcatcatgtttctcatacaccatgtggagaacagtgttacttcaggtggaggtgaagcccacactctaatgcatgcagagttgggctaaaagacacttgtttaaaagatatttcttacaaggctacttgtacactatgtcgcatacagtgttgtttcaaagaatggatgtgatgaccataaaataatgcctatagcaaagtactaagacacgtgttttaaagctgctttgtggtattctacatacatactatgttaagaacaatgttttggcagtgagtgatgtgatgactgcaccgtaatgcacttaaggaatgcttaaagagaggtattacaggccaggtgtggtggctcatgcctgtaatcccagcactttgggaggttgaggtgggcggatcacctaaggtcaggagtttgagactagcctgaccaacgtggcgaaatcccatctttactaaaaatacaaaaattagctgagtgtggtggtgcatgcctgtaatcccagttatttgggaggctgaggcagaagaatggcttgaatctgggaggcagaggttgcagtgagccgagattgtgccattgcactccagcctgggagacaagagcgaaactccgtctcaaaaaaaaaaaaagacataggtattacagatgtctcttgaatgttactcttacactatgctgacagcagtgttatttcagaaaatgtctgtggtgaccacactccctgaaactaaaacgactagatgaacacactggggaaaatctctatgacattggtctgggtgatagtgttttggatgtgacccccaaaagtacggacaacaaaagaaaaattaagacaaatgggattacatcaaagcaaaaagcttctgcccagcaaaggaaatagagtgatgagataacctaaggaataggagagagtctttgcaaatcaaactcctgaaaaggagctaatatcccatggcttctaccggcatccatgaaaatggcaggttaatatgacgacttacaataggatggaattgaagaagctgcacacttatggaaagttttggtaatgaggctgggatgctgagagatgactttctggcccctttgtaggcctggtaagaggacctgtgaattctcttggccaagtggtgagcaaggtggggatgagtgtcctgcactgtcctgtctgcgaatgtagcgacgagtgggtgagacaggattgaaacaagcagcctgagtactttgcttgttcatgtttctcctgctaggaaaaaggggtaaggggtccccagagctgacactgagccttgaatgaatccaaagcactagaagttgatatggttgatctgtgagtggcaagaggctgctagaaactaaaggaaaatgtgctttgttagtggctttcttaccagcatggaggtgcccattccctctgcactccgtaatcacccatccaccagtatccaacttcagcatcttgaaagattaagccaagtatgaatgggtatttgagagaggagagtaactctttggagataggtgttcagttaaccatcctgtgtagtcccctggagcacacggggagctctgggtgcagggtaggtggaagccccagaggactgtagggtctagagtggtggcaaatgggcagaaaggagtaaattccggatcctgggtgctctccaaatgctgggatgcccacaggggagaaggtagcacaacccttagagaaaaatcccatcacccaaaccctctcctcaccctagccccttctggccccttgtgcctccacacccttgcacaggggatggtgcaatcttaagtcagcccctgactcagacaggtgtgaatcaccatggtctgtgcttactgagctaatgctaagcgtgcttcatggctctctatagtaaatcaaaaatttgtttgggtgacatatgaccaatgagagttctgtaaatatgggtattaatgaacactatgtgacaatgaagccttttgtattatagaagcacatattcaatgaattctaagcacaatcccaatagtacttatctcattcttaggtcatctttgcaaaggaggcaaagccaagccaggtcctgctgctttgactgatggtgggaagaggcggagtgcatgggtcaccaggcagtggggaagagaggaaaccagcgtggattgcacttcactcacccagctctgtcctcctcctctgattgacatgctacaaagctcagtagggtgtggtttcatagcctgggactcaagaatccgggaattatatgaggacccagcccaggtgcgtctttgggaggcacacgtgagtatctggagtatacagaagacagatgcactgtttactcagggcatggtgtgccaagccgtgtgctaacagcaggttataggctctgggtgacttattctttgggctaactcaacaatggaggaactcattatccttattttacatgaggaaactgccgtttagatggaataaataaatagacaggattaaatggctggtaaatggtaaactgatatctcaaagacaggtcatctgatcgtactttaggtgagctaggcagcctcatgccagctctctacgaaaatgccacaagcagcagagggtgtcatttgagcctttgatgaacaggagaaaacctcaaacgttgccactcatgagaatggggttaagattgttacaacatttgacgggacacctatttgtaacttttttttttacttcactgggaaggagggagacacccatttttatcttaatgcagtccatgaaagtgcctgtaaggcttatatgggttcaggccgggcacggtggctcacgcctgtaatcccagcactttgggaggccgaggtgggtggatcacctgaggtcaggagtttgagaccagcctggccaacatggtgaaaccctgtctctactaaaaatataaaaattagccagatgtggtggtgggtgcctgtaatcccagctactcaggaggctgaggcaggagaatcgtttgaacctgggggggtggaggttgcagtgagaggagatcgtaccacttcactccagcctgggggaaagattgaaacaccatctcaaaaaaaaaaaaaaaaaaaagacttacatgggttttgagtctatctcttggataagactttacgtggaatatattttatctcaaaaagcatttattcagccactgataactctatgaagctctgtaaaatatgtaatgattagacggattaggtgtttcatctgagatgagtaactgtgtttgtaataaaatgtatttataaataagtatgatcatgaatatttaataactagtaaccacttgaatacatgtctttggccagaatatttacatatatatgtacctacactatataatacctattatgtataatttttatatatacactttatattatattacaatatagctgcaccttctgtggcttttgtgggctttattacccaccaaggtgtcagccatcaggtcctcaacagtggcagtgaggaaatcaggcgtgcatgggccaagccactgggcacagtggatctcccacgagaggggtccacagagttcagggggtatggcagctctgctcctgctgagagggtgccaggcagcttcctaagcctataggacctctaaaagtctcctttttctagacacaaggtttggtgaatggtgtggctcggatgttatttgtccccaacaaaactcatgttgagctgggtgtggtggctcacacctataatcccagcactttcggagactgagatggggggatcacttgaggtcaggagtttgagacaccagcctggacaacatggcaaaaccctgtctctactaaaaatacaaaaattagcccagcgtggtggtgcgcacctgtagtcccagctactcgggaggctgaggcaggagaattgcttgaacttgggatgtggaggttgcagtgagccaagatcatgccactgcattccagcctgggtgacagagcgagactccatctcagaaacacaaaaataaaaaatctcttgtgaaatttgatgccaatgtggcagggttgggaggtgggccctagtgggggattttaggtcatgggtgtggaccctcataaagaatgccctcttccaggggtgagttctcactgtcattatttcctgcaagggcaggttgttagaaagagtctggctctcttggtttctctcttgattcacctcttgccgtgtgatctctttgcacacaccttccactctccaccatgagtggaggcagcacgaggtcctctctagaagccgagcagatgccagccccatgcctcttatagttcgcagcctgtagaaccctgagctaaataaacctcttttctttatagattatccattcttaggttgtgtgatagcagcacaaaaaggatgaagacagggagctttgctccgattggcccagcttgatcctgcccctggcctgggccactcaagatgccagtgctcactcccaccgttgtgttcctgtgggccagcccctcactgggatgccattggtgtccacttggcctagaagtgcccatgataggaccctggtcatcctagtgaccaaacctaacctttcatttgactttttattgtagaaagaaatgcgttctggctggtggtagctcatgcctgtaatcccagcacttcgggaggctgaggcaggtggatcacttgagctcaggagtttgagaccagcctggggaacatggcaaaaccccgtctctagcaaaaatacaaaaaattagccgggtgtggtggcatcgcttatggccacagctactcgggaggctgaggtgggaggattgcttgagcctaggaggtagaggttgcagtgagccgagattgcaccactgcactccagcctgggtgacagagtgacctatctcaaaaaaaaaaaaaaaaagaaaaaagaaaaatgtgttcttcagtggaaaaccttaccctctttagaagataccacgccaggttatctgactctagtctgcactcaatgtgtgttttgcaaccctttttaagttttaggtcactgatagacatgcacaatgtgttgtccagtccagggtcaattttctctcctctcacagaggaaggaaatgagctttcttcccatttacatactcatttaaatactcctggttaatattcctctgtttgttggattctttttttctactggttattgtatctgctaatctcttataagttaaataaaatattttaacatgtgtttgtatctttatgagtgccagacttaatttttttaaaaagatgtattttaagcatttttaaggtcacaccaatatgcccaattgattcaactactaggaccagataaatttctatgacagaaagttgcatcaaatgcataactgaagcctgggcgtgtcttttcttggctctcctgcgtgactgcaaaacatcagtggaaatttgttgactctgcttttctcatttcaattttccattctgttaatttcatgttgatgagttttttgccacatttatagctgaaaagctgtttccacttttggcacaagggtttggagtttatttaattctttttattaagataaaatttatataacatttaatatattaatcatgttagaatttacaactcagtgctttttgttgtgttcacaagattttacaatcatcactatgtagttccagaacagtatgacacccccaaaagaaacctcacacccattaagtgctcgtttcctattgctcccctcactccccaaggccctggtaaccactaatccagtttctgttcctatggatttgcctattctgggcattttatacaactagattaataaagtctctggctttgatgtctgccttttgtcattgatcatgttgttttaaatagccgtccatatagaggcacatatcagtgcttcattcctttgtatggctaattgtccattgcatgaatgtgtctcggctgtgtatctagtcttccattgagggacatttgggtggtttccactttttggtgataatcaataatcctcgtatgaaaagcatatcaagtctttgtgtgggcatatgttttcatttctgttgggtatatcttcaggagtggaattgctgggccatatgataaccctatgttaaccttgggagaaacttccaaaatgttttccaaaatggctgcctcatttcaccaaccccccagcactgcatggggctctagtttcctcatgttttcccccacacttgtctgtcttctgaactacacccatactaacaggggtgaagtggatgttgagaatgtcttctgtgctcattgccctcttgtatcatttatttctctatcctgatgtgttgtcatcactaataattgaaagtcctcagaatatttatcccaagttaatttacacatgaaggacatttacaagggtataaaatgatttcctcagtgaatgtagttgtctcatttatttgcaatgtactggatgatagatttgattttcttattagcatactctgcaccctttttgaaataaaccatctgtcatcattttgtatacttagctagtaattttatgtcaaaattcataattcttcctggcctattttaaaagtttgggtatagtggatctaatagcacacacagtctttccatggcttttcttttttttcatgattaatgaaatggatttgaaagatgaatacctaaacttgaaaaacatgggaaaaagtgtcattgaaaacaatgaccacttttggtgaatgcttccaaatattaaaaaaaaaattttttttagtttctaattattcccagttgagttgagttgacacctcctaggagggcagaggctccgtttctggatcacactttctgtcacgggactgctcatagtggtgcttcaacctcggcacggggagagtaaataactgcacagtgtagaagcaatcaaggcagcccacataaactagagctatgcgactaacttaggagattgtctagtccttccacagcaggcagagctaagcctggatgccctggtcatggcccatgaggacaaaggggctgactgtgggaaaacaggcagtgatgagtgcagccatagaatggcaactatattatatagaaatcacttttctctgttttctaatttattaccataaggttgtttatattagtctctacgggtttaaaaactatcaattgttttaatcgtgtttattaatatttaagttagtctcttcatctttttctcaccattgcactaggtctgtgtattttatcataattttattccttttttgttatattctatgtaataattattctatattttactgtctaccttatgctttgttgttacacattactgtatttagcctatgcttctatgtataagttccagagactgacattaagcatgcatattgtcggcatcctttattctagtaattgaatttgcagttatcttattttgcctaaaactcttgaatcaaatagcgtgcacaactttgatttggaggagttatattgtcttctcgtgtaaaaaataatattaggaatattgcctagttttaatctttaaaatttaaaattctttaatatattatttacaaatattattacattataagtagcaaagctaatctctttgattaaaatattttatgcttggtaaaactttctttgaggccaggcgcagtggctcatgcctgtaatcccagcactttgggaggctgaggagggcagatcacaaggtcaggagatcgagaccatcctggctaacacggtgaaatcccgtctctactaaaaatacaaaaaaattaaccaggcgtggtggcaggcgcctgtagtcccagctactggggaggctgaggcagaagaatggtttgaacccgggaggcggagcttgcagtgagccgagatcgcaccactgcactccagcctgggctacagtgcaagactccgtctcaaaaaacaaaacaaaacaaaacaaacaaaaaaactttctttgatatacctaatgctaaatgatgagttaatgggtgcagcacaccagcatggcacatgtgtacacatgtaaactgcacattgtgcacatgtacttaaacaagtataataataacaaaaaaaataaaataaaattacattcaaactataaagttggagtttttatcaaaaagtacagacatttataataaaaacaaagtattttcataattaagccttgtaagttcctattttttttattttatatcaataataaccagcatgaaaaagcaaaaaaaaaaaaaacaactttctttgagaacaaaatatttcaatggtttcattgtgctgaaaaatgtgatacaaagctcagattcagcatatgtcaattaggacaagcatgtgtgtcgtattgttgaaaattttgaatcatcaataaatgttatctgtgttatcacaaatataatcacatcacaaagggtctgttaaagtttttcactgtggtcaaagaactgcacattttatcttatgattctgtcaaaagttcccccttactattcaaaccagcaattatcttccctaaaaaatgaagccatggccgtttttcccagataccttgtcttcagctcctccatggacagtggacggttccaccatagattccttcccaaagatcagaatgtgtggttcatcccacttctttctttggagcaggctaattgagattatcacttgagagataagaatacagaatattctacctccaaagtgttccaaaaaccagttggttttctctatgatccctctccctctttttttttttttttttttgagatgaagtcttgttctgtcacccatgctggagcacaatctcggctcactgcagcctcttgactcctggttcaagcgatcctcccacctcagcctcccaggtagctgggattacaggcatgcaccacctcacctggctaatttttgtaatttttagtagagacggggtttcaccatattggtcaggctggtctcaaactcctgacctcaggtgatccacctaccttggcctttcaaagtgctgggattacagacatgagccaccatgcccggccacaattctaatatttattagctgtgaatcaagttctaattaaaacttcttgataagattcttggctgggcatggtgggtcaggcctgtaatcacagcactttgggaggccgaggcaggtggatcacctgaggtcaggagtttgagacgagcctggctaacacagtgaaaccccgtctctactaaaacttataaaaattagccgggtgtggtggcaggcgcctgtaatcccagcttgtcgggaggctgaggcaggagaatcgcttgaacccaggaggtggaggttgcagtgagccgagatcacaccattgcactccagcctgggaaacagtgagactccgtctcaaaaaaaaaaaaaaaaaaattcttgtgctcactttgccccacccaggccattctgtttacttttacctgaaaatatttgaaaaatatgctactctcttcccaccaaaaaatcacatatctcaaatgattaactttcttttcaggatttaaggtaaaatgacaaaactggtctttgatgtcctgcagtatctgatacaccgttttccttcatgcttcattccaggccacttgctgtggtgttcctgcttttccttttcactttcttgataagcaattactcagtcttttccattttattaaactcttcttatatttctgtgtccagttaatttcaggatatttttaattaatcggttctacattacatactcgtataagctttccattgtctccaagttattagaggcccatttaaaaaagagaaaagagtttttagcttctaaacttctccactaaaatgtttaataaatgaaagttataccagcactttgggagaccgaggcaggtggatcacctgaggtcaggagtttgtgaccagcctggccaacatggtgaaaccccatctgtactaaaaatacaaaaaattagctgggcgtggtagcgggtgcttgtaatcccagctacttaggaggctgaggtaggagaatcgcttgaacctgggaggcggaggttgcagtcagccgagatggcgccactgcactccagcctgggtgacaagaatgaaactcagtctcaaaaaaaaaattataaaatcattttcaaaacatttagtctacacctgccattctcaccccatgacaatcctacgaaggcagaggatctgtttccagatcacactctctgtcatgtgactgctcacagtggcgcttcaacatcggcacagggagagtaaataactgcacagtgtagaaacaatcaagacagcccacataaattagagctatgcgactagcttaggagattgtccagtccttccacatcaggcagagctgagcccgaatgccctggtcatggcccatgaggacaaaggggctgactgtggggaaacaggcagtggtcagtgcagacgtgttcaccagccaccagctggggttagggtacttagccaaaaatggtgtgaagacagaggagagggtatagaatgatgcaaaggtgctcactagaacaaggatgctttgggtcactctgaactcaggggaggacctggtggggaggttagtcctgtgaaggtgttggacccactccctgtgcctgtgccgaataaagaccatggacctgctggcccaggtcatgaggcccaaacacaaaacatcgtaggatcatgacaacgttgtatgtagtaatcctgtaattctgttattacttactgcacaacaatatcccaaatctcttttccgtgtgttatgtttgttactccacttgtcagtcatactcctaagaaaaatggtatttaccagcatgttcagcacctagcacaggagggtgaaggccccaacgtatctgggagcttatagtttcagctctgcccacgtggaatttgtggggccgatcgtgatggcctggaagatactcagaaatcaggtggtgcccatgcacacacccctgcccactctgtggaaacagaaaacaaatttgcacccaatgtcactgaggaaatggccattgtttgtgggactcctttagagagaatgaccaaggagttggctatagtcaggtgctggagaatcagatctgtggactttaatgtgcatctggtgaaataaaggaaactataatgataaagaagaaagcaattgcccaggaatcctactgtggcctgagataagaagatcattcctattgtcacatccctggaggccatttgccatttttcaatgactgatcatcctattcagagtgagaagatcctgcatgaaaacaggaggcctgtggtaccatgacaactgaaatccactcttgtggaccatagttttcaaaccattaatttcctattaaatttcattttcctttttctgagagttttgctataaaaatatatatgtgtatatagatacatattcctagcataagagtgttataacagtgttttatgtataactgttacaacaattctctgaagggctttattgttcccatttgacaggtgaggcaatcttgggcacaggaaagctgaatgacactcccaaagtcacttccttgtaagaggcagtgtcagaagctgctagtgtacttgaccactatgctgtcttagcagcagatatatttatttatttatttattttgagatggagtggagtgcagtggcaccatcgcggctcactgcaacctctgcctcccacgttcaagtcattctcccacctcagcctcccgagtagctgggattacaggtgcgtgccaccacacctggctaatttttgtatgtttagtagagacagggtttcaccatgttggccaggctggtcacaaactcctgacctcaggtgatctgccctccacggcctcccaaagtgctgggattacaggcatgagccactgtgcccggcccagatatatttattttttaaaacaatccacatacttaaaaaaatattttgtatctcttgagtttttaaaagaatggttgtgagtcttgtttttcttttcaattgtgattgaaaacaacattgcttgttttctaggcaaacattatagtgattagagatccaagtaaaatatagatgggctgattttagtataaccttaaaagaataattatataaaccaaatggaatttattgaatgcacaaatggaattaaaagaggaggttcttttccatcttaaccaggaaggagcatacaatagaatgggcatgcgctaagcaagggagcaggaaaatgagtaggagggaaaacattgcaggagaaactaaattaccatgagtgtagaaagaaaatgagtatttgtgaatgcaaaaatatcaaatatagtatttcaatgtcagactggttcactatattaaaacacgagtccaccatgcaaaagaaaaactagaggtaaagattgtacattgactcaaaatagtactaagatgagcactgagactgcgaatggcatgaaaacatttttacaccagaggaaagatcacaaaataatgcaattctgaaaactgctgaagagtgtaacttttttcctgaatacaaaaacctaaggtcagttacctttctttgctgatttcatgaaggaaaacagcctcaccataataaagagacaacagattttttttctgtcacggcacagttacggtctccatttggtatattctatgcacagagttggtgaaaacactatatttactatttctgaacagaataagataattcaatcagctacatcttatacatgatcacaggcatggaggtgtcatggaaacaagtctacaaatcttagaaatgttcatgtagataagagagagcagctggcaaattaatttccaaattatattagagaacttaaaaataggccgggtatgatggctcatgcctataaccccaaaacttttggaggttgaggcaagaggattgcttgaggccaggagaccagcctgagcaacatagggagagcctgtctctacaaaaaattttttaaaatttgctgaatgttgtggcacatgcctgtggtcccagctactcggaaggctgaggtgggaggatcatttgagtcaaggctgcagtgggccacaattgtactctggcctgagcaacagaaagagaccctgcctcaaacaaacaaaaaaagatttaatgactttattgaaaccaacaatgatgaacagcgaggattacattaaatgagaagcagttaggggctggtttatggtcttgacctccattccttctccatgagtccagcccatgacccagtgattatttccctttccctgcattgtgttggcactgacttagtttctagcccagaagattcccatttcccagacaaaagcctttgctccatctcccagtacacttccttctggtgcaggctatgccttctagactgaaatagaaaatactcacctgatttttcccttgctgctgggacaatgcaggtttatgctcaggacagccagcagatgagtgtgcggagggaggcagccagctctcagatatgggtttttgtcctgtgacctcaccatttctcagcacttcaatgagcatttcacctgtggcaacaatgacagtgcacacttggggagctaaagatagtttaaagaaactttgtcacagttaccaatgaccaaaaacaagtataattttctagtgagcatctccagagagatgagagtgtttggcagaggttcttgctttccacgatcccttggaggcaacaggaagaggctcccaaggagggagcaggaagggctgagtccagactgaggggttggcagcagagcacacgcgtcttgccggagtctgtgctttcctgagatggtctcctatggaaaatccaattttctgctaatcctcagattcctgagccaaactatcatttgattatgaatagagaaatgggatcatgccaagaacttgagaaggatgtgtcagcaggttacagtgcaaacagcaacttgaagtccaatactgataggaaaaataaatggaaacaaatttgggcaatccaatgtaacttaacctgcaaatgtagatgttatatattctataaatatatattttatcaacatttacccccagagagatagaagttctaaattgtacaatatatataaaagaaacagacgtttatcagagtccctcacatacacaaaagcaccaagttcatatgatccagaaaggaattctactaatgaactgattgataaactgatgctacctaaactatttgaatcttaaagtagtctatcttcccaatagtttttaggaaaggtgcataaaggtgatatgagaacttaccatggtttgagccacatattacaaaaatataggacatatgaatataactataaaaaatttaaatattagaagcaattggctaggtgctgtggctcacgcctgtaatcccaatggtttgggaggccaaggcaggtgaatcacctgaggtcagaagtttgagacaaacctggccaacatggcgaaaccccgtctctactaaaaatacaagaattagctgggcgtggtggtgcacacctgtaatcccagctacttgggaggctgaggcaggagaatctcttgaacccaggaggcagaggttgtagtgagccgagatcgcgccattgcactccagcctgggcgacagagcaagactctgtctaaaataaaataaaataaaataaaataaaataaaataaaattaaaataaaataaaaagccattagggcagtcaccaatgttctatgagggatgtgtcttggaagaaaaagtctcttctgtaaggattactcaactggtacatgggcaggcaaggtgatccctagtggcctgccagtcttaagaaaaattttatgcatctagggaaaaattggtcacaaccaggcaattagatcgcagcctccccaccaagtaaaacaaaattctgtgttaagcacatgtaaaacaaaacaccagtacaaacccaaaatattttctcataggcattgtagagttttttgtttgttctgttttttgctctcgagagattaataagcagaatgggaccctcaaatttcaaagcatgcaataatggtccccccactcctgggacccctgccaggtatatgtttaaaaactaattcacaactgattttggctgggcgcggtggctcacacctgtaatcccagcactttgagggccaaggtgggcagatcgcctgaggtcagaagttcgagaccagcctggccaatatggtgaaaccccatctctactaaaaatacaaaaattagctgggcatggtggtacacgcctgtaagcccagttactcgagaggctgaggcaggagacttgcttgaacctgggaggcagaggttgcagtgagccaagattttgccattgtaatccagcctgggcaaaaagagtgaagtgaagctccatctcaaaaaaaaaaaaaaaaaaaaaaaaaaaggaaaaaagaaaaattaaggtcctctgtcttgcatgttttaatttttatttgtataaatttaagcggtacaagtgtagttttgttacatggatacactgggtggtgatgaagtttggtttatcacctgaatagtgcacattgtatccaccaagtaatttctcatcccttacaccctcccactcacccacccttctgagtctccaatgactatatatatatatttttttgagatggagtttccctctgtcgcctaggctggaatgcaatggcgggatcccggctcactgcaacctcccgcctcctagattcaagcaattctactgcctcagcctctgggtggctcggactataggtgcacgctatcacacccggctaatttttgtatttatagtagagacggggtttcaccatgttggccaggctggtctcgaactcctgacctcaggtgatctgcccactttagcctcccatagtgctgggattacaggcttgagccagcgtgcctgacctccaatgactattattccactttctatatccatgagtacatgttatttagctcccatttataagtgagaacatggaatatttgactttgtttcttttattttacttaagataataacctccatttccatccacattgctgcaaaagacatgatttcaaggctgggcatggtggctcacacctgtaatcccagcactttgggaggctgaggcgggtggatcacttgaggtcaggagttcgagaccagtctggccaacatggtgaaaccctgtctctgctaaaaatacaaaattagccaggtgtggttagtgcatgcctgtattcccagctacttgggaggctgaggcaggagaatcacttgaacctaggaggtggaggttgcagtgatcctagatcttgccatcgcactccagcctgggcaacaagaatgaaactctgtctcaaaaaaaggacatgattttatttattttttaattttgtagtttatcttagatataggaatacatgtacagatttgttagatgggactattgtggattttattctttttatggctgaagagtaatccattatatacataccacattttctttattcagtcatccattgatggacaatagcaaagatatggaatcaatctaagtgctgctctgagcatacaagtgcaggtatctttttgatataatatttttcctttgtgtacatatccagcagtagaattgctggatcgaagggtagttctatttttagttctttgaaacacttacatactcttttccatagaggttgtactaatttagttcccactaacagtgtataagtgtttccttttctccacctcctcaccagaatctgttattttttgactttttaataattgccattctgactggtgtgagatagtgtctcattgtggttttaatttgcatttctctcatgattaataatgttgcacattttttcatatgcttcatggccatttgtatggcttcttttgaaaaatatctgttcatgttctttgcccactttttattttatttatttatttttagtataatctgtacaacaatctttgcccgctttttggtggggttattttttttttggtgtgtgtatggagttgctttagttccttggaaattctaggtatcagtcctctgtcagatgcatagtttgcaaatatttcctcctattctgcaggttgtctattcactctgtttattatttcttttgttctgtagaagttttttagtttaataagacccatttctatatttttatttttgttacttgtacttttgaggtcttactaataaattctttgtgtggacaaactgttcaaaagagttttgcccaggtttcttctgctatgtttatagttctacaacttatatttaagttttggtccatcttgggttgatttttgtatatggtgagagatatgtgctcagtttcattcttttggatataaatacctgattttcccagcctccctgagtgaaaatggtgtcctttttccagtgtatatttgtgttgattttgtcaaaatcagttggctgtagacatgtgactttatttttggcttctttcttttgttccattgatctatttttatacctgtaccatgctgtttggttgctatagctttgtagtataatttgaagccatgtaatatgatacctgcagctttgttctttttgcttaggattgctttacctcttcaggtttttttggttccacacgaattttaggatttttttttaattctgtgaaaaatgacattgatattttgatagggattacactgaatctgtacatagctttgggcagtatagtcattttaatattacttcttcagatccataataatgggatattttcccacttgtttgtgtcatctacaattacctcatctttgttttgtagttctccttgtggagatctttcacgtccttggttaaatgtattcctaggcagtgggagagaatgataattgtggggatggaatttaaacattatgtatttaagataaaaaatattgtctcaaacctgtaatcccagtactttgggaggccgaggtgggtggatcacgaggtcaggagatcgagaccttcctggctaacacagtgaaaccctgtctctactaaaaaaaaaaaatacaaaatacaaaaaattagccaggcatggtggcgagtgcctgtagtcccagctacttgggaggctgaggcaggagaatggcgtgaacccgggaggcggagcttgcagtgagctgagattgcgccactgcactccagtctgggcgacagagcgagactccgtctcaaaaaaaaaagaaaaatattgtactgagcttatgatttgggggaagtttccaagtcatttaatatagtaagaaccttttctgtcatctttgctaaggctgaattgcaatgttatcatctttagggccccaaaagtaattatgttcacagatttttaatgctttaatctcatgtgtttattagacagtgaatgtttacttaaaattaacccctgacattttccaaattgactcacaaattggataaaagttatatatgcttttatctttaagtctactttaaaagagagtcttaaatttagaaatgccagaatgtatttacatgtttgtaattcaaaatggagtttctgcaaacacttaatttccaaattatatcaatgacatttaaatagattataattgaaatttgatgctaggagtaataatcataatgcaaattagttagaaaagttatgactgctcaaatattactgtcttacaaattacttataattatcatgccgaagttttgacacccatttaaaattcagtttcttagagatttaagcattataaggaaataagaatactctcttcttgtatagatgttaaataaaatatcttgtttcctttaaagatccaagaaattaaaatagcattttataacatgacttatgatagtcaacaatcatgtctttttttaaagaaaattgtaaaaattatttgaatccatgaatattgtttgttctcatttctctgaagccatattaggctaattttgagtgtcaaagttactccatcatgtggttttgagtgttaaaagcaaaacaaatagaagtgaatattctggccaggcacagtggctcacgcctgtaatcctagcactttggaaggctgaggcgggcggattacttgaggtcgagagttcaaaacaagcctggtcaacatggtgaaaccccgtctccactaaaaatgcaaaaagtagccagacatggtagcaggtgcctgtagccccaccacttgggagactgaggcaggagaatcgcttgaacctgggaggcagaggttgcagtgagctgagatcatgtcactgcattccagcctgagtgacagagtgagactccttcacggaaaaaaaaaaaaaaaaaagaagtaaatattctgtggtaacataatagttttttaagcaggacacacattgaccaaatatcttaaattttctttctaagttgttatgaactcccccacatgaaatagtagtcagttatataataaaagttttactgttcttattgaagttggataattaacagcagagtaagctcaactaatttacatgggaaaagacaacaatagtataaataaatttccttcatttgacaccatcaaacaaagttgtttaaactttctcgttcgttttcacatcgttatctcttcaatttatccaaagcatttaaaatatgttcttgttattcttcataataggtaccctgtgagatactgatttttcttttttaattattaacaggcaagaaaacgagagctcaaacaggatgaatttcaagatggcaatggcagaactcaaaattgcatttgtcagtgtccaaaaccactgttcttccacaagtcttttttatatagaattctttttctgtaatctattttgtttatgatagctaaacattcagtttcatttatattatgtattttatcttattgtttttatagtattttctttctctccatacattctaatcagtttattcacatggtcaaacattaacagcagatatttatgacaatttctatttaaaaaccttaaacattgattacattttcaattattttctccatacaggcatacctcagaaatattgtgcgttcagttccaaaccacaacaataaagtgaatattgcaataaagtgagtaacacagactttttggtttctgacacatagaaaagctatgtttactctatagtgtagtacattaagtgtgcaatggcattatgtctaaacatcaatgtacataacttaattgaaaatactgtattgctaaaaaatgctaataatcatctggaccttcagcaagttataacctttttgttggtggaagctcttacctcaattttcatggctgctgaccaatcagggtggtggttgctaaaggttggggggctgtggtaatttcttaaaataagaaaacaatgaagtttgctacatttactgacatcttttaagggaagatttctctgtagcatgcaatgctgtttgatagcattttaccctacagtagcatttctttcaaaattggggttcaccttatataaccctgccattgcttcatcaactaaatttatttaatatttgaattcctttgcagttatctaaacactgttaatagcattttcttggctcatccatgtaaatcattctagaagatccattaaaattttatgatgagattgcagcaattcagtcacatcttcaagctccactgctgattctaggtctctttctatttccaccacagcagtgcttccttcttccactaaagtcttgaatccctcaaagtcatcaatgaaggttggaagcaacttcttctaaactcctattaatgttgatattttgacctcctcccatgaatcacaaatattctttttttttgtatacatagagatgggatcttactatgttgaccaggctggtgttgaactcccggcctcaagcaatcttcccatctcagcctcccaaagtgctgggattacaggcatgagccaccgtgcccagcctccatgaatcacgaatgttcttaatggcgtctagaacagtacattctttcttttttttttttttttacttatttatttatttatttattattattatactttaagttttagggtacatgtgcacaatgtacaggttagttacatatgtatacatgtgccgtgctggtgtgctgcacccactaaatgatagactggattaagaaaatgtggcacatatacaccatggaatactatgcagccataaaaaatgatgagttcatgtcctttgtagccacctggatgaaattggaaatcatcattctcagtaaactatcacaagaacagtacattctttctaaaaggttttaaatttgctttgcccaaatctctctgaggaatcactatctgcggcagctataatcttatgaaatttctttctttttttaattaaaaaaaatttaatgttggtgggtatatagtaggtgtatatatttatggggtacatgagatgttttgatacatgcatgcaacgagtaataatcacatcatggagaatggggtgtccatcccctcagcatttatgcattgttacaaataattcaattatactcttttagttattttaaattgtacaattaagttactgttgagtatagtcagcttgttgtactatcgaatagttgaaatttatttctcagataatatgacttggaagtcaaatttacttcttgctgatccatgggctgtagaatggatattctgtgagcagacctaaaacaatatgaatctccttgtgcatctctgtcatagctcttgggtaactaggtacattatcaatgtatggtaaagttttgaaaaaaatatctttttttctgagcagtaggtctcagcagttggcttaaaatattaagtaaaccacactgcaaacagatatgctgtcatcaggctttgttccatttccagagcaaaggcagagtaggtttagcatcattcctaaggtccctaggattttctgaatggtaaatgagtactggcttcaacctaaagtgtccagctgcattacccactaataagagagtcagtctgtcctttgaagctgtgaaaccaggcattgacttcacttcttagctatgaaagtcctaggagacatcttcttccaatgcaagactatttcagctgcactgacagtctgtcatttggtgtggtcactttcctcagtgaccttagctagatcaaggtaacttgctacagcttctctatcagctcttgctgccttgccttgcactttcatgttacggaggtgacttctttccttaaacctcatgaaccaacttctgctaacttcaaacttttcttctgcagcttcggtcacttcctcacctctctcagcttttacagaattgaagagagttagggagtttctctggattaggctttggcttaaggaagcgttatggctggtttgatcttctattcagaccactcaaaatttctccatatcagcaataagactgtttgctttcttatcattcatgtgtttactggaccagcacttttgatttttttcaggaacttttatttgcattcacaacttagctaactgtttggtgcaagaggcctagctttaaggctatctcagtttttgacatgtcttcctcactaagcttaataatttctagcttttgatttaaagtgagagaaatgcaactcttccttttatttgaatacttagagaccattttagagctattaattggcctaagattgttgtgtctcagggaatagagaggccaagggagagagatggcaaaaagagaagaatgggtggtcaatgtagcaggcagaacacatgcaacacatattgattaggtttgctgtcttctatgggcacagttcatggcaccccaaacgagtacagtattaacatcggaaatcacgaattacagatcaccataacagatataacagaaaggaaaaagtttgaaataatatgtgaattaccaaaatgtgacacacaggcatgaagtaagtacacgctgttggaaaaatgatgccaatagaagtgtttgatgcagcgttgccggaaaccttcaatttgtaaaacactcaatatctgcaaagcacaataaaatgagggatgactgtatactgttcaatatttttttacttattatgaacatggtgcttttttaaatgatttttttgagatgtatctaaatagctgcaaagacattcattgtatgaatgtacaataatttaatgtaacaactatttttaatttttctaaaatatatttaaaaatttttaaatcacccataatattattattgaaattcatgtaaagcagtaaaagcaattagctgggtgtggtggcatgtgcctatagtcccagctactcaggaggctgaggcaggagaattgcttgatcctgggaggcagaggttgcagcgagccgaaatcgcgccactgcactctagcctgggcgacagggcaaacaagactccatttcggaaaaaaaaaaaaaaaaaaaaaaaaaggcagtaaaagctccctcttctgttcatgctgtaattttcccaaaggttaactttcttgtgtggatctttcacaataattttctaagtttgtaattatacatcaataagtatgtatgtagatctgacacagatctcagtcaccggtttccttagcgcacctgtctcatgtatccttggccatctactctgccaccagccatgccctgtggtttcctgctcaggcccaagtagctttgctgcctggtgacaaccagtgtgctgtctgtcctaggagtatagcctctgatacacagccaggtccagcagtgattgcccagagattccagctttttcctctgtaggaactagcaacccataaaatagcttgggctttggcatttgaactcactattgaaagaatgatgcattctggaggtatgagggagttaatgtcctatggggaatactttgtcaatggaaaaagaaggtaggaggaagctgagaaattaagcttctcttcccataatctactctgaagtgggatacctatttttggctcatccagaaaagtgttctatctcaagcagataattgtttcccactaatttactatagttttgtggtttctcataaagtaataaccactgactcccatttctagccaaccttatttctctttctcttacctatgctgccctttttctcacctccaaaagaaaacatctaatacgtgtatcagaaaacacaatataaaataatagatatgtacacatgtgtattaaaaaattaaacagaacaaatattaaacaaaatagctctgaaccatccatcatttcaacaagaaatcacaagggaaattagaaaatatctggagtggattgaaaagaataacacaataaatcaaaatacatggaaagaagctaaagcaatgcttacagggaaacttatgaattcaaatgttttgctagaaaggaagagcgtctcaaatcaattacctaatcaacttaagaaacaaaaacaaaaacaaaaataaataaaataaaagaaataataataatcagaacaacaattagtgaaataggaaacacaaaaacaatagagaaaacaatgaaacctaaaattgtatctttgaaataacgcaactggtagagattttactggactcatcaagatgaaagagagaaggcacagattgtcaatatcaggaatgaaaggcagaaccttacaacagattcaacagaaatttaaaaagaatttaaggctgacatggtggctcacgcttgtaatcccagcactttgggaggttgaggtgggtggatcgtttgaggtcaggagttcaagaccagcctggccaacatggtgaaaccctgtcactactaaaaatacaaaaaaaaaaaaaaaaaaattagccggggtgtggtggcacaggcctgtagtcccagctactgggaagactgaggtaggagaatcgcttgaacctgggaggcagagtttgcagtgagccaagattgtgctactgcactccagcctgggtgacagagcaaggctccatctcaaaaaataaaataaaataaaataaaaaaagtaaggtaatgatgaacaactaatatcaacaagtttaacaacataaatgaaataataaaattcctagatagatattaagtagaaaaactgacttaaaaacaaaatagaaaatcttaatagatgtatataaagtaaaaaaaaattgaattagtaactaaatatattcccctgaagaagagtgtagtgccagatggcttaacctgtgaattccatctaatatttaaggaagaaagaataccagtcatacacaaacattttcagcaaatggagaaaagagcatatgcccaaacattttagaaagccagtattagcttgataccaaggcaggatggcgacatcagaggaaaagcaccaagcaatatctgtcataagtttacatgcaaacatatttaacaaaacggaagcaaattaaatccaacaacatgtaaaatggtgatacactgtaactctctggaattaatcctagtaatgcaaatttggtttactatctaaaacccaatgaacatagtacatcatataaataaaataaagtagtaaatcaatagaatcatctcaaaagacataaaagcattttgacaaaatccaatgctaatttctgataactcacaacaaacatacgtaaaaaagtgaaaaaaactagcataaaggacagaggagagtaattggaattataccattttaaggctcttgccttaaacaaaaatgttaaaatattaattcaagatagactatgataaagatacatattgcaatctttctttctttctttctttttttttttttttttgagacagagcctagctctgtcacccaggctggagtgcagtggcaagatctcagctcactgcaacctccacgtcccaggttcaagcaactctcctgcctcagcctcctgagtagctgggattacaggtgcctgccaccatgtccggctaatttttgaatttttagtagagacagggtttcaccatgttggctaggctggtctcgaactcctgacctcaaatgatctgcccgcctcggccttccaaagtgctggggttacagtcgcgagccactgtgcctggcctacatattgtaatctttcaattaacaaaaaaaatgaaaacaaacagatatagctaagaagacagcagaagtgataaaacagaagactaaaaaataggcacactaaagaaagaatagtttaaaaaaaagaagaaatagaaaacaaataacaacagggtacacttaaacctagtcattttcaacaattacattaaatataaaagggcccaggcttcatggctcatgcctgtaatcccagcactctggaagctgaggtgggaggatgacttgagaccaggagtttgagaccagccctggcagtgagatgctgtctctgtctctgcatgcactgtgttttttttgtttttttttgagggagtttcattctggttgcccaggctggagtgcaatggcacagtctcagctcactgcaacctccgcctccaaggttcaagcgattctcctgcctcagcctcccgagtagctgggattacaggcatgtgccaccacgcccagctaattttgtatttttagtagaaacggggtttctccatattggtcaggctggtctcgaactcctgacttcaggtgatccacccgcctcgtccttccaaagtgctgggattacaggcgtgagccaccgcgtgcccggtcaaaattttttttttctttgagacggagtctcactctgtcgcccaggctggactgcagtggcgcgatctctggctcactgcaagctccgcctcccgggttcatgccattctcctgcctcagcctcctgagtaactgggactacaggctcccgccaccatgcccggctaattttttgtatttttttttagtagaaacggggtttcactgtgttagccaggatggtctcgatcttccgaccttgtgatctgcccacctcggcctcccaaagaaaattttttttaaaaaataaaagattagctgggcatggtgccatgtccctgcagtcctagctactcagaaggctgaggcaagaggatcctttgagcccaggagtttgaggttacaacgagctatgatcatgctactgcagcccagcctgtgtgacagagccagaccctgtttctaatacataaataaatatagaagggctggatatctcaatttcaaagttcggattacttatgagattaaaaaaaataaataagacccaaccctatgctgttcacaagaagcatattttagatatagaaacaacacgtaggcaaaagtatgggtataaatgtgtcatacaaatgctcatcctaaaagaattggtgtgcccatattaatattagataaagtggtcttccaaacaggagtactgccaaagataaaggggtcaagtcacaatcaaaataggccagttcataagattaacaatcttaaatgggtgagcctaatgaaacttcaaaatgtgtgaaacagacatcaacagtaaaggtgacgataatcagatctacttttttaagtgtctgtggaacattaatcaagacagatcaaatactggaccataaaacaattctcaataaatataaaatgatttaaatcatagagggtttgtatactgagcaaaataggactaaattaaacatcaacaacaaaaatatactcagaaaaccttaatatttggcaattgagcaaagaacttctaaataacaatgaataattctcagatatatatgttaatttttttattgtgttaaaattttaacaattttaagtatataattcagtagcattaagtacattcacagtgttgtacaaccatcctattaatcacaagccaaaataaagtacccattaaacagtgactcaccattacttcctttggtattttaggtagagtatataatatatatttcgtgtactttgatattttatgtacagtatataatatgtaattggtgtaatttgatattttatgttcagtatataatatgtatttggtgtactttttgatattttatgtacagtatataatatgtattttgggtactttgatattttatgtacagtatataataagtatttggtgtactttgatattttatgtacagtatataacatgtatttggtgtactttgatattttatgtacagtatataatatgtatttggtgtactttaatattttacatacagtatataatatgtattttgtgtattttgatattttgtgtacagtatataatatatattttgtgtactttgatattttatgtacagtatattatatgtgttttctgtactttgatattttatgtacagtatataaaatgtatttggtgtactttgatattttatgcacagtatataatatgtatttggtgtactttgatattatatgtacagtatataatatatatttggtgtactttttgatattttatgtacagtatataataagtagttggtgtaatttttgataatttaagtacagtaaataataagtatttggtgtactttttgatattttatgtacagtatgtaatatgtatttggtgtactttttgatattttatgtacagtacataatatgtatttggtgtactttgatattttatgtacagtatatagtatatatttggtgtactttttgatattttatgtacagtatataatacgtatttagtgtactatttgatattatatgtacagtatataagatacatttggtgtactttttgatattttatttacagtatatgacatgcatgtggtgtactttttgatattttatgtacagtatataacatgtgtttgctgtactttgatattttatgtagagtatataatatgtatttggtgcactatgaaattttatgtacagtatataatatgaatttggcgtactttgatattttatggacagtatataataggtattttgtgtagtttgatattttatgtacagtataaaatatgtatttggtgtactttgatattttatgtacagtatataatatgcatttgatgtagtttgatattttatgtactctatataatatgtatttggtgtattttgatattttatgcacagtgtataatacaccaaatacaatttatatactgtacataaaatatcaaagtacaccaaatgcattttatatactgtatataaaacaccaacgtacaccaaatacatactatatactgtacatagtttgaaagtacaccaaatacatattatatactgtacataaaatgtcaaaaagtacaccaaatacatattatatactgtacctaaaatgtcaaaaagtacacgaaatacatattatattctgtacatatattatcaaaaagtacaccaaatacatattatatactgtagataaaatatacgaaagtacaccaaatacatattatatactgtacataaaatatcaaaaactacagcaaatacatattatatactgtaaataaaatatcaaaaattacaccaaatacatattatatgctgtacacaaaatatcaaagtacccaaaatacatatgatatactgtacataaaaaatcaaagtacaaaaaatacatatgatatacagtacataaaatatcaaagttcaccaaatacatattatataatgtacataaaacatcaaactacagcaaatacatattatatactgtacataaaatatcaaatagtacaccaaatacatactatatactgtacatcaattatcaaagtacaccaaatacgtattatatactgtacataagatatcaaagtacacttaatacatattatatactatacataatatatcaaagtacacaaaatatatattatatgctgtacatataatatcaaagtatacataatatatattatacactgtacttaaaataccaaagtacacaaaatatatattatatactgtacataaaatatcaaagtacaccaaatacatattatatactgtacataaaatatcaaagtacaccaaatacatattatatactgttcataaaatatcaaagtacacaaattacatgttatatactgtacataaaatatcaatgtgcaccaaatacatattatatactgtacataaaatatcaaagtacacaaaatacatattatacactgtacataaaatatcaaagtatgcaaaacatatatactgcacataaaatatcaacttacacgaagtatatattatatactgtacataaaatatcaaagtacaccgaatatatattatatactgaacataaaatatcaaatcacacatattatatattatatactgtacataaaatatcaaagtacaccaaatacatattatatactgtacatgaaatatcaaagtacaccaaatacatattatatactgtacataaaaagcaacgtacacaaaatatatattatatactgtacataaaatatcaaagtccaccaaatacatattttatactgtacataaaatgtaaaaaggtacaccaaatacatattttatactgtacataaaatatcaaaacgtaccccaaatacatattatatattgtacataaaatatcaaaaggtacaccaaagatatattatatattgtacataaaatatgaaaaagtacacctaatatatattatatcctgtacatcaagtatcaaaaagtacatcatatatattatatactgtacatcaaatatcaaaaagtacattatatattatatactgtacatcaaatatcaaaatgtacaacaaatatatattatataatgtacatcaaatattaaaaattaaccaaatacatattatatactgtatatcaaacatgaaatagtacaccaagtacttattatatactgtacatcaaatatcaaagtacacaaaatacttattatatactgtacacaaaatatgaaagtacaccagatacatattatatactgtatataaaatagaaaagtaccccaaatacatattatatactgtacacaaaatataaaattacagaaaatacatattatatactgtatataaaatatcaaagtacacaaaatatgtattgtatactgtacataaaatatcaaagtacaccaaatatatattatttactgtacataaaatatcaaacataccaaatacatactatatactataactaaaatatcaaagtacaccaaatacataatatatactgtacataaaatacctaagtacaccaaatacatattatatactctacataaaatatcaaagtacacaaaatacatattatatactgtacataaaatatcaaagtacaccaaattcatattacatactgtacataaaatttcaaagtacaccatatacatattatatgctgtgcataaaatatcaaagtacacaaagtacatattatataccatacataaaatatcaaagtacactaaatacatattatgtactgcaaataaaatatcaaaatacacaaaatacatattatatactgtacacaaaacatcaaagtacagaaaatacatattatatactgtatgtaaaatattaaagtacaccaaatacatattatatactgtacataaaatatcaaattacaccaaatacatataatatactatacataaaacatgaaagtacaccagatacatattacatactgtacattaatcatcaaagtacaccagatacatattatatactgtacataaaatatcaatgtacacaaaatacatattatatactgtacataaaatatcaaagtacaccaaatacatattatatactctatataaaatatcaaagtacaccaaatacatattatatactgtgcataaaatatcaaagtacacaaagtacatattatatagtgtacataaaatatcaaagtactctaaatacatattatatactgtattcaaaatatcaaagtacacaaaatacatattatatactgtatgctaaatattaaactacaccaaatacatattatatactgtacataaaatatcaaagtacaccaaatacacattatatactgtacataaaatatcaaactacaccaaatacatattatatactgtacataaaaaatcaaactacaccaaatacatattataaactgtacataaaatatcaaagtacacaaaatacatattatatactgtacataaaatatcaaagtacacgaaatatatattacatactgtacctaaaatatcaaagtacacgaaatacacattaaatactgtacctaaaatatcaaaatacacgaaatacatattatatactgtacctaaaatatcaaagtacacgaaatacatattacatactgtacccaaaatatcaaactagacgaaatacatattatatactgtacctaaaatatcaaagtacacataatacatattacatactgtacctaaaatatcaaagtacaccaaatacatattacatactgtacctaaaatatcaaagttcaccaaatacacattttatactgtacctaaaatatcaaagtacaacaaatacatattacatactgtacctaaaatatcaaatacaccaaatacatattacatactgtacctaaaatatcaaagtataccaaatacatattatatactgtacataaaatatcaaagtacacaaaataaacacttatctttgttctgtcttcacaaatttgcctattgtagatatttcatatcaatggaatcacacaacatttgtctttttatgtctggcttacctcacttagcatcacgtttccaagtttcacccatgttgcatgcatgagaacttcattccctttaatggatgaataatactctattatatatgtatcatattttgtttatccattcatttgttgatggacatgggctgtccctgccttttggctatggcaaataatgctacaataaactttggtgtaaaaatgtctgttccagatcctgctgtcaacttttttgtgtgtaatacctaggagtggcatttctgggtctatgtgtgattctgtgaggaaccaccgaactgctctccacagcaactgcatcattttctgtttttagcagccaattcatgagggcttcattttctccacatccttagcaacatttattttctgtttcattgttgttatgaaagccatatcggaggatggaaagtggtatttcattttggttttgatttgcactttattaatgaataatggtgtttagcattttttttgtccttattagacatttgtatattttctttggagaaatgtctattcaagtcctttgcctattttttaattggaatgttagaaattttgttgttaagttgtgcgatattaagcttttatcggatatatgttttgcttttatcagataaatattttctcacatactacgggtggtcttttcactcccttgatagtgtcctttgatgcataaaatttttcgattttgattaaatctaacgtgttttttcttttgttatctgtgcttttgtgtcatatttcaaaaagcatttaaaactcaaaggtcataaagatttacgtgtgtgttttcttctaagagttacatatttttagtccttacatttaagtcttttgttaatttagagttaatttttgtatatagtgcaaggtaggggtctaacttcactcctgtgcatggatatccagctgttgaagagagtgttctttcctccattgactggtcttggcctccttgctgaacagtcattgaccatatatatgaggactaatttctaggatctcaatcctattctgttattttaaatgtctattgattttatgccagtaccacaccctcttgattactgtagatttgtagtaggttgtgaaactggaaaatgtgagttttccaatgttctttttcaagattgttttgtctatgtcagattctttgaatttttgtatgaattttataatgggtttctctgtgtctgcaaaaaatgtctttgagattttgatggtatcgtattgaatctctagattactttagatggtatggtcatcaaatattgtcttacaacccatgaacacagaatgtctttccagttatttaaactcttcagtttctttcagcgaagttttgtgcataccaccatgtttagatttatgcctgaatatcttattctttgatgctattataaatggaattttaaaaatgtttccatagttcattacagctatatagaaatacaactaattagcatgtgtttgtcttgcttccttcctcttttattagttctgatgggttttgggtattctttagagctttatacacataagatcatgtgtagatataattttacttctatttttcatttctaatttagatgccttttatttctttgtcttgcctaattgctctggctagaatttccagtgctatgctgaacagaattggcaaatgcaccatccttgtcctgttctagatgttaggaaaacagctttcagtgtttcaccattgagcacgatattaactgtcagttttttatatcccattgtcatgttgcagaagttcccttctgtgcttagtttattgggtatttttatcataaaagagagttgtatatcatcaatgctttttctgcatcaattgaaataatcatgtgcttattcattttactgttatagtatattacactgatcggtttataatatgttgagccacacttgcatttttgggataaatctcacttggtgatagtttacaatcctttgattatacagtagtgctgctagtattttgttagtattgctagcattttgctgagatttttgcctatattttcataagggatatcgtgctttagttctctttttttgtgctttgtctggctttggtatcaggataatgctgttatcaaaaagtgagggttgggcgcggtggctcatgcctgtaatcccagcactttgggaggctgaggcagttggatcatgaggtcagtttgagaccagcctgaccaacatggtgaaacccccgtctctactaaaaatacgaaaattagctgggtgtagtggcagggacctgtaatcccagctactcgggaggctgagacatgagaatcgcttgaacccaggaggcagaggttgcagttagccaaggtcgtgccactgcactccagcctgggggataagactctgtctccaaacaaacaaacaaacaaacaactccccgcccccaccccacaaaacaactgaattggcaagtattctttcttcatacattttgttggaagagtttgagaagaaatggtattaatttttctttaaatgttagatagactcacatttaaatgttaggtagatttatgaccaaatatggctatttggtcataaatctttttttgttaaatggtttttgattactagtccaatcttcttgcttgttatctgaatgcaggtctattcagattttctctttcttcttgagctattttggtagtttgtgtctttccagcaattcgtccatttcatccagggcacctaatttgttaatatgcagctgttcacagtattctcctataatccttttttatttctgtaaagttggtagtaatggctctactttcatttatgattttagtgatgaaagtcttccatcttttgctcagtcaatacagtgaaaggtttgatcttttcaaagaatcaacttttagctgtgtttatttcttctactgcttttcaaccttctattttattgatttatactctaatctttattatttctttccttctgctagctttggatttagttttctctggtttttctactgcttttaggtacacagtgaggttactgatttgagattttttttttaatgtgattgtttatatccatacattttcctttgaactctactttcactgcattcaataagttttggtatgctttatttttattttaatttgtctcaaaatactttataatttcacttgtgatttatcctttcactcactggtagtttaagagtacattgtttaatttccacatatttgtgaattttcccattttcattttttatttatctgttgtttcttccattgtggttgtaaattatattttgtatgatttcaaacttttaaaaatgattaggacatatttttgcagaggaagatatggcctatcctagagaaagttccatatccacttgaaaataatgtgtattctgctgttgttgggtggactgttctgtatctgtatattagatctaagcggcttatactattgttcaagtcttctgtttctcatgaagcttctgtctggtttttctacccattaattaaaatgaggtattgaagtgtccaactgttattatagaactgtgtgggtttaaccttttaatcctgttaaattttttcagctttactgaggtataattgagaaataaatgtgaacatattcaaggtttgcaatgtgatgtgtttctatctatatgcacattctgaaatgattaccaaaacgaagtcaattaacatattaattacctcacataatagctttttgtgcgcatgcgtgggataagaatacttaaccccatccccagtgactgcagagtggcccttccagctgttccaggctctggcagaggaggagcagagcgggtggcaccgccaggggagccctcaggcctggcgcgcacgcattccggaggtcgccaggccatgctccgtcgcctgggcgcccaagctgcagccccaaatttttgggtggattgtggttttggggtggatcgcggatttggggctgcacttgggcgctgcccggcaactccccagcccgctcacactgccagcatcgcagagccggggccagaagtcccggtgctgcggccaagccaggcgttctgcccggcggcggctgcacaggggcgagaactgagaacctgccgctcaaccccatcctgggtgactgcggagtgcccatgccagcggcttctgtctccctgcggcggaggagcggggcgggaggcacggcctaggggccctcaggctggtcgcgctggcgatcccgaggccgcccaggccatgcccctccagcccgcctgggcacccaagctgcagtcgccctctgtgtgcaggcagcagcctccgggaaacctctaagcccgcctgctctccgaacatctaagaaccaggaccagatgtccctgtggctgctgccgagccaggcggtccgcccgacggcggctgcacaggggcgagaacctgccgctcaatcccatccccggtggctgcggactgcttctggccagcggtcccgagctccgtcagaggaggacggcgggtggcacgaccagggatttgagggtagattgcggtttttgggtggatcgcggatttgggggtggatcgcagatttagggctgggaggcggggtggaaaggctacctggagccgcggcggctcaggagcgggttgttgagcgtctgagaagtcgccaccacgaggaagcgcttcagcttctggagacgcctgggccaggcggtcctgctccatcgaccacgagtacccggatcccgggtaccacacctgggacgcggaactgcggaagatccacagggcggcagtgaggggcgacgccgcagaggtggagcgccgccgcagaggtcgagcgccgccagatgcgcagaagccgggacttgtacgcccgcgacaggaaagacaggcagcggggcctcagctccaggtgggagggggccctaggcccggcttcccgcagccccgcagccccgcagccccgcagccccgtagccccgaagccccgcagcacctggggcggggatcttggagggcgccgggcaccctcggaacagcgaagccaaacggagcctcagctgctttctatcgctggcaattccccgtctggagcacttggtggagaatttgatttatctcacaaagttaggcatatacacgtttaaaagataagtctcatatacatgatagggaggtgcctaatgagaactcattcccatatcaaaaatgccatgagtcattttcagtaggcgaaaagttctccgataaaaccctgcgtctgttttacatccgaatccacctatgtagataaattctttactggggctccttagagggaaacttggaagtgggaggtgggttccgtgttcttgaatgggaagactcagttttctcaaaatgtgagctctttctatatttatcagttttacgtaaaccaagtgaaaatatcaacgttttaacatttttgcatgacacttgctgtctgtctttttctcttgcgatgacatttaaacatttttataatggagtgaaaaaagtcttgctcctctagatatcaaaatgtgctattaattcccacaattaactgttgactaacagctgaaaagacgtaaatacatggaacaggataggaaatcccaaaacactgagataaatgtaagatatatacgtagggattgtggtaacatttcagatgagtaggaaggtatgagttattaataacgtgtcctatttgaagaaaactaataaaattttgtgcgacaaaaatgagttcctgaaagaatacagattgaaattattacatatgcaaaacgaagaaagtaccagaagaaaacagaaatgcttatttatacaggtacattttatattgacaaaggccttcctaagaatgacctcacaagtaggcattctgaaggttgatttagcaactaaaaattaaaaccccttgtgtatcagaaaaaattaacaaaagatgacatacttgaaaaatgctataattttttactatatataaatatatattaatacatattcagatgaaaagtgtgtctttattctacagggaacttattacattttttattatatataatatatattactgattataacaaattgtatatattactgatataatatgttatatatatcagttttatacacacacacacacacacacacacacacacacacacacagataaaaagcacatctttattttacagggaattctttcaaataaaatccagaagaaaagaactctaaaagtgagcaaagtacttttttgcagatccacaacttaacttacgtacataggaaaaaatccttagtgtttctcataagagaatttaagttaaaagagaaatgagactgttttctatccacaatgtttgtgagaataaagagcagtggtagttatactgctgcttaaagtttaagttgctgatgacttttcaagtagataatttggtggtaattaccacatttaaaaaatctatatgccctttacctatcaattccattatattaaaatacctttagaaaatagagatacatgcactttgttttttctcagcacttattttaacaagaaatgataggatagatcctataaataaatttcagttgcatccataggatggaataatatgtgaccattttgttatagccagtgagaaaaaaaagtcagtttgcttgcatatacacacaaacatactatggtcttgtgttagccaaaactatgtacaaaatatgataaaaattgtaacttctgagcattggtattttaagtaaagtttcttgctcctttttcttatctgtgatttccgcaatgatcatgtataaaacttctagtaaaagtttattattaatggaataatccttgggaagagagaatatgaatcttgcacaggtaaaaataatttctcgctgtctattttatcattattattgcgtgggttgttatcttctttgaacttttagcctcttcagaagtaaaaagggaatctttttatgtatgcttgcagattttattatgtatatattttattaggtacatatgcttttcttatgtatagattcattgaatatatgcaaacaatgacagattaaacatttcattttgtattcttacaaaaataataaatagcaaatataattactatcacaaaaatattgttttataaaagttttatttaaaaatattgaactccacaactgtatttatccattctttcaatccatttattcatcaaacataacatgaatgcttgttatgtaacagacatattctactatctctcaggatccttccatccttaaaaagttcatgtttacctgccctgactgagcagtttaaagaatgtatatataaattacatgtatatatatataaattaattcttttaatttaattagtttagcttagaattcagagttatttcagaagttagttgtagctaattcataatctcaaacagtattgtctggaatcttctgatccatagtcagacacgttatccatcgcaccactggcccgcggtttctcaaacagtactgtctgaaacaaattcatttacctaattatgatccctgaaattctatatatttttgtattaatataaacaagaaattagacttttaagatttttaagttagtgtgttgtatttttctctatagtcatattataacaaattggacttatgcaaatggttcttctatttaatttttataataaatggtttgtatttagtagataaatattaattacacttgattcttgaataatgtgggggttagggactcttatttctgtggaattgaaaatccgagtataacttttgacctcttccaaactagcctaccattgactggaagctttactgataacataaacagtcgaggtacatatatttggtatgtgctgctgcattatttactatgttcttaaaataaagtaagctagataaatgaagctgatataaagaaaatcatagaaaagaaaaaatatacttactattcataaagcataaatgaatcctcccaaaggtcttcatcttcatcatcttcaggtttcctgccctctgcctcttttaatctggtggacctcattctttaagtctcagctcaggcatgatctctagaaaagccatccccgaaggttttattcctattctttacaccccggtgcctaccacttagtaggaactcaataataaatatttggtaaaataaagactgtttatacaaagatgattgctacagtctagctgcaaaggggatagacatgcaaagacatgatgtacagttcaggtggtgaagtgacactagaaaaattgacaaagtactaagggagccccaaggaaggagatgcctgtgtatgtggagaaagatagtcagattcaaggaggatttcacatagcattctgagcctttttttttttctttttctgtttttggagacacattcttactctgtcacccagggtggagtgcaatggcatgattaagactcatagcaaactcaaactcctgggcttaagggagcctctcgtctcaacctcttgagtagctgggactacaggtgctcaccaccatgcctggcaaattttctgtagagtcagggtttctctgtggtctccaggctggtcttaaactcttggcctcaagcaattctccttcctgggccttccaaagtactgggattacaggtgtgagctactgtgcccagcctacattcagagtcttaaaaaatgaaaataaatttgtcagaatagtagaggaaaacatttctgatgtaaaaaatagggtgtacactaataaaggtacaaatggtaacaataattttgcaaattattagtaaataccaacttgcatagcatgttgttaaaaagatactattatgaagtagagaatagtaaagtgttactttatatgtttttactgtatttttaaattttgttttgtttccagaagttttgtttatttatgttgggtggaacaatttgtgagcaaaccttagatttttgcatggcttgaacctactgatacctagtgtctccccaagtggtgcgttgaagtttcagataactagaagtatttcttaaagatgtaaatattccagtaaacattaagctttatttaaactctcaatttataaaataagagtatatattattttgtatcaatttttataaagattatagtcgttatctaaccgttctaagtcactcattttaattaaacatgtggatttgtcagcagaacacgacttaaaagtggcttcagaggaaaagcaagaaaggcttgaaagatgtgaaaataaacagccacaggtatataaaaatttaaattttaatttctggcttactattggtttgtttgtttctttttctttaataacatggtatagtccaaatgaagtgaccttctggactatcccttttagaatccaacagataatcatttcatatttaattttaaaacattttaaccagttataaaatttaaaaaattcttacagtctgtagtaactcatagctatctttacccttggaattgaggccagaaatttccagaagtctctttgctcttttatttttataaccttcttcatgataaagaaggtaacatcaaaaattgagttgtgctactaagcaagagaaattacgaacaatttaacagtgatggccactgaattcaactcatgttaaaggactcatcattgccagtggcccaaactttgcagttttatgttgccagtcactagtggctgaggttaaagacttctgttttttggtctctggttgcctccagtgtctatgttcagggagagaattgggtcataaaatcaacccaactgcctattaagagaatcatgccttccagaatgggacctttggtattaggatacaaacaaaaactttcttattttaacataaatagtaaatgttattaaaaattttaagtccactgtcactagtggaacttagaatatattagaactggatataagcagataatctatctagatacataacactatcatattacagtatagcatttgaagtagaatctaaaaattttcttctctttctaattggtgttcattttggcttctaataatttggcatttgcctaccctacagttaatctttagaagtataaattcactgtaggggttcactatttatggtatgctgaggtaaaagtcttttaaagagagaaagcttttataatactacatatcttctgtgaacctatttctggtagatttaactcataatgaattaaatttagtcccaagaaacaacgagagttaagcttgatggttcatgtttttctcctgtgttagaccaaggcaaattagtttttacttcttagttataatccagtagcttaggggtagcaaaacatagaataagcttcacagttaaattttaattatgttataatttttctttgctcatacttgattacttcagaataaagttaattttaaaacatgcactctgacagagaaggcatctgagaaacaaaacaagcaaatgaattttccacctgcaaaaaaatgtctcgagaacaagaactgagtaagaattgtgataaagaggatatgtctattcagggcttcctttaaaattcattttaaaaacgttcaactgaagattggtgaaagttttgaaatattcaaaattactgtttgtcctgaggaagcgttcgtacatagtaactctaaagagggacaaacttaaagggagtgccctctaatctgatgaatcatatccctgatcatgaggaagcagatgcatctggagtgtctaactgtagtattccaggcattgcctgaacagaaggaatgtctgttcattcttcaaacatgtcttgtcattgcatttataccttgggttcctcaaacaaacttgccagtcatcttctaagctttattcaaatgaaaacaaatcagactataaaaattataacaaacagttataaacagaccatagcctgtttctaacagcgatgaagaaaatggttgaaatgatacagaaaatgaaaaattaaggagctcagtagttacggttgaaataaaagaaaacccagagtttgataatgcaagtgataaaaaatataaaccaaaataccactgattggaaattacacattagacattggcctcagtctagagatccaaaaagtctttttgatttgtggtttggccactccaaagaaatgtatcatgtgatacagatagaaagccacagtatttccgctgttgcagacacttataaaaatagaaaaccaatacagcacttgttccacaattcatgtggatcttagaggctcttctaaagcttaaagatgactggcaagtgtgtttcagggacctacatatgacagtcccactgttaataactataaaagcataaaacatgaattagaagttattctccaccctgtagtgacagaacatcaaaagcatatctagaagaagacttacagcaagatatccaaaggtttaagaatgaggtgggcatgttacaagtagagtccctggctttgaagaaagagaaagtttaactacaaaatgacagaggttcacttgctgttctctttttataagttatctgattcattctgattttctactcaagaaaatctcatgtgtatggttacactgtggttatctaaatgtgtaattatgtgtcaaagtaaattagtgctgctatctaaatgacacttctggaaatattcttgtaatctttgttgattactcaacccaagtctcactattagtctttcaagtggcttatgggctgggaaactaatttagccatataccatgtgatcttctgaaccagataagcataaagaaaattgctaaagaaataagctctagattcttttttctgtattcatttaaagacgaattacatttatttaaatgataaaatggtaatacagtgggagggaagcaatgactgagaagagacataaaaatatatcttgccttgagagttgcaacaaatattcccatccaaagaagtctgtttaatgtgctttcatgcatgcaagtttatctgtttgactcaaactgtttaaacttattattccatcatggtcattttaaatatttttggaaacaaatacatatactttcacatattaaaaaaaatcaccactctccaatgtttctgttgaatcagaatttacgttatgttgtttattaaaatatgttaagttttgacatgtatgattttgtcatataagtagcataacccctcagccaaaaatttagcatttgattctttagttgaaagctgagttctgtacattttgttctaaagatagacaaaaatctagagattttcttttttcaaagtaaaagcagatgaggcctcccactaccctcggaggcatgatctaggagacagcagaaagcagtttcaattctagtcatatttctagctctagctctacatgcaagtacctctgagaagtattttcattggcctatacacaatgaggatactgatacatgtatattataaaataaaaatgtgaaatacagatgtagctaacattttacaactgaagcattcttctagtcactggtaaatgaaaacaccttaactaaatcatatggcaactacatgtgtgaagcttactaaataaattgtttcataaggcattttttatagagaagtatttattctccccagtcattccctgcttactccactttctattgggctttttgcatgtcaaatttgaaaacatgaacaaacaaaataaagtgaacatggtagtttattattatgaaagtaattgtaatgtataagttagatgtccctgtgctattgacaaaattctctaaaaaccttttgaataaatgtgacaaagactacctaagttgatgtccacaatttgagagaaaagaaagacaaaaacagtccttgaggactcagatgcctcaggaagatttaagaagtttttatactttgatggagcttttaagaaaaattcatctatttttttccttgctctggtcacatactgagaggacttacagactgcttacttaatagtatggatttgtatttttcttagagtaaagtagcatcctgattttgaaatagttcctgtagtttgtttaaagaaagcaggaaagaaacaaaacaagaaaaaaaggaaagaaggaagaaaaaaagaaagtgaggaaggaagaagggaaggaagaaaaaatatggaagaaaggaagaatttcttttagagtagtggaaagctgtcaaaatctgcttaagaaaaccgtttgtataaaatgttttgtcttgccctccaaagctcaaagtctctggtcctgctgatggctttcctatctagaatatacagatcttccacaaattgaaaaactaaaatatagaaatatattttgtacaggtggcggatttgaaatgttttatcaaggctaaaacaggatgtatatcattataatacttttccttcacattctgctctgaatttgctcagtcagcaccattccacttaataaggcttagatcaaatcaaatcaaactttgatttgaatattacagaagagaacacatggtaggagcttgtatattctctgtctctcttactctctctcatgtctgagagagaataccttggggttgaccagctagacagtttatgagaaggtagtatctccctgttttcattctccaggaatactgaacagtgtattattgaattatatttgattaaaatatactgatggaaaagagcacttcagagtgtccaaaatggaagtaaatgtaaatctttttataatttataaataccaagtttataaaacgaatcttctcttgtagatttgtagattgtagatttctgctcatagcagaaagcagaggccaagataattttaaattatcttacttttaaaaatataattattttctaaagtgaacttaaagcaaaatctaaatacagaaaaatgcctgattacaagggtgcagctcaaagagcttttacagagttaggcacctgtgaaagcagcacagattaagaaacagcactgagcctccccacccaactcatcgccgtgtctctccatagctacatcctaacttctaattagatttctagattggatttctcaggctttgagtttctcacaagtggggtgatacagtaagttttcttttgtgccttctttttacaaatgattttttgtgaaattcattcatgttgttatgaatagttacaggtcattcattttcatagctttattgcagtccatgtgaatatagatactttgtttatccattttcctatttacagacctttgaggagtttctggagtagggttgatgctaattgtgctgcaataataatatttaacattttttggaaacatgtacacatttttagggcatatttctcagaatggaattgctgggtcatagaacatgtaaagtagatattgccagcagtttttcaaatttatatttttcaaatttatacaagtacttctagtatatgtgaattcaagtcactccacttccaaaccaacacattgtatgtttttaaaaaatatttacatttggatgagtttgtagaaatattatatttaattttgcattttttgtgtgtaatgaagttgagcatctgtttgtgtttatgctggctgtttgaatatcccatcttataaagtgccttttaaaatattttttctatatttctacttgattgcctatcatttattgaatactatagatatgtagaatatacacataaaatatctccttatatctttggccttcatttttattatgctaatagtgcctgtggattcacagaatttctccctttatttgtttgcttttgagacagggtctcactttgttactgaggctggagtacagtggcacgatctaggcttactgcaacctctgcctcccaggttcaagcagttcttgtgcctcagcctccctagtagttgggattacaggcatgtgccactaagctcagctgatttttttgtatttttagtggggacgagtttttgctatattagcaaggctggtctcgaactccttgcctcaagcaatccacctgtctcagcctcccaaagtgctgctgcgatttcagatgtgagccaccatgcaaggccagaatttcttaatttgacataacaattttgttctgttactgttaggtttgttttctaacaccctgtttaagaactatttatcccagggggaataaagttacttatcaaatttgttctgttacttatcaaatttgttctgttactgttaggtttgttttctaacatcctgtttaagaactgtttctcccagggggaataaaattatatttacttatgtaagtgttaactacatgtctcaactgtggggaaaatggattcctagataactctttgtagtactacatccattgtttgaagtgtagtgtgcataaaatttaatgaagacaatttgcattgaaaaagtcacatttctataaagccataaattaattagttctaagacttagcctacttggatgttagtaagttcagtctcagttgcttacattgtgttctcataccctgcatagaaatgatccaaatatgaataggaatttgaggtataagtgttagcagaaaaagaaaatcaggggtgctccatggcttctgtccacagtgggcactgggttggcctttgccttacctaggagatggggtggtggagtgctcaggccagttgtctgcccttgggtgctgctgtcaggaatgagactctcatctcctttcttgaagacatcagtctctgctaccttgctcctagtctcctcctcaagctcaggaaagactaaaaatccctcagatctagttggtttccacctgtaccagtctttcacatctctgtgctttgagataaagcagtaccagctctttcagtgagagttaagacactggttaaatagagtttgatcttcctgcacagtgatagcaggcattaaagatggtaacacaagttaacctttttctaaataatatcaacaactataaaagaaaattcaaaatatgaaaatattctaaaattgtatttaggataaaagtaactatggtacttggatattcactaataaatattcaggatctaaagtttattaatgctttcaaaaaaatagtacctatttttaatttttactttttttgtttttagagattgtggtctcactctgtcaaccaggtgttggagtgcagtgggacaatcatgggttactgtaccctggaactatggagctcaagtgatcctcttgcctcagcctcttgagtagctgggactacaggtgcatgctaccccaactggctcatttaaattttttttttttgtaaatattggatctggctgtgtcatctaggttggtcataaactcctagcctcaagcaattctcgtaccttggcttcccaaagcactggtattacagatgtgaacaccatgcatggccaagaaacagaatgtaatattataaagctatcaactgaagaaaatatatttgatacatatgtaaaatgtaaaacctaaaatctgattttttctcctcttcctcaccacgtgtattattccattctcacattatgataaaggactaactgatactgggtaatttgttaaaaaaagtgggggttagttgactgacagttctcagactatgcaggaagcatggctagagaggcctcaggaaacttataatcatggcagaaagtgaaggggaagcaaacacatctttcgttgtgagagcaagaggaagagagagaagggggagatgatatacacattttaaaagccagatctcatgagaattcactatcaggagaatagcaagggagaaatctgcccccatgatccaatctcctttcatcagcccctcctccaacactggggattacaatttgacatgagacttgggtagggacacagactcaaaccatatcattctgtcctggcccctcccaaatctcatgtccttctcacatttcaaaatacaatcatgtcttcccaacagtcctccaaaatcttaactcatttcagccttaatgcaaaagtccaaagttcaaagtcttatctgagataaggctagtcctttttgcctgagcctgtaaaatcaaatcgatattacttattacttacttccagcatacaatgggggtacagtcattgggtaaatgctcccatttcagaaaagagaaattggccaaaacaaagaagctacaggctccatgcaagtctaaaacccagcaggacagtcattaaatcttaaagctccaaagtaatctcttttgattccatgtttcacatccagggcatgctgatgcaaggagtggtttcccaagtccttgggcagctctgcctctgtggatctgcaggatacatggctgcttttacaggctgatattgagtacctgtggcttttccaggcacacaatacaagctgatggtgaatctactattctggggactggaggactgtggcctttttctcacagctccactaggcagttcccctgtgggaactctgtggggggcaccaacccacgttttccctctacactgccatagcaaacattctccataagggctctgcccctgcagcagacttctgcctggacatccaggcatttccatacatcctctggaatctaggctgatattcctagatgctcagcctccgagcatctgcaggcttaacaccacatagaagccctagtggcttccagcttacaccctctggcacagcagcctgaaacatatctgggacctttttagccttagctgaagctggatgcagggagcagtgtcctgagattgcacagggcagcacagccctgggcttagcccatgaaaccattcttttcttctcagtctccaggcctgtaatgggagggatggcaacaaagttctctgaaattccttcaaggcaattttcctattgtcttggctattaacatttggttcctctttatttatgcaaatttctgtagctggcttgaattcttcatcagaagatatgtttttcttttttaaaaaatttattattattatactttaagttttagggtacatgtgcacattgtgcaggttagttacatatgcatacatgtgccatgctgctgcgctgcacccactaactcgtcatctagtattaggtatatctcccaatgctatccctcccccctccccccaccccacaacagtccctggagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttaaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccagtttttcatggggttttttttctcttgtaaatttgttggagttcattgtagattctggatattagccctttgtcagaggagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtgcttgcccatgcctatgtcctgaatggtagtgcctaggttttcttctagggtttttatggttttaggtctaacgtttaagtctttaatccatcttgaattgatttttgtataatgtgtaaggaagggatccagtttcagctttctacatatggctagccagttttcccagcaccatttattaaatagggaatcctttcccctttgcttgtttttctcaggtttgtcaaagatcagatagttgtagatatgtggcattatttctgagggctctgttctgttccattgttctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctgtaaattcatgatattgattcttcctacccatgagcatggaatgttcttccatttgtttgtatcctcttttatttccttgagcagtggtttgtagttctccctgaagaggtccttcacatcccttgtaaattggattcctaggtattttattctctttgaagcaattgtgaatgggacttcactcatgatttggctctctgtctgtctgttgttggtgtataagaatgcttgtgatttttgtacattgattttgtatcctgagactttgctgaagttgcttatcagcttaaggagattttgggctgagacagtggggttttctagatatacaatcatgtcgtctgcaaacagggacaatttgatttcctcttttcctaattgaataccctttatttctttttcctgcctaattgccctggccagaacttccaacactatgttgaataggagtgatgagagagggcatccctgtcttgtgccagttttcaaagggaatgcttaaagcttttgcccattcagtatgatattggctgtgggtttgtcatagatagctcttattattttgagatacgtcccatcaatacctaatttattgagagtttttagcatgaaggattgttgaattttgtcaaaggccttttctgcatctattgagataatcatgtggtttttgtctttggttctctttatatggtggattacatttattcatttgcgtatattgaaccagccttgcatcccagggatgaagcctacttgatcatggtggataagctttttgatgtgctgctggattcggtttgccagtattttactgaggatttttgcatcaatgttcatcaaggatattggtctaaaattctcttttttggttgtgtctctgcccagctttggtatcaggatgatgctggcctcatataatgagttagggaggattccttctttatctattgattggaatagtttcagaaggaatggtaccagttcctccttgtacctctggtagaatttggctgtgaatccatctggtcttggactctttttggttggtaagctattaattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcatctatttgattcttctcttttttctttattagtcttgctagcggtctatcagttttgttgatccttttcaaaaaccagctcctggattcattaattttttgaagggttttttgtatctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccttctacacactgctttgagtgcgtcccagagattctggtatgttgtgtctttgttctcgttggtttcaaagaacatctttatttctgccttcatttcgttatgtacccagtagtcattcaggagcaggttgttcagtttccatgtagttgagcggtttagagtgagattcttaatcctgagttctagtttgattgcactgtggtctgagagatagtttgttataatctctgttcttttacatttgctgaggagagttttacttccaagtatgtggtcagttttggaataggtgtggtgtggtgctgaaaaaaatgtatattctgttgatttggggtggagagttctgtagatgtctattaggtccgcttgttgcagagctgagttcaattcctgggtatccttgttaactttctgtctcattgatctgtctaatgttgacagtggggtgttaaagtctcccattattaatgtgtgggagtctaagtctctttgtaggtcactcaggacttgctttatggatctgggtgctcctgtattgggtgcatatatattcaggatagttagctcttcttgttgaattgatccctttaccattatgtgatggccttctttgtctcttttgatctttgttggtttaaaatctgttttatcagagactaggattgcaacccctgcctttttttattttccatttgcttggtagatcttcctccatccttttattttgagcctatgtgtctctgcacgtgagatgggtttcctgaatacagcacactgatgggtcttgactctttatccaattttccagtctgtgtcttttaattggaccatttagtccatttacatttaaagttaatattgttatgtgtgaatttgatcctgtcattatgatgttagctggttattttgctcgttagttcatgcagtttcttcctagtcccaatggtctttacatttttgcatgattttgcagtggctggtatcggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttcttcaagaatgttgaatattggccgccactctcttctggcttgtagagtttctgccgagagatccgctgttagtctgatgggcttccctttgtgggtaacccgacctttctctctggctgcccttaacattttttcctcatttcaactttggtgaatctgaaaattatgtgtcttggcattgctcttctcgaggagtatctttgtggcgttctctgtatttcctgaatgtgaatgttggccttccttgctagattggggaagttctcctggataatatcctgcagtgttttccaacttggttccattctccctttcacttttaggtacaccaatcagacgtagatttggtcttttcacatagtcccatatttcttggaggctttgttcatttctttttattcttttttctctaaacttcccttctcgcttcatttctttcatttcatcttccatcactgataccctttcttccagttgatcgcatcgactcctgaggcttcttcattcttcatgtagttctcgagccttggctttcagctccatcagctcctttaagcacttctctgtattggttattctagttatacattcgtctaaatttttgcaaagttttcaacttctttgcctttggtttgaatttcctcctgtagctcagagtagtttgatcgtctgaagccttcttctctgaactcgtcaaagtcattctctgtccagctttattccattgctggtgaggagctgcattcctttggaggaggagagatgctctgcttttcagagtttccagttcttctgctctgttttttccccatctttgtggttttatctacttttggtctttgatgatggtgatgtatagatgggtttttggtgtggatgtcctttctgtttgttagttttccttctaacagacaggaccctcagctgcaagtctgttggagtacccggccgtgtgaggtgtcagtctgcccctgctggggggtgcctcccagttaggctgcttgggggtcaggggtcaggaacccatttgaggaggcagtctgcccattctcagatctccagctgcatgctgggagaaccactgctctcttcaaagctgtcagacagggacatttaagtctgcggaggttactgctgtcttcttgtttgtctgtgccctgcccccataggtggagcctacagaggcaggcaggcctccttgagctgtggtgggctccacccagttcgagcttcccggctgctttgtttacctaagcaagcctgggcaatggtgggtgcccctcccccagcctcactgccaccttgcagtttgatctcagactgctgtgctagcaatcagtgagactccgtgggcgtaggatcctccaagccaggtgcgggatataatctcctggtgtgccgttttttaagcccgtcggaaaagcgcagtgttcaagtgggagtgatccgattttccaggtgccatctgtcacccctttctttgactaggaaagggaactccctgaccccttgcgcttcccgagtgaggcaatgcctcgccctgcttcagcttgcgcatggtgtgcgcacccactgacctgcacccactgtctggcactccctagtgagatgaacccgatacctcagacggaaatgcagaaatcacctgtcttctgcattgctcacgctgggagctgtagaccagagctgttcctattcggccatcttcacataagatcatgtttttcttttataccacatggtcaggctgcaaattttccaatcttttatgctctgcttcccttttaaatataatttccaattttagataatttatttacttaggcatattaccgtaggctattagaatcagccaggtcatatcttgaacattttgctgcttagaaatttcttctgccagataccctaaatcattcttttcaagctcaaaattccacagatccctagaccagggcacattgctgccagtctctttgccaaagcatagctgagtgtccttttccccagtttccaatgagtttctcatctccatctgagacttccttagcctggactttattgtccatatcactattagcattttggtcacaacaatttagcaagtcacgaggaagttccaaactttccctcaccctcctgtcttcttctgagccctccaaactttttcaaattcttcccattacccagttccaagtcatttccaaattttcaggtatctggtttttttaatttttcaaaaattcagtttattgagagaagacatatatggtaaaatgcacccatttgaagtgtagagttcagtgagttttgacaaacataacctcaagccacaatgaaaatacagaatattctcatcatgcccagaaagttcccttgtaccccttggtagagagtctttccctccacacccaaccccaggcaaccacagatttgctttccgtccctatggattcgttagcttctagaattggaaataaatgaaatcgtatggcacatacttcattgtgtttggtctcttttcctgttttttgagatccacagacactgctgtgtgtattaatagtcattcatttttactgctgtgtggcattccactgttacaaacataccaaatatccatttcattcttgatggatgtcaggattattttcagtttattgatattataaataaagtagtaacagtctttgcatggacataggtttttgcttatcttggggaaataagagtcgaattgtttggtcacatggaagtgttcatctgcctttataagaatctgccaaactgttttccaaaatgattgtaccattttacattcctttttttttttttggcagggtctcattctgtcccccacactggagtgcaggggtctgatccctgcccaccgcagcctccgcctcccaggttcaagtgatcctcccaggttccagcgattgtcctgccttagtcccctgagcagctgggaccacaggcattcactaccatgtctggctgacctttccatttgtagcagagatgtgtttcgccgtgccggccaggctggcctcaaactcctaaccttaagtgatccacctgcctcgaccccgcaaattgctgggaccacaggcgtgagccactgcaccctgccccattttacattcctatcaacatgtgagcgtttcaactgctctgtatccttatcaacaatgaagactgtctcttttttattttaaccattccagcaagtatgttcagatagctcattatgggtgaatttgcatgttcctgatgaataattataccctgtgtgtgcttaatgcccacccatataccttctgtgagatgcgtgtttaaatctttcacccattgttttactgggttgcttgttttcttattattgagttctaagagttctttatatgctcgatacaagtcctttgtcctatatatgtattgtaagtattttcagagggtgtggcttgcctttttattttcttaactgtctttcaaagaaagagagtcttaaattttgatgagatcccacttatcaactttttcttttgtggcttgtgctttttgtgtcccaagaaatttttgcaaatgttcactgtttttcctgtgactactctgttgccagagccacctgcagataagacaattcctccaccttgaattatcccggtacctctgttgaaaatcaattaaccaaaagtgtgtgggttgctttctgggctccattccaccccaatggcctgcgtgccagtcctcttaccagcaccacattctcatcgctgtagctgcacacagtcttaatattggggtgagtaacttacactgttttggctactcttactcatttgtatttccatatcggttttagattcggcttctcaatttctacaaaaaaattctgctataattacaatagattgcactgaaattatcaattagtttggggagaactgatgtaacactccacgagcaaagtctacatctgtttttatttaggtcttattatttcaatgtgcatgtcctacaaatattttcttaaatttattcctccatatttcaagtttttatatgctactgaaattcctaatgaaattgaatttttaaaatttcattttccaattgtttactgctaatacacagaaatacaattggtctttgtatactgaccttgaattcttcaaacttgctaactttacttattagttctagtggcttctctgtgggttccttaggatgttttatggacactctaatgttgtcttctctatggttcccttgcttcacctcaattcctggcccacctcaattcccagtgaccctgatacccattgtaaggcagggaggcagctgctttctgtcatctgtgctgcagtagtttgggaaatgccctcagttgaaaagcagaaaacgtaaaaatgtcacgtggttcccccctgtctttcaggggtagatttatctttggtctctgcttacccttttgccaggctttctgggatcgccactgtgaacgtgtagtttagtggtcggcctgggatttgggcagttcctactcagattcgggcctcacctcttggtagttttctcgcttctgggattttcgtattaaatttccagtattcttcaagttccagactatctcctctaccatcttaggagagtaaagcctatgtctcacaccactctagtgtggagattatgaaaaacccttaggcaagagagccacaggctcccagttcaaacccactgcagctgctgctttataggagcaaactctcctccagctctggcctgcttttggacactctgaggtccctttaaataattttctgggccgggggcggtggttcacgcctgcaatcccagcacctcgggaggccaaggcgggcggatcacgagttcaggagatcgagaccatcctggccaacacggcgaaaccctgtctccactaaaaatacaaaaaattagccgggcgtgttggcgggcacctgcagccccagccactcgggaggctgaggcaggagaatggcgtgaacccgggaggcggagcctgcagcaagccgagatggtgccactgcactccagcctgggcaacagagtgactccgtgtcaaaaaaataataataatgattttctgtccaaattttatatttatctatgggacagtttgtgcaaccatggttaccagaagttaccagaagttttggctaaagccttctaaatatcttgtttctttctcctttgcgggagtgtagcttgcttcttgagtgactgcagcgagcagctgcttgcgtgcactggctgcctagtgcagccaccctgcttcacctttaagagcaggtctgtgggctccagataccagctggcaaccgcatggcctgcttcatggtatgccacggtcttctcctcaggctgcagaacctgcgttttcttctctaagcgaccaatcacttgctcaattgcctgttcgaagtgtttctgatttatggaatctgacaggtgtctcgcagcaatctacgcagcttcattacagacattagcaacatcagcacctgaaaaccctggagttaaagatgccagttttcttgccaatttctccttctccagggtactgtccagttttagtggtcggaggtgaactttgaaaatagaaccccttccttttatgtctggtagtccaataaagatttgcctgtcgaaacgccccggcctaagcagcgcagggtccaggatatccggttgattggtgctggccaaaatgacgacatttgttgttgtattaaaaccatccatctccaccagcagctggttgagtgtgtcctcctgctcattctgccctccaaagttgccttttcctgtcttccttcccaccacattggaagaggatgcaaggggcattcttccgagcaagggcaaataagtctccgactctagctgggcccacaccaacaaacatctccagaaactcggatccactaacggtgatgaaagggacattggcttttccagctgtggccttagctagcagcgtcttcccagtgcctggagggccagtgagaatggcaccctttgggatttttgctcctaggtcttgatactgctttgggtttttcaagaaattcacaaatttcatgatctctagcttggccttctcacagccacatctttgaactgcacatcaatttcatcctttaagaccttggtttctctgacactaaagagttggcccatccctcggcctgtccggccaatgccagcaggccctcttctgatggtgcagagcaagaaggcaatgatgagcaccgcgggcagcatgctcagcaggaaagagtcatcactttcagcaatgtagacaacaggcacccgattttctccttctatgcccaattcctgctgtaaagtttccagattccattcaaaggtgtccacactgccagtattaaaccaaacgtgttgcccatcaacaggagttcttcctggtgtaaaggtcactcgaacaaaacgctcgttgacaactttcagtctgtctactactccttttgaaacatagttattgacaagttccttccaagtgacttctctcccggatctcttgagcaggaagtaaaacatgactctaccccagaatagagcagtccagacgaagaacatcctgaaatccttgtcgtcccatggaaagtcacccttctggaacctggaccaccagtgagaatcatctttcttgccacctcgttttccaccgccaccacctcctccttcagaagagtgtgtggtagcagctggctttgattcttttttctgtcccataacttctttaggttcattagcatttttcccccatttttttccattaggaaagtatttttcaaatccttttgggggtcgagaacagaatatttgataagcagcaattacatctgtcaaaagagaatttctgctggcccttgcttgagttgtaataaatccataaagcgtccgaaggcagggctgctcgccagggcccatgcctgccatgcacgaagagctgctttaggccgcggggcccagcagccgacccggccccacagctgcaagcagcagcgagccatggccaccgcagtggccctcttggcccgggacgctgcgcaggcgcaagcaggcgacaacgggctgcctcgggaagcgggctccactccgggagaggctgccaggcagcgaagtgcgcccgtggctcactgcagagcgcaagctctcaaccaggtatctttatagtaatattccacttctctggtaccaattttctatatttgtctgttcttatattgctataaagaactacctaagactgggtaatttataaagaaaaaaggtttaattgactcacagttctgcaggctgtacaggaagcatgactggggagccctcaggaaacttacattcactggggaaagtgaaggagaagcaaacacatcttacatggcgggatcagaagaaagagtgagaagaaggaggggacacacacttttaaacaactagaagatattgtgagaactcactcattatcatgagaacagcaagtggggaaatgtgcccccttgatcccaccatgcccctcttccaacactgggggttacaattcaacacgagatttgggcagggacacagaccctaatcatatcatcatggatatcacctttgagaaaaacaaaggttaatcaaaaaacaattcttatcagagtatttttatttgtgttttaaatagttgtcagacaaatcttcagttagaaatcaggccaattttgacttttggtttttttctaagtttaactcctataagtatgtattaaattaaaaatatccagacatcttcaaaattgcgtgatggaaagaagtgatgcctgagtggttcactcttcattttatggccagattgaagttaaggttgtgagttatcaatgactatgatcttccttaggagaaaaaaaaatgtggcttgagtgaagcctctaatctcagtaggctaatagcctccatcactctgttcttgggtgactcatggcttcaaatccctgagttcttgcttgaaaaactttgggtttcccttctgcccacccatggctcaaatcattttatctcccctctctgacacctccttcaatgactaattttagaaaatatatttagcttattttaaacaaaatcttatttttattgaattggaactctgaacttaatttgataaattgaacttaatagggcatataaataggatatctaatataaatgaaaattcaacaaatatgcagagaggtgattcattatttgaaaaaaaaaactgcttccagcatgagaagggtaaagccatgatattctttaacttgtctgtttctttaactcatttatcacgtccaaaaacagaaaaagggtttttttctattacagttaatattgtgtttatcaataaagaattcaaaataaatatcctacatgctttggatgtcttctaggcaatcactaattgcagctaacacagaaaagatgtcatgtgttttggtgacattgttgtatttgataaaagatttttcttcattttctgcagctcctaagcccatgaccgttctgtctccttaccctagttcctcattatgacaggcagaacaagtaggacactgtgcagggaatggaaaggacactgggtggttgtaaaaggttgtctccactcccctctgtgtttgaaaaaactgaacattaagtgctgcatttaaatgcacacacacagttatactgtttgaaacaggttaaaaatgtggtgtgctttgtgatgacttcctccagagtttctcagaagtacattaatatgccaatgtactctcatttttctatgtataccaattataagataaagtgttaaaataattctgaaaaatgtaactgtaatcaattagaataattagaataaaagaccctggtgaccccatccttctgaaaacttcaaaatctgtagaaaatatacaaaaaatacacccagttttagcaaaaattactaaatcctcatagaaatttccattgatcttggacttccaagcctgtagaactgctcagagatactttcttttcttctcttccttttaaagagcttcatggtgtgagtggagtgtctgaggagtagcacctcccagcttctgcctgggcactcacctgagctgaggtgctcacttgagcagaggtgcagcttcggccaccatgggaaaaccagccctccctgggaagcacctctctcccagccttgcctagtgggggcctgggccatcctgcagggcaggtgctgctgcctcccctgcaggtctgcagctctgtattcagggctcacggctggaagcggagcctttatgctatgccctgggtggcacgggagggcaaacaggctccagggctgtgcacaacagcgcagctaggtggtccctgcctggtttcctggcctctgtaaacagaccccagaggggaccctcctcagcctcagtcacacctctgagaaatgctggggactggcatctctgccgagaggaccaggttgtctaccaaaggcccagctagcccatccctccctgcacagcaggcttatgcctggcctggaggcctggcacatacagcagcaaagggcaaacagagcagccggtaggatcgccagcaaaggcaagggtagacccagtggcagaagcctccttggtcagcggcaggcaaggttctccctcccttccctagagtggccagctgccctcacagaactagacctcccttaatcatccccccagggtggcggctgcctggggacccggtccccagcaagggcccctgatcttggctgccttcctctcgctgctgcacagagcctgcatcctcctcctcctcggatcctccttaccctcctcctctacctcctcctcctccttgtgctcctccttcttctcctcaccctcctcctcctcattctcatttccttcttgccctccccctcctcctcttcctctcactcctcctccttctgatcttctcctcctccccctccccctcctcctcctgctcctcctcccctcctcctcctccctcatcctcctccctcttcctcctcccccttcccttcctccgtctcctcttcctccccctcctcctccttcccccgtccctcctcctgcttcccctctctctcctcctcccactccttctcctgcttcccctcctcctcctccacttttccttgccctcctcgtccttgttcttgcatttgctcttctccttcacagcctttccttcctctttgcctttttcttgggctggtccttggagggaatttgcctttctaatcttccttgctgctctccttggggtctgcctcctccagccccagccttgaggtctgagcagcttctgtctgaaggccaggaggtaggactgggttgcaggggctgctgggcagggccctcttcctcctatcacatcagagatgttgtctggcacgggaaacatccaccctccgctgtgtgtcccacgcttctctctcaaagttgggttcattcatgaagaaggacagcatttagcagcggtgggcccctcagggtcgctgacaaagatgcctgctccttcttccctcctcgggtctgagagaggggccctcggcaggggcctgggcctgccccgcttctgagagcgcctgggagcccaggtgcagccctggtgggagcttcccgctcctcggcctctaggcctttgtggaggacatgtggtctctggctctgcccactgctgggtagcccggacagcgccttttgagggacctgccacctcccctgttcgtcctccctggaaagagtgatgttttgactggggttggggaccgagggtggcaggggcttcctgtggtgctgggctctgaggcccatgtcgtcctggagaactgccagggtttctgggggtgtggctctcgcccagggcctccccagattgtggctgttccgctgtggccttggcttccactatctttgtgtccctgggggtgggtgtgtggccgtttctgccaggaatatggagtccaggtgggtgctgggaaccaagtcctccacattctggacttttgctgaggcttctgcagccggggccagctctggaggtgaaggggctgcattggccgcgtgatgtcccagacagcctggaggtgacgctgcgcggtggggcggggtgaccagacgggccccagcggcatgtgggagccggcagggtctccgaccctgggatgttgaggacgaagaggacggtggcggacgggggacaggctgatggggcattgaggggccgctgtgggggcgggcggggtgagggggtctggagctccgggtggacactgcgctcagaagcgtcactggctcctgggaggccaaggaccggctttgcctgttggccgccagcggggacgcggagctgcggctgggagcccccacgtggaggaaagtgcaatgcttctggtcctcagtctcctgctgcaccaccgctcctccagcgtggagtccacctccaactgctttttctccctctgaagctgcaaaaatggaatattgaaaaattcgtgaaggtgctttaggcccgagctgttcttcctggaagactcggcggaggggaacaggaggagcggcctcagcaggatgactcccactggctcctgtcccgcagtccccaggacgcacacctgcgcgtgggcagcactttctgaagccccagagaatgcacttgaaggcgcactgcttggtgatggggatcacctggccagccggtggcagttcttgggcacgtccaggaacttgcatccaggtccattttggactccgcctccttgggttgttctccacctgcaagccccggtctggctgtttgcattttccaccctccactacctccgagacttcaactctcacgacgtcttcagtggtggggtggttcccgtagatgctgtggcctggatccctgcgtggggatatccacctccaccaaatgcttgccctgcggaccgtgcctcagcgcggtggggcgggtggccccgtctcccggatagccatcttcatgttttcacgccacggcgaagcgcctccgtggcctcagctcctggcctgcagcacgcaggggatgttcttgtccccgccggggcctgctccgaccccaccagcttcttcagggcgggaaccatctttctactgggacgtccgagcccggtggcggccgggaagctcagcggcagcggcggagcagctcgactcgcactgtgtccccgcgggacaggcctcccgctaggcccgggacccacggcgccacgcggcctccagccagggctcccgacctcagcgcagctccgccatgtcctgcggcctccggagccgccgcctccagccctcggcgccgccacctgggagccggctgcgcagggcgccagcgaaaatcgcatttctgcttagaagccacccagttcacggtgttgtgttatggcggcctgaacggactgaagcacatagtgactatgtctgtgctcgcttttaaatttacttttatctttttaaaatttttattagttttcccggaaatcttgatgttttacatagcctcaaattccttcttggcaaagttatacttgctaaatatttagtagtttcagcaactgtctgaaaagacacaattatgctgctaaaaaaacaaggaagaaagaagagacagcaacagacagagtttgagaatttgaattttctatacacacagattaaattttgcaaataatgtttctcttcttttctgttgaagtaaaaacacccaaactttcctgtatatatttgtacaactgaaatcccccctggactgtcacccttgccctaactaaaaaatcagttatattctagaaaatgagaaagaaaatataatgaagataaaaacatgtattaaacatggttatctgaacggactgaagcacatagtgactatgtctgtgctcacttttaaatttacttttatctttttaaaatttttattcgttttccccggaatcttgatgttttacatagcctcaaattccttcttggcaaagttatacttgctaaatatttagtagtttcagcaattgtctgaaaagacacaattatgctgctaaaaaaacaatgaagaaagaagagacagagcaagagacagagtttgagaatttgaattttctatacacatagattaaattttccaaataatgtttctcttcttcttttctgttgaagtaaaaacactcaaactttcctgtatatatttgtacaactgaaatcccccctagactgtcacccttgccctaactaaaaaatcagctatattctagaaaatgagaaagaaaatataatgaagataaaaacatgtattaaacaaaaatgcagtgataaaatcgtgagtttcaaaataccctgtgagctttgtttgttaagtccagggaaagagtaacaaagataggcattaggtgtgcaggtcatttacatgtgtttatgtggccatgtctaccattttctctttaacttttcataacgtggaactcatttctttaggtagaagttatgagttaactatcttggtagtgtttaaagaacaagcattctttaaaagtccattctttttcttcatttttgaatatgcatagcattacagaaaaattggaaagtaaaccagaaaaatacccataatctcaccattccaatacaatgctgtctgtgctttttcaaaaaaaagggacctcaatttctaaacttagagaaaaatctctagcttttgaatttttttatattctgaatttttgatgaagagttatgaatttttgatgaagaagtatttgtttactgcctctagcattgtattttaaaagagaccggtcaaaatttgattttaaaacaaaggattaagaactcttccatttgtgcttattttacatctatcaggtgagagtaaaatcactgatttaaagacctctgagttttcacaacacaaggaaaaataaatagacaccacccttactgttttgtacattccactgaaatataagttccttgtggacaggggttttcatctgttttatttgctgctgtatcccagtacctggcacctagtgccacgtaggaagtactcaagtacttgttgactgagctaattaaaatagtttcaccatagcagaattgcctttattctgtgggggcgacccatgtaagtttatcttttatgtcaaaaatgccattttaatgcatttatgaacatcttcaaattgcatcataggttttgttaatttttttaactagagtacttcagacatattttgcctgctgactcaatggtgtcattatgaatattactataatttttaggtgggccagtgaagcttgtgttaattaccatgaactgttgttttgatgacttggaatagattaggatgaatgttgtaaaggtttttctatttctgctggaatcttctgtcattctactcatcatcatctaggtaatggtctaaggctggcaccatttctcttatcaagtaacgcaaatggactttttggcagatagttgttgtttaacaacttttgtttttagtttcagagactatgttctggaatgttgagatttcttcatacatgacctctagagaaataggcatattataaaatgagttacactgtgtaactgagggcatgtgctgatggcaaaattattatcttcaagaattttttttttagtgttctgcatttgcccacactgttagaaatggaatgttagagaatatttattattttgttgctatcaaagcaaaatttgcagaaacttgaatttattgtaattactgtattaactctgaaatgcatggctatgttttaagggaggtttttgccttccatattgttctcgttctactttttcttttactcagaaggacttaatctctaaacattagaaaatgttttatacagagacaggtctcactgactacaattagaattataagaatctcttcatttgtattagttgataaaagtattttttcctgtttttagataacagtcctccaaaatttatattactattatcaattcacttcttaagataagcacaatgaagtagtgcctctgggtgttaggattatgtagttttaacatttacattgattatctgtattttctactaaaaaaaaaagcctatacgatttaatcaatatgttaccaatagataacaaaagtatagaatactgtttctgctcctttaatagcgagactttactctaatttcatggtggttctaaggtagtagtaagatgcaaaaaagaggtgcagatgtgacaagaaaagtgagcaaaaagtaataatgaacccacttaagaaattacatgtctgtataagtattaaagataaagcttaggcagggcgtggtggctcaggcctgtaatcccagcactttgggaggccaaggagagtggatcactcgaggtcaggagttcaagaccagcctggcgccaacatggtgaaaccccgtgttgaataaaaatacaaaaattagccaggaatggtggggcgcgcctgtaatcccagctacttgggaggctgaggcaggagaatcacttgaacccgggaggtggaggttgcagtgagccgagagctccccattgcactccagcctgggcgacaagagggaaactatgtctcaaaataaataaatacataaataagaagaaataaaaaggttaaggatctgacacagaaatgcacacattttcttctcaactatcaaaagcaggaggaaaatttttaaacttcccagagatgagttttctaagttttattttccaaacttcactcttattaacctttaaaacaacactggtagatcatttctgaagtgaagttttaaaatattcccttcactgtctgaaagcaaaatataacccttagttttatcaatttgtaatttttagttaaagaaacaacttgataatggggactaagggaaataaagtttctctgcgggagtccctgctgaatgccgccctgagctagcgggcgacgctgcgcttccccgctggagggcgccatcatcccatccacagagagctcagcaggccacgtgccgcggcctgctgcgaacccgcagggactgctccctggctggcggcacccttattgttcaataaagacctggttcagagacaaaggtggccctgtcagtagctctgaatagccccaagctagttgctgatcctaacaggcccaattaactgctactcatttagcaaagcggcccgggacccatcccgcttcccgctccaccttctgaaactctccctgcctgggtaccttggctatgggctttgcagtctccctttagcggatcaaaggtgtgtgggaaagaatgacggctggatccgcctccacaggtccttacacagacgcacacatcacagccagacccaaagcactcatggtggtgagcgagagcccgaggtggaattccagggccggtctcagaacaacgccttgattgccgtgattcgaagagctatctcaaaacatttcgcttcagtgaagtgcctgagaagaaacactcgtcacaactcactctgctgctgacactggatgtactcaccttaggtcctcccactgccaggctgcctggcctcgggaacacgctgacacacacaagaatacacactggagctggcttccttcctcctcacaactaagtatattcctgttctagaagtcccccaggatcatgttagacaatgtgggaaacagacgggcagaaacagaaagggaagaaagagaacccaatgtccccatgcaacaattagactttggtgatggaattttctcatattatagaaggtgccttgtcaacatcatgggtagtgacaatataatattctatactgttctcattcatttcccattctctaatacctgtggccacttggttttttaattttttgtcattatgagcattattgtacataaaaatttccccatatttttgggtaatttacttatttttccttttttttgttttttttttttttggagacggtgttttgctcttgttgcccaagctgtatgtagtgcagtagtgcgatctcagctcactgcaacttctgcctcccgggttcaagcgattcttctgcctcagcctcccaagtagctgggattacatgcatgcaccaccacgccctgctaactgtatagttttagtagagacggggtttctccatgttggtcaggctggtctcgaactcctgacctcaggtgatccacctgcctcagtctcccaaagggctgggatgacaggcatgagccatttttgggtaattttcttagaatttattttgaaagcaaaattaagtcaaatttcagcctaatcaaaactaggtaaaaagatgctaggtcaagggatattgatacatgttgctaaattgttttccaacagaattggaacatcttttttttctgcccagcaatcattgacaccagtttatcagatatccaccagcaatgtgttatccttttttggaaatatttatacaattttatgttagactattactgtaattaaactttcccacgtgcttgttaacagtatgtggaaattttccatgtgtttcatcaacttgccgtgtccataacaatttttctaattgattgcctgattgctttatatagcataaatatttcctgttgtttcattcaattttgattttttgtagatacatctattttttcatttttaggtagttaaatatatcagttttttaatttattctatttattaaccttggttatttgttatttttatgtattttacttttcaaatttatttggaatccagcttctgaaggtacaaattattttctgtataccaaagcaatgaacatttcatgtgtcattttagtaaaatgttttatttccttttggatatatactacgaataggattgctatatcagatggtagttctgtatcaagttctttgagaaatctccaaactgttttccacagtggctgaactactttgcattcccaccaacagtgtataagtgttcccttttctccccagcctcaccagcgtctattgtttcttggcttttgcatagtagccattctgactagtgtgagatggtatttcattgtagttttgatttgcatttctttgatcagtgatgttgagcattttttcatgtgtttgttggccgcttgtatgtcatcttttgaaaagtgcctgtttctgtcttttgtccactttttaattggcttatttggtttttgcttgttgaatgaagttccttatagattctggatattagacctctgttggatgcatagtttgtgaatatgttctcccattctgtatgttgtctgtttgctctgttgatagtttcttttgctgtgcagatgctcttcaggttaagcaggtcccacttgtcaatatacattttcattgcaattgcttttgaggacttactcataaattctttcccaaggccaatgtccagaatgatgtttcctaggttttcttctaggattcttatagtttgagatcttacatttaaatcttaaatccatcttgagttaatttttgtatatgatgaaaggcaggggtctagtttcattcttctgcatagagctagccagctatcccagcaacatttattgaataagtagtcctttccccattgcttatttttgttgactttgtcaaggaccagatggctgtaggtgtgcagctttatttcttggttctctgttccactgggctatgttgttttgttttgttttgttttttaccagcaccatgctcttttgatatagtttgaagccaggtaatatgatactgatacctccagctttgttctttttgcttaggattgctttggctatttgggcttttttttggttccatatgaattttaggatatcaacttgggttacatcagtggtggattggataaagaatatgtggtacatatgcaccgtggaatactacacgcagccaaaagaaatagtgaagtcatgtcctttgtagcaatatggatgcaactagaggccattatcctaagccaattaacacaggcacagaaaaccaaatactgcatgttcttacttatgaaaggaagctaaatactgagtactaatggacacaaagatggcaacaatagatactggagactaatagagggaggagggctggagtgggggaaggattgaaaaactaacctgggtactatcctcactatctgggtgatggaatcgttaatatcctaaacttcagtgtcaggtgatctacccatgtaacaaacctgcacatgtactccctgaatctaaaagaaaagttgaaattgttttaaaaaattgttgaaagaaaaaaaaataataagtatgaagaacatttcttaacagtattttgtagtccatctcttccccactgatgtggatgactttcttcaagtatcttaagttttatgtaactataatctacgtctgaatgatatgtcctcttcttttttcttttgttctccagcaacttttcttggtcaaagaatgcagaaggatatatggtgtctgtggtttaattaacaggattgtttgtaaaacaactttacatttatcttatttttaaaattcttgcttttgaatagctgatgtattagaatagacactctcctatcccatgcaaaaagctgttaaaaaatgagcagcttgcaaatctatcataaatgagacattgaataaagcattcttacagtgagggctaaggagcagttcagtctagaatttgcttcagatactttttgaaataaaatattcaaggcataaaaaagcaaaactcgaaatatctaaaacagatacctactgatatttttaccctagtctcttcccacagtttttatgtgtctctgtgctccactgattcaaacaaacaacaagagcagtaggcatcttctaactaaaagttaatttactagtcttcaactaaaaagtcacagtggaagaacatatgtaaggtgaagaaagctttttaacctttcagacttaaataatactgtatttcaactttaaagaaaggctccactatatattttctgcattgacattttaaaatatatgaacaagtctttgtggtacaatatatacttcaatatatccaatataccttatatgaattaaaaacatgtcaacttgataactgtagtaaggcatttaagtattcagaggagccataaagaaatttcttaatgagtgctgtccttttaatattaactggatttagtaggtttccttaaaatgaacaggaaacaggccgggcgcggtggctcacgcctgtaatcccagcactttgggaggcctttggcaaattagaccccaccccatctgagacttcacctcctgcaactctgccgtccaccacccttactctagccacattactgccaagcataatcttaccatagggcctttgaacgggctatgcctccaccagaaccacttttcccgtttatctgatcactccttcaccttcaagtcttgatcaaatgacagcttcacagtgacaactttccagtccatcgtaatacagattatgcttcccctctactcagccccaccccttgatatctgctttattttcctttatatgacttatcactttctaactttttaaatatttcagatatttgtgatgtttgttgtttgttggctccccctaaaatgtatgatccaagaatgctgggattgctgcttgttctgtttcctgctgtatcccaagcacacattaaatctctttggtgtaagactcaatgacttaaatacttttcaattttatctcttgacttggtttgatcatccatatttttttcattcaaaaggaaaacacttctataatgtcactattgatacttttttcatgaataaatttgttttcaaacagttttactgtactttattttctatcttgtgaatgtttgaacaacactttcaattctttattcagcgttttggagatttggtgtttacaaatgttgtttttacttctgaaattaattttattgccaaaatatattttatcaacctcaagaagtaattgttgattattcctatggagaatttgccaggtgaataatatttctcccatgatcttttctcactttcctcccttatttaattgaaattatcttgaactagcagacccatttttaaattttataattatgaatatcaatatacatgtcttcttaaatcatgtttaattagctttgttttggaaagcgtttatgactataaccattgatctacatataattacatgtttatatggttccaatgcttgtcacaaacctttctactacttgttttattcctgcttctttgaaattcatcatagttttttatgtaattctcaaaggtacatttttttaaaggaaaactatgggagataagtttatttaattccttgctcctataatcttatcaatggaacaataactttgctaggcatgcagttattaggtaacaatgtttcctttctctggcctctttttgtgtgccaattctgagttctggagatatggttccctcctctcctagtattcaatgcatggagggtatccctgccttcccttcttctagtagataatttttgatagtggtaatctttgtgattgttgtttttctatctagaagtttgcattatttcttcttctccttcgtcaactcctcctttttcttcttttttttccaaaactcaacttcttaataatttgtactagtaccaaaaagcttctttactttaaggtatgagagatttccttacgtttaactcacttttccacatacatatttctgattgttgcttctgccctttttcattcttgcctctttttttatttaacttatcttgtttgttctttcattctttatcctgaaatatttcttcatatactgatgatgtatttatatcctgatctttcccttattaaagtccataatttttaccttaatctttgtttctaatttcatacatatccttttatatttctaccttcatctaatctatctccttgtgttatcttcttgtcttttatttctcatatattaggactcttatttgcaagtgacagaaactgaagctgcactgagccgagcatacaggagcttaatggtttataatcctaaaacattataatagcgtgtggagtaccaatgcaataacacatcaattacaccatgaacacaccattaaaaatgagaatttgtaggacactcaagagacatataaaatgctaccctactagagaaaaatgtgataatattaaatataggctaaaaaagattcctactgtcaaaaaagttggttattttacatctatcccaagtttaagtctggtcataattacccaaaaataaatttaacaaacaggtcccagagttcacctaatgaataaaaatggcttagcggagttttggttaaaaaccctgtagaagttgcatttcaaacatccactaaatcacagatgttactgaattattgggccacccattgaaatacctagcagatgatatggtccataagcatcccagacatttaagaagtatagtgaaccaaactctcaatcaacagaagactaatcacccggccaattaatttgtgtaggctaaggctaaacttacatcaagctccaatactgtgtattctgtgaagatcaatagagaaagatcttcttcccttcttgtcctcaccctactctggacctctgggttcccaatcccctgaaggcaaatatccattattattgtggctcaatttgtactttgacaaatattgacatctatttcaaagagactgcaaagaaatctggtgttcctctgagttttgttttcatcttgcctttctcaagcataaattaagatattatgttaaatgtttgtttttgtagcctaattacactgaatacactgtcgtcgatagtgtttacatactgcaagctacttaacatattatatatagtaggaaagatgtgtttaaatatgtttgcatggcttaaacttgtatatctcaaaaatagtcttgaattgttatcaagcattgccattagtatgcttttttcagttctaatcaaaatatatcattttattatgctttccagttttactctagaaaatgttgaactgtaactgcacattcaagtctaatgtactgcttcaaaagcaatttgagcgatcttttatctataaatattataatttggtgatggtgtatgtggaacagaaaatgcttgttcaggatgtggcaaatacagccacctgcctgggacagttcacggaggcaggaagactccaggctggaggggaaattaggggatgcttccgagggcaggaggcagacataaagaaaaatcgtggaggtgatgtgggagcataattcatggctttgggtgccaggaaaggaggtgaaaatcctaggaaaatccaagtagggtgaatgagattgcagcaaatccataacactattgaaaggggaatcccctgttctctagagtttaaaggcccttgtttattcactgagagttgtcaggctaattatgggctctggttttctgctccttgagggaagtggcctcttgactcataatactaacaataaacaactccactttgtagggcttgagttgagttacggtttttattttagagaaatggaatttttcccctaatactcagacccagacctgtcacagatttcggtggtttcacagagactcctccaagtctacggcactcttggtcgctttgctttatggcaacaacatgccctccatctacttgattttctttcacttggtttggtgaaatagaaacgtgatgctgaggcctgtgttagttgagagttatgttcttggagtggcaagactcagggtccagggcatctgctcttggagtagctcccttgtgacccggatatttgccgctaggcgatctttccaggtcagcatctcacgtgcaggagacactcgtccgttcgatgcctctgaccgcaccgtccttgcttctagtctcacctggacaccaggagctgcctcttgctatcagcactcaaagcagatgcagccgtttggtgcctgtgcaaggttgcaagtgtgtggttggatgggaggcttctcctcgaccccctggtcccatgtctcatgcatagaagaggaaagtcagggccagaggtcacctggcccgttgaaggtccttactccaggagcagatcctcaatgggagtccagatttcaggtgcacaaggcgtgcggtctttcggcagctcacgccaccatgcacgtggtgtgtttctgctccatgcttctcctacggaggccattccaccgccatggcgtaaccagggaggtgggcgaggccagggccagttcctcacagtcgggggaactaagggacctgactccagcaggtcctggattaccttgatgcatcccagggggagaggttgtgttctgaagattggaggagtgtttgatttatttacatgggatttgttgcaatacatgttgtgaataaattttctttataactgtttcagtataagtagatactgattatctataagaaaattctacaatcctttcaaaagtactaagtaaaataagaagtagaaagtgttatctcggccgggcgcagtggctcacgcctgtaatcccagcactttgggaggccgaggcgggcggatcacgaggtcaagagatggagaccgtcctggctgacatggtgaaatcccgtctttattaaaaatacaaaaattagccaggcgtgttggtgcatgcctgtagtcccagctactgcagaggctgaggcaggagaatcgcttgaacctgggaggcggagggttgcagtgagccgagattgggccactgcactccagctggtgacagagaatgactctgtctcaaacaaacaaacaaacaaacaaacaaaaaaccaaaaaagtgttatctcttgaaatttttaactctgaaaatccaccctctgcacatcttacatagaacaagacaggcagccacaatgtgccatatgtgttgatataataccgcttaatgccagcacgtgtaagatctgtgtcccttctctgtgttccaatgagcagacaaagcttcaaaacattagaaatgtagaaagaacttaaacttattgcaacttactctttattcccactgctaatcacactttgtcatctgatttttatgtaatttttcttccaggtggcctttagcttgaaactcaattgtatagaaataaagtatattattttatataagatatgcctttaaattgatattacatgttcatgttacattcaatagggagcgactttattcttggcacaaacagtccctgaaaacattaagctcactgttgacctcaatcgtggtcattgttttcttgtgtgtatttgttgcacaatgactttaaatataatgtctgaaaaatcacagcatggggctgtgaatactggttgccctgtatagctggagatttatagctcctgtcagtctcccagggatctctgagatggatttaaggtgtgagtggtctccacactttctgggcggctttctcttctctacccagtgaaaccgactgctgtgatgagctggggttggagctgtggctggggctgtcaagatactcttgttactatgatcaatcacagccaggtccatgaagcagttgctagttgagctcagcaatgggattagccccttttttcaagtacttatttagttttataaattttagttgacaaaaatatatatttaaggtgtacaatatgatgttttgaaataagaatactttgtggaatagctaaatcaagctaattaacatatgcattacctcacattttttgtcgtgagaacaatgaaatctactcttagcaattttcgagaatatgatacattgctattacctgtagccaccgtgaagtgcaatagagctcttaaacttgctcctcctccttgtctgaaattttgtaccttttgtccaacctctctcaattctgtccctcagccccatcctccgcagcctcccttccactctctactcccataagtttgagtgtcttcaggtaggtgagatcttagggtgctcggcttcatgcatctggcttatgtcacttaataccatgcattcagggttcagccctgctgccagagacagcagggtttgcttcttgtttaaggatgaacatcgctgctgtgttcatgttccaccccattatctgtgtgtcagctgatggatgcttagggtgattccatgtcgtgtttgtttctgtgaacgatctcattgatgcctcatgcatgccacctgagtcccgcatgtctggtgctctctgcctctgaaatccctggccagcatccgggcacgggggcctgcagggcagatcccagccccactgcctccagagtctccacactgagcaccttgcagcctgccctcctggcacagctgcctccaggaggagccgctatgggaacgtttttgttctcagtaatttaaggtgcttgctgagagcctgatgagaaggaatttgtagcataggaagcctctggtgaaatttctccttggcattattgggaccaaatccccatagtgtcacattgaagtcaacgcaacaaatgtgaactgaaatgtcgcagtgtacccgatcctgtggcccccgagtgccctgtcgctgatggtccggtgttctgggtgcggaccaaggaggagccggtggcaaaggcgcctcaggcaggccctgggctccatgggcggcttgtgctccgcgattttgaggccatttgcagcagctccgccagcccaccgctctgagctgcagccgctgccagccacaacagcaccaccacgagtgtcttgggggctttcttcagaggaggctgtcagcgtcctcaagttccaggcgctctagcctgctacaacaggctttttcccacctgcggcctctcctcaatggcctaaaagcttggccaactcccacaaagtttggcagtaacacaggctgtcactgacatttgtggcgccaggacttgcccacgcgggttgcaaacgtcagccactgtctgtgtcacgtgcagtgacgccgcccgaggtgcgcacggtgcgcacaccgcacgcgcacgcccacgtaacggcttggctgggcacccccgcttggcttggtggtcctggtttggattggctttaccctggcattcctttgctgggcttgaccttttcttgctgggcttggcattcccctggctgggctgggtgtttccccggtggggcgtgcactttccctgggtggtggagggggcgtgggctctccccgggtggtggggggacgtgggatctccccagttggtggtgggggaggggtcgtgggctctcccagggtggggttttggctgggattgacctttctcccctaacagattggaaactcgtaatttcccgctttttggtgaaactcgttgacagacaccatctgctcgctactaccaggctgttgaaagcagatggtggctgaggtttctccaaagctggctgcctcccctatgaagaagccctttggcttcaggggcaagatgggcaagtggtgctgctgctgcttcccctgctgcaggggaagcggcaagaacaacatgggtgcttggagagaccacgacgacagcgccttcacggagccaaggtatcacgtccgtcgagaagatctgggcaagctccacagagctgcctggtggggtgaagtccccagagcggatctcatcgtcatgctcaggggccctggcattaacaaaagggacaagaagaagaggtaaccgggcctggggctgggaggaggcgggaccttgggggatggggttggacgtgccctcgtgtgtgtgtgtgtgtttgtggggggcgccctggctttcttgcctcctcaggtcccacgccacccggtgtgtggatacttcagagagctcggggcacaggcctctttatgagcagcaacacaaaaacaaaactttagttgatttccaatcccataataatttcccttatggaacacttaagagactgttttaaagtgatttaactctcaaaattaagtcgatgcagcagattatttttaatgtacacattttaaaacaatgttatatacattatagaaaggagtataatgagaactaagtcccataatatatcaaattctgagattaaatattcttcagataaaatccaatatgcattttatatcaatgtacccctatgtaaatatgttctttactgaggaaccttagaaggaaactgaaatgggaagatagttcgtgtccttgaataggaagatttatttttcttaagatgtgagctcttttgtgtttatcacttttacccaagccaaataaaaatagtaaagttttaacattttaaaattacacatgctgtcttttactattgtgataaatgtttgtgacagaatggaaaaagacttgctcttccagatatcaaaatgttcatgtgctatttccacaaattgtttactaacagctcaaaagacataaataaatagaacagaatacaaaatccagaaatacccaaatatatgaatttagaacttgatagtggtgatgtttcatagtagtataaaaagatgaattattcataaatgaaatgcatgctgtttggagaaaactagctagattttttatgtcacaaaaataagttcctggggtatacattaaaaattttaaatatacaaattaagaaaagtgccagaaggaaacacaaatgtctatttttatatgcagatatattttatgttcacagagacctaagaacctcaaaaacaagtattctgaagggtggtttggcaaaataaaaattaaaacaccctgtaaataagaaaaaaattaacaaaggacaaaacacttgcaaaacatgtattttcattttacagagaattctttcaaatcaacaagaagacaactaaataaaacaagctcaatttaaaattgggcaaagtacttttttgcatgtctaccaatgacctatgcacataggagaacatagtgttcctgataagagaaggaatttaaattagaagagaaatgaaatactcttttctatctaagttagaagaggaatgaaattctgtttctatccacaaagtttgtgaggatgaagaacagtggtacttatacagcttcttaaggtttaagttgctgtgagttttcaaatagacattttggtggtaagaaccacattttaaaaatgtatatgccttttacccatcaattccattatactgaaatatcttttggaaatagatacatctgcttttcttagtattacttaaatagcagtgtattgagaagaactcatgtaaagattttatgaacaaatttcagtccatccatatgatggaataatatgtaaccattgagggtgtcaatagatacagagataagttgacatgcaaagatgtacttaggtatatatcaagtgagaaaaaaatcagttatacgcaaacagaatctgctcttgtgttagctgaaaatatgtcaaaaatatgataaaacttatttctggggatttgtattgtaagtgaagtttttccctttatcttatctgcgatttctgcgatgaacgtctgaaaagttttagttaagtttcactagtaatgaaataatccttgggaagagaaggagtatgctatttgcataaatacaactaatttctcacattctagtatttatttttctttctgtggatgcgtatcttctgtgaatttttttttttttcgacacggagtctcactctgtcacctaggctggagtggggtggtgcgatcttggctcactgcaacctctgcctcctgggttcaagtggttatcctgcctcagcctcctgagtagctgggattacaggcacgtgccactacgccatgctaatttttgtatttttagtagagatggggtttcaccatggtggtcaggctggtctcgaactactgacctcttgatctgcctgcctcggcttcccaaagtgctgagattacaggggtgagccaccatgcctggcctcttctgtgaactttcattcttttcagaagtagagggaatctgtttacctgttactgtagattttattgtgtatatattttattatataattatcttttcattgtatatagattaacatgtgtaagaagtatggattaattattttagttatatatgaaaattaaaatagcaaatataaatgattattactattgtgaatgtattgctgtactatacaggagttttctttgaaaatattgaattcttcagctgtgtttatcaattctttcaatcgatttattcatcaaacataagccagacacctattatgtggcaggcatattctactatctcttaggatccttctatctttgaaaatttcatgtttccctgccaggcctgagcaaactgagagatttaaaattggactattaggacttaatctcaattgacgcttttcctctctcctttcagaaaaaagcgtttcggaaggtagaaaataataaaacgtaaactttaactgcctttttgaaaatttataacagtcacgggtaaagactagtttaggacttttaagaactaaaacatgatacttaaacagcgtggaatattatgcagccatagaaaaagaacaagagcatgtcctttgccagtgacttggatggagctgcaggccattattcttagcaaactaacccaggaatagaaaaccaaatactgcatgttctcacttacaggtgggagctaaatggtaagaatgcacagacacgtagaggggagcaacacacactggggcctatcagagggtggaggatgggaggaaggaaagaagcaggaaataaaactaatgggtactgggcttaatacctgtgtgatgaaataacctgtacaactaatgcccttggcacacgtctgcctatgtaacaaacctgcacaccctgcagatgtacccctgaatataaaagttgaaaaaaaattccacaaatagtttcataaatccattttaaaaaataaaatttataacaatcttaaatcctaatattaatgattgtaaatatctgatttacatacattctacaaatctaagtattgaaaaaaattagctacacctattcatttgaattccatgttttctttggcttaaagatttttgaacaccaaagtaagaattagtttattttagaaatttgtttttgttttcacctcagccctcttaatgtgtagttcttttaagaactaaaattcatctaaatgtcagtcatctgaccagaactgccccagacctgttatagataccatattctacttaatgtaaggcaccatagattttatgatgccccattattttatgtcacaagaagagagttatttaaatgctgccaattatagtaaattgtgaattataagcggtattccagtgtaagaaatgtgaaaacatggagacaatgaacatcttagaatcaataaaatacaatgttatctgtaatctttaagacatatctcaaagtgtaggtgtaattgtatcatgtcacttatttcaaatagtcttcattaagtagtagtattaatacaaattataatatctgacaattattgagctgttatttgtgttaggaactattctacatattttgtgtagagtctcatttaagcattatagtggttttctgtgagaaagctattttttgcatccccattttattgatgacgaaattgagacacaaaaagactaagcaacagctaggaagtgacagagcttaaaacagttttccagctcaagttgaatggaatccaagggctgcgctctttctgttctgatactctgctctttcattaacacagtgagaataagaggtaataaatagtgtgctttcttcacaggaatattaaatatttgttttgaaggctgggatagcatgctattcagcatttgcaattacatgagtcattggtatggctttagatagtgcattacaatttcctaaaaaagtctctcactctcttaggactgctctacacttggcctgtgccaatggcaattcagaagtagtaagtcttctgctggacagacaatgtcaacttcatgtctttgacagcaaaaagaggacagctctgataaaggtatgcagtagccaactatatcagcatgaggtagatttaagataattaaaaaaatgagttttctcatgtaaatataacttggtgaaatctgtggaatgtttattttgaattcctaggatttacaattgatttcttggtctaatactgacaggccgtacaatgccaggaggatgaatgtgcgttaatgttgctacaacatggcactgatccaaatcttccagatatgtatgggaatactgctctacactatgcagtctacaatgaagataaattaatggccaaaacactgcttttatacggtgctgacattgaatcaaaaaacaaggtacagatctaccaattttattttcaaaatactgaaatacatttgttttaacatcgacttgtgtaagggtcagtttgccatatttggaagctcaagcataacctgaatgaaaatattttgaaatgacttaattatctaagatttaattttaaatattgttacttttaaagaggcatcagcaggtacagctttttttatgcacttgtggtaaaatttttttgaaaacactgaatttgtaaaaggtaatacttattttttttcaatttttcccttccaggttttcttttccctaatcaatgtaaaatgacaaaatttgccctggaagcaagtttttcattaaaactccaagaaaactaaaacatgtttcagtgaatagaaatcttgctgctttggcaagttcctaaaaaaaaaaaagtaatagatatgaagcgatgtatcttttagtggcaaggcttaagatatttctgattccttataaggcagaaatagaaaatgaaaaggagagcaatcagaaatatcgaggccaatttggaaattaggtaatggaggaaaaagaccatgaagagattctgtgtgtgtgtgcttttttttgttgtttgttcatttctttcctttgcgtggtgaaacaaggttctcttcagttttagagaatgacagttttttagtttgggagagggagttagtgggttgtaaactgcctagagattaattttaggagccctctgaggaagcagattggcagtgaataggtggtatgtaatgggaaacccttgagcagagggaatatcagggaattatttgacttattatcctattctggtagaaatggccacttagatagagtctaaactctgctttcaaatctagaatgtcttgatgggaaggtgggagataaagagcttataagtaataagatcaagttggattttgagtttactaggccctgttctaaccccatccaggaaaattaagtggtgttttcagcaaatgagtctctcactctttccttttttttggccaaaagctcaaatgataaagggaattggccatgtgggtgagagatgagactgaagtaattgtctgttgcactagttttcaactagaagtgtgcatctcagtaacttgaggaacattttaaaataatctacaagcctagaccctctcctgaagattttgatacagtaagtctaataaagcctggatatgtccatttaaaaatgtttccttgaaggcaggcatgctggttatggatgccttcctcccagctgctagagaggctgaggtgggaggattgattgagctcaagagtttgaatctagcctggacaacataatgagaccatgtctgtaacaacaatgacagcaacaacaacaacaacaacaacaacaacaaattccttaaaatgcagatacacttctgcttaagaaccactgaatagataagtgtaatatgtaaattctcatatctcagaaacttaagacatctctagaagagttggagttggatatgcgcaatttcctttaaatctttcctttccaataatattagtttgactttctctttctttctttctttctttcttctttctttctttttttctttctttctttctttctttctttctttctttctttctttctttctttctttctttctttcttctttcttctttctttcttctttctttctttctttttttctttctctctctctttctctttctctctttctttctttctttctttctttctttctttctttctttctttctttctttctttctttctttctttctttctgactgggtctcacattgtttcccaggctggagcacagtggtgcaatcacagctcactgcaggcttgacctccccaagtacaggtggtcctcccacctccagtttgtattttatttatttatttatttttttagtagagatgggttttttgccatgtttcccaggctggtcttgaattcctgtggtcaagcgattcagctgcctcagtgtcccaaaatgctaggattacagttgtgagccaccatgcctagcctagtctgactttcttctctgtggttgggacattaaaatgaatattattggtagtatctatcagcttacagaataataccttttccttcctaccatcagttattcactgccattcagaaggtctttagaaatttgcagtgagtattctttcaataagtagaggctggccctctcaggattttgtgtctctttgttattcaagtgcttaagtcagtaagtcattactaagagcagagttttctcaattaaaattgtagcaaattccaaaccatttttgtcaattaaagccatattatggactatccagtatgtctcttaagtttgtagaactttggcataatcaggatggtagtattaaacactaaaaaccatgcagttattaagaatacacatgggaattctgttaatttagtttcagcagtcctatgaactgattatttagttaacaatcaggaaaattaaatataaatagatttcaaatgaataaatatgggaaaaattcttgaaatgggcagtatgagccttaatagcaattttttactgcacattggagcttgattttttgggtaaaacatctgaaactgaagaaatattttacatgcaaattcttgctttatacacaacaatttgtcacagggtttgaggatatagggataaaagatacagaccctgccctcaagaagatttttgtttagataggaaaaattattatcatccaataataccatgtcacaaatgctgggatagagtcaaagattcttgaaaccagtaaatgtttaaagtgagttttcaagatgaccagggttaatgtggtgaggcagaggaggggtgtttccaagggaagagcagtgtgtgggaaagcacggaagagtgagaaggaaacaactacattttatttactttctatgagtataagtccataggatctttatataaagtttccaattcagttgagaaatatataattttttcagttacatattatttttggtttctattgttttacagggtggcctcacaccacttttgcttgctgtacatggacaaaaacagcgaatggtgaaatttttaatcaagaaaaaagctaatttaaatgcacttgataggtttggaaggtatagttatttcttttaatctctgtgttgttctagattgatagcagtcactcaagtcataaatattaaattaataatactaacttatacttattgggacatagttatcagtagcaacacaaatcagttaagtagaaaaaaacagttatttagactgggcaacataaagaacagttttagtaggactcattttattattttgactgatgttatttgttatgtgatgttattggttgtatgttcttatgttagctaaagggatttcatattagttttagaaagtgtgaactttaactttcagttatgactcagtcttgaacttcttaaccctttctagtagtttttaacctctgcttcttatatggttttccactaaatatgctatattaaacataaataggagttgcaaatcattttgtcttttgaataactctgctttaagttgctttctttaaagaatattaatgttagcttatccctacttgacaatcaattgctattcccacatactgtgggttcatcagatttttccctttttatttccagtgtattttgatgtttttatttttaattagtatggagagagggagcgaagatagtcttaagtggatacacttttcctttcatgaaggcaagccataggtgggtgataaagagaaaagagctaggctttagagtcacacaagactgggtttaattcctagctttcttacttgctaggtgtgtgacattgtgaatgttatttaccaccaaatatgttgtcatgtatgaaaaggaggagaatatatccttcaaagttagctgtgcatagtaagaaagatatatatatatatatatctttatatatatctttttatagcatttaattcagggcctagcacatgcttattggtattcattaactgaaaccactatgaccactattcttaccatttgttattactgctttcagcatgcagatagctcttatttatctgatccctagctgattttctattacagtgtatcagtctagggacctgggaagaaaacttcacttaaatctttgtctacttcagataagcagccctagcatagtttcttgcccatcaaaggcctttaaattagtagctgctactatgcaataccccactgagataagaggtttcctttttgtcccttccttttaaccttgatggtactttataaagatgaacccttgagcacccaagatgcttatgtcttttagtacatgtaaatgtttaattctgcatggacgggcaagatattaaattggcaaagtatattgaattagcttttaaaatcacttgaagttcctaagggagaaattatctctatattattttagaactgccctcatacttgctgtacgttgtggatcagcaagtatagttagtcttctacttcagcaaaatattgatgtattttctcaagatgtatttggacaaactgctgaagattatgcagtttctagtcatcatagtatgtaagtgtttacattaaaagtctagttaaaactacattgaggtttaaaataattataatgattgcatcttatatatcaggtgagatgtgatagattgattcaggtagttttagagtggctatgatttagtccactgcatcagctagaaatgaaacaaaaaactagactagttagaagtaccaatgggtgcaggattctttatctcgggacttttaagacctttatccttagagattccaacattgttcatttcattccatgtataacacctatgcatgggataaaaaatagtgccatatctttaatttttctagttagttatttgggtcttgaaatgttcagtttaggagaaagtcttgtactgtcttctggggactgtctcctatatactccctgaattttttgagaaccaaagggattcactaagtccaaggaagacagtcctttttttcaagtcataaggaggagaaaaaaaggacattttaatcattcttttgtttctgttgattctgttgctgcatcgttgccactgaaactggtcctgctgcctggtaatggttggcctttgacatcaagatgcgcttactgattcaaatccctcaagtcttcatggtgatccatacatggacttcaaagttataaaattttttacattcacatacctatgcctatgtgttcagccattgttcccaaagcaccagcaccctgctctggcagcttagcatcctggctttatccacacacaaagtgagcaaattgacccttccacccacattcaaaacctgatgtggaacccacatgttatcctacacttaactgagactgtcatggtaagagatcctttgagtcccatgttggtcttttctctagcagatattagctgggcttgttctaaactgtcagagaggttcaaataatgtggcagaaagaggtcagtgtttgtttattcttctttgctaccatatctgtaccctgaggcacatttatattgtgtatagtaccttaggcagtagaaagtcccatattaaccttccccagagcagtgagcacccagttatagttgaccccttgaatgatccattttccataataatgagaatctcccaagctacttgcatctcttcctcaagatttaaaaatattttcaaattctacctcactggaagatattgaagagatttctcaggatctcaagtaggttagttggacttagagccaaaccttgtcaatgactcatcactgtccatgtgtaaaagtagagctttgtgcttgcttaggcagcacatatcctaaaattggaacaatacaaagaaaattagcatggtgcctgcataaggaggctgaaccaatttttgaaggattccaagttttgtgcagtcactggaaggtcatttgactattttctgactagctccaaggaaatggtgtgaatcaaagcaaaatgggtgccacctaaatattgaaattgtgattttttgctacaaaaatattcatgtaaggtggtctaagagatgaccccagagctgaataatgtgtggggtgttgtgtgaaaaatatattgccagcatgtgacttgaaaattcaagaaggtcaacttacaacttcttcatggaacctaaaaaaaaaaaaaaaaaagtagggttttagtctcccatgtcagctggagatgagcagggagatgaagcatcatcctaacaaacatctgctggtttagagtttgagtctgtagagaaggatcattggtccaagccaggtgttgacatccagtggattttctgcccttgttgtgattggtaaactccgtaatagtgggcaatcatgttttctactttaatgagatatttatgaataaatttagttacaaactatgaaatagttgagattccttgaattataagccataaagagtaggacaactaataaggaaaattaggacttaacatttcctgaaaattacaacatttgcatattagggcctatgaacaaaatatacattgggttttatttgggattctgagataatttcagtataaagtttaggaatagattatttcattgctttactatttttctgagcatttagaaaatgttatattgttaagtctttgtaacaacctagtgaaataacaacctagtgaaataaggcagcaaagtccccactttgtagaaataacaacctagtgaaataaagcagcaaagtcctcactttgtagaagaagacattgagcctaagagaagtaacttgtccaagaacaagttgagcacttaggcataggtatggatcagctgttcattatggagctaggccttatgcagagttgggacactttctattgtgtcaagctaatgcaagttagtttattgagtcataatgcccttgatttatgagtatttcaccttacttttttcttctttaattagaagcttaatgagaggtttgtagaatgtacacagaactgtatgggataatattgttaagttctgatattctgatactgtttgaaatactcaaagaatttttgcatttggtaagcatttttatatcagtattaaaatagtaattttatttattacatttttatacatagaatttgccaattactttctgactacaaagaaaaccagatgccaaacaactcttctggaaatagcaatccaggtaagacttctgatagtgaattactttaggtcagttgtccccaaccttttcgccttcttggcagcagggaccagttttgtggaagacaatttttgcatggactaggtgaaggtgtggatggtttcagaattattcaagcacattacatttattatgctactttatttatattattattaccttataatatataatgaaataattatacaacttaccataatgtagaatcagtggaaactctgagcttgttttcctgcaactagatgtcccatctgggggcaaagggagacagtgacagatcatcaggcattacattctgataagaagcacacaacctagatccctcacatgggcagttcacaacagggttcatgctccaatgagtatctaatgcaaccactgatctgacaggaggtggagagcaggcagtaatatgagtcatggggtgtggctgtaaatagagatgaagcttccctggcttgcttgcttctcaccttctactctgtggcatggttcctaacaagccatggactggtaccagtccatggcctgggagttgtggatgcttgatctgggtggtcctatcacagataaaaaggtaaaagtaaggaagttttgatcacaaaagaagagcgaagcacaggttatgtttcatatgcttgtaccaacaaagtctcactattactgacttcattcctcctaatttgaaattgaaagagatagatttactttgttggaacaagatgtattcttctacctgctggttaattgtcatgataaacagtaattttgttagaacaagatgctttgctgccagtcgccaaaagattgtcataataaatacacaaattgcccaattctaggctcagcagattataataaaagtacaaaaatgtttcacagtaagaaaaatgctagtatgctacctggatgtggacacctaacgcatcgtacaatccagactctataaggacatctttaatttagccctatgtttatcaaagagcttctgtaagttagattgtgtacattgcaagagacaaagatggaatagatgtagttctgatctttaaggtgctcataatagaatacagctgcctctatttcatttctctgccttttcaacagaatttacaaagaaaatatttttatgttttcacttgtccacttaacaaataactataaaatgtcttttaggtactaagcatttttctaatgctagagaacagaaacaattaaaaatacagacaggagtttgtcattatcattgtcatttttattatgttcctaccttattcagtgcttactgtgtgctagatgcccactggaagtttataattatgatttattgtatattatattgattatgtgccagacatacgtgatgaggaatgaaagctttaaaaaaaagtaggtaggatttaaggtaagcatgcagagtgagtagaatttttctacgtaaagaagtagaagaatgatgtttggcagaaggaacatgtaatgagattgcctgttgggaggaagagcagcaagtgcaaaagacaagatgcttaagcgaactttgtagggtttatgagcagttcacttttgctagtacaactagtgtgagataagagaggttgggaatgaggtgaatatttagctaaggcaagtttatgatagactttttaatactgttgaaatgagtaggtcttattctggggaccacgggaaatttaccttcgatatcttccagtgaggtatttgctttggactgcaaatactagatgagcagtggctaaaacagtaggaaccagagttgttttggttgttcagtgatatactaggttccccttgtccctctttcagctgtgcttcatgtctcctttcatggttggctaatccacaacagttccaaacatcttgttctcacaacacaacatcacaagggctgcttttcttcacacatgtcttttaaatagggagaaaccttagaagcatgcagtggacttcctgtaacatattattggctaggtcacaacatatgcttatccctaaaccaggcactggaagagcaaatgtaagtatgtgattagcttagaataatcatttctctttctgaagctgaggagggggattggaatactgtctcagaagacttgtgtttcttctgcaagaaagaataaggaataagaaagaataagggagccagcaatgtttgctgcagggactcattggagaaatttgagcaggggagtcacaagattaaattagagtattaaggccttttggtaatgttgtaaaacaggggttggcaagctttttctgtaaatgaccaggtggggaatgttttagactatgtggtctctgtcatatctacttaaccctgctgttgtgtgagagcaactatggataatatgtaagcaaataggaatgagtgagctccaataaaatgttattttttttttcacttttggcatttttaataggatttttaggcataacatcttacataaccacacagaaactgtttctggtctttttttattattatactttaagttttagggtacatgtgcacattgtgcaggttagttacatatgtatacatgtgccatgctggtgagctgcacccactaactcgtcatctagtattatgtatatctcccaatgctatcactccccactcctcccaccccacaacagttcccagagtgtgatattccccttcctgtgtccatgtgatctcattgttcaattcccacctatgagtgagaatatgtggtgtttggttttttgttcttgtgatagtttactgagaatgatgatttccaatttcatccatgtccctacaaaggacatgaactcatcattatttatggctgcatagtattccatggtgtatatgtgccacattttcttaatccagtctatcattgttggatatttgggttggttccaagtctttgctattgtgaataatgcctcgataaacatacgtgtgaatgtgtctttatagcagcatgatttatagtcctttgggtacatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcactttttcatgtgttttttggctgcataaatgttttcttctgagaagcgtcttttcatctcctttgcccactttttgatgaggttgtttgtttttttcttgtaaatttgtttgagttcattgtagattctggatattagccctttgtcagatgagtaggttgtgaaaattttctcccattttgtaggttgcctgttcaatctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacctttaagtctttaatccatcttgaattgatttttgtataatgtgtaaggaagggacccagtttcagctttctccatatggctagccagttttcacagcaccatttattaaatagggaatcctttccccattgcttgtttttgtcaggtttgtcaaagatcagatagttgtagatatgcggtgttatttctgagggctctgttctgttccattgatctatatctctgttttactaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggcagcttgatggggatggcattgaatctgtaaattaccttgggcagtatggccattttcacgatattgattcttcctacccatgagcatggaatgttcttccatttgtttgtatcctcttttatttccttgagcagtggtttgtagttctcctggaagaggtccttcacatcccttgtaagttggattcctaggtattttattctctttgaagcaattgtgaatgggagttcactgatgatttggctctctgtttgtctgttgttggtgtataagaatgcttgtggtttttgtacattgattttgcatcctgagactttgctggagttgcttatcagcttaaggagattttgggctgagacgatggggttttctagatatacaatcatgtcgtctgcaaacagggacaatttgatttcctcttttcctaattgaataccctttatttccttctcctgcctaattgccctggccagaacttccaacactatgttgaatagaagtggtgaaagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaaggttgttgaactttgtcaaaggctttttctgcatctattgagataatgatgtggtttttgtctttggttctgtttatatgctggattacatttattcatttgcgtatattgaaccagccttgcatcccagggatgaagcccacttgatcatggtggataagctttttgatgttctgctggattcgttttgccagtattttattgaggatttttgcatcagtgttcatcaaggatattggtctaaaattctccttttttgttgtgtctctgcccggctttggtatcagaatgatgctggcctcataaaatgagttatggaggattccctctttttctgttgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggaccggtggtgatatcccctttatcattttttattgcatctatttgattcttctctctttttttctttattagtcttgctagcagtctatcaattttgttgatcctttcaaaaaaaccagctcctgggttcattaattttttgaagggttttttgtgtctctatttccttcagttctgctctgattttagttatttcttgccttctgctagtttttgaatgtgtttgctcttgcttttctagttcttttaattgtgatgttagggtgtcaattttcaatctttcctgctttctcttgtgggcatttagtgctataaatttccctctacacactgctttgaatgcatcccggagattctggtatgttgtgtctttgttctcgttggtttcaaagaacatctttatttctgccttcatttagttatgtacccagtagtcattcaggagcaggttgttcagtttccatgtagttgagcggtttagagtgagattcttaatcctgagttctagtttgattgcactgtggtctgagagatagtttgttataatttctgttcttttacatttgctgaggagagctttacttccaagtaggtggtcaattttggaataggtgtggtgtggtgctgaagaaaatgtatattctgttgatttagggtggagagttctgtagatgtctattaggtctgcttggtgcagagctgagttcaattcctgggtatccttgttaactttctgtctcattgatctgtctaatgttgacagtggggtgttaaagtctcccattattaatgtgtgggagtctaagtttctttgtaggtcactcagaacttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggatcacaacccctgcctttttttattttccatttgcttggtagatcttcctccatccttttattttgagcctatgtgtgtctctgcatgtgagatggttttcccgaatacagcacacactcgactctttatccaatttgccagtctgtgtcttttaattggaccatttagtccatttacatttaaagttaatattgttatgtgtgaatttgatcctgtcattatgatgttagctggttattttgctcgttagttcatgcaatttcttcctagtctcgatggtctttacattttggcatgatttttcagcggctggtacccgttgttcctttccatgtttagcacttccttcaggagctcttttagggcaggcctggtggtgacaaaatctctcagcatttgcttgtctgtaaagtattttatttctcctttgcttatgaagcttagtttggctggatatgaaattctgggttgaaaattcttttcttgaagaatgttgaatattggcccccactctcttctggcttgtagagtttctgctgagagatccgctgttagtctgatgggcttccctttgagggtaatccgacctttctctctggctgcccttaacattttttccttcatttcaactttggtgaatctcacaattatgtgtcttggagttgctcttctcgaggagtatctttgtggcattttctgtatttcctgaatctgaaagttggcctgccttgctagatggggaaagttctcctgggtaatatcctgcagagtgttttccaacttggttccattctccccgtcagtttcaggtacaccaatcagacgtagatttggtcttttcacatagtcccatatttcttggaggctttgctcatttctttttattcttttttctctaaacttcccttctcgcttcatttcattcatttcattttccatcattgataccctttcttccagttgatcacatcggcccctgaggcttctgcattcttcacgtagttctcgagccttggttttcagctccatcacctcctttaagcacttctctgtattggttattctaattatacattcttctaaatttttttcgaagttttcaacttctttgcctttggtttgaatgtcctcctgcagctcagagtaatttgatcgtctgaagccttcttctctcagcttgtcaaagtcattctccatccagctttgttccgttgctggtgaggaactgcgttcctttggaggaggagagatgctctgctttttagagtttccagtttttctgttctgtttttttccccatctttgtggttttatctacttttggtctttgatgatggtgacgtacagatgggtttttggtgtggatgtcctttctgtttgttagttttccttctaacagacaggaccctcagctgcaggtctgttggaataccctgccgtgtgagatgtcagtgtgcccctgctggggggtgcctcctagttaggctgctcggggtcaggggtcagggacccacttgaggaggcagtctgcccgttctcagatctccagctacgtgctgggagaaccactgctctcttcaaagctgtcagacagggacatttaagtctgcagaggttactgctgtctttttgtttgtctgtgccctgcccccagaggtggagcctatagaggcaggcaggcctccttgagctgtggtgggctccaccgagttcaagcttcctggctgctttgtttagctaagcaagcctgggcaatggcgggcgcccgttgcccagccttgctgccgccttgcagtttgatctcacactgctgtgctagcaatcagcgagactctgtgggcgtaggaccctctgagccaggtgcgggatataatctcgtggtgcgccgttttttaagcaggtcagaaaagcgcagtattcgggtgggagtgacccgattttccaggtgcgtccgtcacccctttctttgactcagaaaaggaactccctgaccccttgtgcttcccaagtgaggcaatgcctcaccccgctttggctcacacacggtgcacgcacccactgacctgcgcccactgtctggcacttccaagtgagatgaacccagtacctcagatggaaatgcagaaatcacccatcttctgcgttgctcacgctgggtgctgtagaccggagttcaataaaatgttatttagaaaaccataagggagactggatttggcctgtggcctatagttttctgacccctcatagaggattgatggaaggtaaccatgtaaagaaaccaggagacaaaggaagatttgctgtagtcagctacagtttccttgtcacatgtccttggactagtatcaatttattataaggttttcacccatccatcgtgaaataaataaagttaggaatctcagttattcattttaaaatgttggcctttttttggtgttatgcctttttcatttgttttgttttaattttttttcatgtaagaaataacattaacagctgggttttttaaaaaaataaaagccactttgtaaatgtttatgttcccagtggcagtgggaatataaaatggaagcagaagagaggtatagtcaatatgatttagtgactgttgaatgagaaaatttaggggacagagagaaatcccagatgattcacaggtttccaggttgtacagtattatttaacctgaacatgaggaaggagtaggaaattttctggtgaatacagaagagcaaagaagagcagctcaagaggaatgactaattatttttctgtgcatgtttaatgggatattcatataggatttttgaatagatcattgaatatcagcatttatagctggcatcctactagtttgactctcagtaataagacttgtcaaagatccaagaatctgaaagttgatgataaatttccatgtgtatcaccatcaatgactgaaagtcagcatccacagaattgggagagatgaacttaatagataaagatgaattggagttgtgtttctcttagagaatgatactctccatgacttgtgtgagtcacagctgccagaaaacaaagaggccaaggaacatattaaagaagcacagcaaattcagtcctagagtgcctctgcttggcttcgtgttatagttctgacttctaaaaaatcactttttggcaaaatatactttgtgtttcttcccctcttgcaaactgcaaccaaacagaatcctttttagcaaggcatttttgtgttctttgaccaaagcaacatataaataacaaaaagaagtaagagaaagaacttttttttgtgtgtataggctagtatttaacataaacttgagagtgagtgccagtattatatttaggatttagggactagataggaaaactggatagaaatctaaagattgctgactcaaacacaatgtggtttctttgctttattttcacagctctgaattcacaactattagttatatttatatgcactataactttagaaagcaccttcccaaaccaaattttatgtgatttcttataatttagatgactttattatagaattgaatttccaactgttcataagaattattgagcatttgctgcatagtatcatctcagctgtgtccacatgagctacctatcaccttgtgttaatgaataatggttcaccaggaatattggttttggcatttaaagtgatctgtatttaatgcagataggaccagggaccactcttgaacattaatgtccaagcatcttaaaattacacagaatgctttcataatcagaattctgcctcactctccatctttagcccttttccccatgtgccctttctctggcattactgaactgcctgcaatgccctactcactcatccttctcttgtaggcaaatacattcactctttcacaccttactccctctcttgctgcttcctggcatactgccaacctttcctgccctctaccccttgtaatctggctagcctcaatatttaagtctctgcttggccatgatttctagaaaaccatccctgacatgctttattttcattctttttaaatcctaatgcctactatgtatgtagcaggactcagtaaaaaattgctgagtaaaataaagaatgtttatacaaaggtgatatgcaagactgtcccctacagtcttggagccgaggggacagacatgtggagcaataacgtacatttgagatggtaaagatgcagtagaaaaataagtaaagtattaaggcagcctcaaggaaggaggtacctgtttatctggggaaagacatgcagaatcaaggaagacttcacatagcattgttttaaaagatgaaaaaaattgtcagaatagtggagggaaacatttaaatattaggaagacattgtacactaataaaggtgtcagcagtgattttggaaatcatttacaaggcactattaggaagtggagaacagtatactgtgttaccttatatgtttctgccgtattttaatattgtgttcctggtggttttgttcatttacgttgggtggatgaatttgtgagtgaatgtttgacatgtttgtatgtcctcaatctggtggactctggtatctccccaagtggtttgttgaagttttggagaattattacttaagtaactatttcatgaaagattaagcttcatttaagcgctcaatttatgaaatgaaatgtcttaaatctatttttataaaaacaatagttttaaattgttctaagtggttcattttaaccaaatatatggatttcacttcagaacaagacttaaagctgacatcagaggaagagccacaaaggcttaaaggaagtgaaaatagtcagcatgaggcatgtaaaattttaaatttaaatttctggtttaatgttcttttctttgctttgataatagtagatagtccaaatgaaattacctttcagactaggctttgataatcaataaattttttaaaataattttttaatagattcttaaagtttattttaatagatttagtgaccttattaacagaagaatcaatagaatctaatttaatatttgatatttaacttaaagattataacccactataaaatttaaaatattcttatttaaaatattcttatctgccttcttgattggcttatagctaatctttccctttggaatagaggcaaaacaaatccagaactttatttgttcttttatttttacaacatccttacatgataaagaaagtaacatcaattattggatcatattatcaagcaattgaaattatgaacaatgtagcagtgatggtccctgagctggattcatggcaaaggagtaatcatggccagtgattgaaaatctgcggttttatattgccagtcagtgatgccaaggttaaagatgaattctacctgtggtctctcactgacctcagggtttctgttcagggagagaaccaggtcttaaaagcaacccaactgcctattacaataatcatatcttgcagaatgagacctttgttgttagtgtacaaacacagtaacattttaacatttcagttgcagaacatcagtacatattatttaaaaatttttatcctctgtcattagtacacattagaatatattagaactggacttaagccgatagtctagatacataacatgatcgtattatagtacataatttcaattaaaatgtaacaatttgcatttctttctgtttggtgttgattttggctcctaataatttaaagtgtgcctacactccagttagtaatcttttaaaaaaccacctaaatgcactgtaggggctcactacttaaggtatggtgaagtaaaatcttttcaagtgagaaaaaccctacaaattacctgctaattcattttggtagatttaacacataatgaattaagtttaatccaaacaaaaggtgacaaagttaagttttccagttcatgtttttcttctttctttggctaaggtgaatttttttatgttttagtcagaagccagtgatgtggcagtagctaaacatagaataaaatgttaattcttcattttagttatttaattattatttctttaattattttaacaggtaaattttaattttaattattttctaattttttattgtccatacttgattacttaagaataaaattattttaaaaacatgtactccaaaagagcagacatctgagaaacacaacaagcaaattaaccttctataattgcatctgcagaaagtgactcaagaaccagacataaataaggattgcgatagagaggtatacctttatattcaaatgtttccgttgaattagatttttacattatgttgtttaacaaagtataataagtttaggcatgtatgattctatcatgtaagtagcataaatcatcagtgaaaaatttagtatgtaactcagaaagctgagttgtgtacattaagttttaaagagagacaaaccctagaaatattcttcattattatggaataatcctgaatggtgccaaaaatgctacgtaatgctactttaggagctttggatcaatcattttatctttcttggtattagtctgattatcaatagataatatggctaaagaagataatttgttattctgtatatcctctagctagaaagttttatggccactgaatgtgaaatttggggagcgtctcatttactggaattccatgctagcacctcagcagttttattctgctttttgtgttgtgggaaactttggttcccatgtttcagtgagcactttcatgtttttgatatcccagcaaccatatgaaaaagcaatgatcacaggcagtgggggagaagaatattttagtgcaggaaagggaaatcttcctttctattcctggagcccgacagtgtctcatcctctaaatctgactgcttaatggaaaatccaggttgtaaagatggaagaagacacattttgcatctttgtgtttttatttgtgtgttcccacaagtcaaatggggtgaatatttatattagattctgaagagtggttgggaataaaagcacaaaatgaaattttgaaattttggaaattttgaaattttggaaaattgttctattcattcaaagagaaataaagcaaactttacaaaaattttaatgatatactaatgatgtaataattacatcttaaaattatatggtaacagttctgtatatatgatcaaatttaagtgtgaaatatttttaatgacaaattatgacaaactgagtcaaatgataaaatcaattaaaacaaaaaggtactttttattcaataaagcaataactgtccttaatatcaaacttccactcaaggttgaagaagaaatgcagaagcatggaagtaataatgtgggattatcagaaaacctgactgatggtgctgctgctggcaatggtgatggtggattagttccacaaagaaagagcagaaagcatgaaaatcagcaatttcctaacacagagattgaagagtatcacaggtaagcctatggcaacatttaacaggagataactatgtgctatcaaactaatccgaatttggactaatattcatgatgaaaaaattttatacttttcctaggatattcagccttgcctggtaatcagaagaatgaaaatcagcaaacaatgagttatattttttccagtcattaatttatttgaaaaataaccagtgttggcaaatgtgagggaaaaagcattttcttttctttttagtgaacttttattttagcttcaggggtacacgtgcaggtttgttacataggtaaactgtatcatggagattggggttacagattatttcatcagtcagataataagaatgatacccaataggtagttttttggtcctctccctcctgccatgctccaccctcaagtaggccgcagttgtctgttgttctcctctttgtgtccatgagttctcattgtttggttctgacaaatgagtgagaatatgtggcatttgattttctgttcctgcattagtttgcttaggataatgacctccagctccatctgtgttgctgcagaggaaatggactcactgaaaaggatattttcatacactgttggtaaatacattttgagtgttaatttagtagcatattcacacacacacatatataacagtaaggatataaaatatatgtatgttatggatatttgtatagatatattacatatatacttatgtataaggacatttattatagcataattatatcaaaaagttggagctagtccaaatccttatcaataggaaatagctcagaaaataatatagtatgcaatcagttttttaaaatgaagttagatctagagtgtactgattatttcacaattaacatgtatttaaagcatttagtttgctgacccatcttaagacaattttgttagaattcttgtagtatctgctgtgttgcaaatggaagctacatgctatgttgacactgtaccttgttagcaacaatatcgctagttattaaattatggttgtcagtgcctgagtgctgaaataattggaccctcaactgaacattgccaaaggattgcacatggggatctgtattttatgtaaatatttcagtatattggataaaacttgtttaaatacatcaaaggatctttgatctactaaaacaggaattggccagcttttttctgtaaagagccagttggtaaatattttaatctttgtggactatatgtacttatttttttgagacaggttctcactctgttgcccaggctggagtgcatttgcgtgatcatggctcactgcagcctcaactttctgggctctagtgatcctcccacctcagtctctctactagctgggaccacaggtgtgcaatatcacacccagatgattgactctatggactataaagtaaataagcatggctgtgtttcaagataccttacttaaaaaaacaggcagtgggctggagtgggcccacaagtgttaatttgctgacccttgtgctaaaaggaaggtgttgctaatgcagtgaatcttatttgtaagtgtcctgcatgcatgacattatccttcctttgaaaaaagaatatatttcagtattcacctcaccatagttttcaagtgacttcatataatttttatattgatgtaattcatgtaattatacttcataaaatttttaaaatttcatttataaaataagattattttctgcatttctcctattttattcctgttaataggactcagtattttactgtgatcaattactttgtatatgtgatgagtatcaactgtcctagatttcactgatttttatcaagcaagaaatactcctcttgaaacttttagtattccttggtctttatttttattcatttatttttattttattttattattattatactttaagttttagggtacatgtgcacaatgtgcaggttagttacatatgtatacatgtgccatgctggtgtgctgcacacattaactcatcatttagcattaggtatatctcctaatgctatccctctcccttccccccaccccacaacagtccccagagtgtgatgttccccttcctgtgtccatgtgttctcattgttcaattcccacctatgagtgagaatatgcagtgtttggctttttgttcttgcgatagtttactgagaatgatgatttccaatttcatccatgtccctacaaaggacatgaaatcatccttttttatggctgcatagtattccatggtgtatatgtgccacattttcttaatccagtccatcattgttggacatttgggttggtttcaagtctttgctattgtgaatagtgccgcaataaacatacgtgtgcatgtgtctttatagcagcatgatttataatcctttgtgtatatacccagtaatgggatggctgggtcaaatggtatttctagttctagatccctgaggaatcaccatactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgaacattttttcatgttttttggctgcataaatgtcttcttttgagaagtgtctgttcatgtcttttgcccactttttgatggggctgtttgtttttttcttgtaaatttgtttgagttcattgtagattgtggatattagccctttgtcagatgagtaggttgtgaaaattttctcccattttgtaggttgcctgttcactctgatggtagtttcttttgctgtgcaggagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatgtggctagccagttttcccagcaccatttattaaatagggaatcctttccctatttcttttttttgtcaggtttgtcaaagatcagacagttgtaggtatgcagcattatttctgagggctctgttctgttccattgatctatatctctgttttggtaccagtagcaggcttaggattgacttggcgatgcgggctcttttttggttccatatgaactttaaagtagttttttccaattctgtgaagaaagtcattggtagcttgatggggatggcattgaatctaaaaattaccttgggctgtatggccatttttatgatattgattcttcctacccatgagcatggaatgttcttccatttctttgtatcctcttctatttcattgagcagtggtttgtagctctcctcgaagagttcctttacgtcccttgtaagttggattcctaggtattttattctctttgaagcaattgtgaatgggagttcactcatgatttggctctctgtttgtctgttattggtgtatgagaatgcttgtgatttttgtacattgattttgtatcctgagactttgctgaagttgcttatcagcttaaggagattttgggctgagacaatggggttttctagatatacaaacatgtcatctgcaaacagggacaatttgacttcctcttttcctaattgagtaccctttatttccttctccggcctaattgccctggccagaacttccaacactatgttgaataggagtggtgagagagggcatccctgtctcgtgccagttttcagagggaatgcttccagtttttgcccattcatatgatatttgctgtgggtttttcatagatagctcttattattttgagatacatcctatcaatacctaatttattgggagtttttggcatgaagggttgttgaattttgtcaaaggccttttctgcatctattgagataatgatgtggtttttgtctttggttctgtttatatgctggattacatttattgatttgcgtgtattgaaccagccttgcatcccagggatgaagcccacttgagcatgttggataagctttttgatatgctgctggattcggtttgccagtattttgttgaggatttttgcatcaatgctcatcaaggatattggtctaaaattctctttttttgttgtgtctctgcccggctttggtatcaggatgatgctggcctcataaaatgagttatggaggattccctctttttctattgattggaataatttcagaaggaatggtaccagttcctccttgtacctctggtagaattcggctgtgaatccatctggtcctggacttttttttgttggtaagctgttgattagtgccacaaattcagagactgttattggtctattcagagattcaacttcttcctggtttagtgttgggaaggtatatgtgtcaaggaatttatccatttttctagattttctagtttatttgcgtagaggtgtttgtagtattctctgatggtagtttgtatttctgggggatcagtggtgatatcccctttatcattttttattgcatctatttgattcttctctcttttcttctttaatagtcttgttagcggtctatcaattttgttgatcctttcaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttaggttgtcaattttggatctttcctgctttctcttgtggaaattttgtgctataaatttccctctacacactgctttgaatgcgtcccagagattctggtatgttgtgtctttgttctcgttggtttcaaagaacatctttatttctgccttcatttctttatgtacccagtagtcattcagaagcaggttgttcagtttccatgtacttgagcggttttgagtgagtttcttaatcctgagttctggtttgattgcactgtggtctgacagacagtttgttataatttctgatcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtctcattgatctgtctaatattgacagtggggtgttaaagtctcccattattattgtgtgggagtctatgtctctttgtaggtcactcaggacttgctttatgaatctgggtgctcctgtattgggtgcatatatatttaggatagttagctcttcctgttgaattgatccctttaccattaagtaatggccttctttgtctcttttgatctttgttggtttaaagtctgttttatctgagactaggattgcaacccctgcttttttttgtttttcatttgcttggtagatcttcctccatccctttattttgagcttatgtgtgtctctgcacatgagatggttttcccgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattatttgatgcagtttcttcctagtctcgatggtctttacattttggcatgattttgcagcggctggtacccgttgttcctttccatgtgtagtgcttccttcaggagctcctttagggcaggcctggtggtgacaaaatctctcagcatttgcttgtctgtaaagtattttatttctcctttgcttatgaagcttattttggctggatatgaaattctgggttgaaaattcttttcttcaagaatgttgaatattggcccccactctcttctggcttgtagagtttctgctgagtctcatgggcttccctttgagggtaacccgacctttctctctggctgcccttaacatttttttcttcatttcaactttggtgaatctgacaattatgtgtcttggagttgctcttctcgaggagtatctttgtggcgttttctgtatttcctgaatgtgaatgttggcctgccttgctagatgggggaagttctcctgcataatatcctgcagagtgttttccaacttggttccattctccccgtcactttcaggtacaccaatcagacatagatttggtcttttcacatagtcccatatttcttggaggctttgttcatttctttttattcttttttctctaaacttcccttctcacttcatttcattcatttcattttccatcattgataccctttcttccagttgactgcatcggctcctgaggcttctgcattcttcaggtagttctcgagtcttggctttcagctccatcagctcctttaagtacttctctggattgattattctagttatccattcatgtaaatttttttcagagttttcaacttctttgcctttggtttgaatttcctcccatagcttggagtagtttgatcatctgaagacttcttctctcaactcgtcaaagtcattctccatccagctttgttccattgctgttaaggaactgtgttcctttagaggaggagaggtgttctgctttttagagtttccagtttttctgctctgttttttccccatgtttgtggttttatctccttttggtctttgatgatggtgatgtacagatgggtttttggtgtggatgtcctctctgtttgttagttttccttctaacagacaggaccctcagctgcaggtctgttggagtttgctagaggtccactccagaccctatttgtttgtgtatcagcagcggtggctgcagaacagcagatttttgtgaactgcgaatgctgctgtctgatagttcctctggaagttttgtctcagaggagtacccggccgtgtgaggtgtcagtctgcccctactggggggtgcctcccagttaggctgctcaggggtcggggtcagggacccacttgaggaggcagtctgcccgttgtcaaatctccagctgcatgctgggaggaccaatgctctcttcaaagctgtcagacaggtacatttaagtctgcagaggttactgctgtctttttgtttgtctgttccctgcccccagaggtggagcctacagaggcaggcaggcctccttgagctgtggtgggctccacgcagttcgagcttcctggctgctttgtttatgtaagcaagcctgggcaatggtgggtgcccttcccccagcctcactgccaccttgcagtttgatctcagactgctgtgctagcaatcagcgagactctgtgggtgtaggaccctccgagccaggtgggggagataatctcctggagcaccgttttttaagccccttggaaaagcgcagtattcgggtgggagtgacccgattttcttggtgtcgtctgtcacccctttctttgactaggaaaaggaactccttgaccccttttgcttcccaagtgaggcaatgcctcaccctgcttcggctcacacatgttgtgctgcacccactgtcctgcgcccagtgtctggcactctctagttagatgaacctggtaccgcagatggaaatgcagaaatcacccgtcttctgtgtcactcatgctgggagctgtagaccggcgctgttcctacttggccatcttggcctgggacccccttggtctttatttataagcatgaacaaaatgataatcagcttatataatccagaaatgttcacggggtcttttagttgtataatttttttattattatactttaagttctagggtacatgttcacaacatgcaggtttgttacatgggttatacatgtgccatgttggtttgctgcccacattaactcatcatttacattaggcatttctcctaaggctatccctccccctgggccccacactctgacaggccccagggtgtgatgttccccatggtgtgtccaaatgttctcattgttcaattcccacctgtgagtgagaacgtgcggtgtttggttttttgtccttgtgatagtttactgagaatgatggtttccagcttcatccatgtccctgcaaaggacatgaactcatcctttttcatggttgcatagtattccatggtgtacatgtgccacattttcttaattcagtctatcattgatggatatttggattggttccaagtctctgctattgtgagtagtgccccaataaacatatgtgtgcatgtgtctttatagcagcatgatttataatcctttggatatatacccagtaatgggatgactgagtcaaatggtatttctagttttagatccttgaggaatcaccacactgtcttcgacgtggttgaactagtttacactcccatccacagtataaaagtgttcctatttctccacatcctctccagcacctgttgttccctgacttttaaatgatcaccattctaactggtgtgagatggtatctcattgtggttttaatttgcatttctctgatgaccagtgatagcattttttcatgtgtctgttggctgcataaatgtcttcttttgagaagtgtctgttcatatccttcagccaattgttgatgtgattgttagtttttttcttgtaaatttgtttgagttctttgtagattcttgatattagccttttgtcagatgggtagattgcaaaaattttctcccattctgtaggttgcctgttcactctgatggtagtttcttttactgtgcagaagctcttcagtttaactagatcccatttttcaattttggcttttgttgccattgcttttggtgttttagtcatgaagttgttgcctatgcctacatcctgagtagtattgcctaggttttcttctacgatttttatagttttaggtctaacatttaagtctttaatcaattttgaattaatttttgtataaagtctaaggaagggatccagtttcagctttctacataagctagccagttttctcagcaccatttattaaatagggaatcctttccccgtttcttgtgtttttttttttttttttgagagggagtctcgatctatcacccaggctggagtgcagtggcgtgatctcggctcactgcaacctctgcctcctgggttcacatgactctcctgccttagcctcccaagtagctgggactacaggcgcttgccactacgcccggctaattttttgtattttttagtagagatggggtttcaccatgttagccaggatggtctcaatctcctgacctcgtgatctgcgcaacttggcctccgaaagtgctgggattacagacaagagccaccacacctggccccccatttcttgtttttgccaggtttgtcaaagatcagatagttgtagatgtgtggtattatttatgagggctctgttctgttccattggtctgtatctttgtttggtaccagtaccatgctgttttggttactgtagccttgtagtatagtttgaagttaggtagcatgatgcttccagctttgttcttttggctgaggattgacttggcaatgcaggctcttttttggttccatatgaactttaaagtagtttttccagttctgtgaagaaaatcattggtagcttggtggggatggcattgaatctataaattaccttgggcagtatggccattttcacgatattgattcttcctatccatgagcatggaatgttcttccatttgtttgtatcctcttttatttcattgagcagtggtttgtagttctcctcgaagagttcctttacgtcccttgtaagttggattcctaggtattttattctctttgaagcaattgtgaatgggagttcactcatgatttggttctccgtttgcctgttattggtgtataagaatgcttgtgatttttgcgcattgattttgtatcctgagactttgctgaagttgcttatcagcttaaggagattttgggctgagacgatggggttttctagacatacagtcatgtcatcttcaaacagggacaatttgactttctcttttcctaattgaatgccttttatttccttctcctgcctgattgccctggccagaacttccaacactacgttgaataggagtggtgagagagggcatccctgtcttgtgccagttttcaaagggaatgcttccagtttttgcccattcagtatgatattggctgtggatttgtcataaatagctcttattattttgaaatacatcctatcaatacctaatttattgagagtttttagcatgaagggctgttgaatgttgtcgaaggccctttctgcatctattgagttaatcatgtggtttttgtctttggttctgtttatatgctggattacatttattgatttgcatatgttgagccagccttgcatcccagggatgaagcccacttgagcatggtggataagctttttgatgtgttgctgcattcggtttgccagtattttattgaggattttgcatcgatgttcatcaaggatattggtctaaaattctctgtttttgttgtgtctgtggcaggctttggtatcaggatgatgctgacctcataaaatgagttagggaggattccctctttttctattgtttggaatagtttcagaaggaatggtgccagctccttcttgtacctctagtagaatttggctgtgaatctatctggtctttgactttttttggtttgaaagctattaattattgcctcaatttcagagcctattattggtctattcagagattcaacttcttcctggtttagacttgggagggtatatgtgtccaggaatttatcaatttcttctagattttctagtttacttgcatagagatgtttataatattctctgatggtagtttgtatttctgtgggatcggtggtgatatcccctttatcattttttattgcatctatttgattcttctctcttttcttctgtattattcttgcttgcagtctatcaattttgttgatcttttcaaaaaaccagctcctggattctttgattttttgaagggctttttatgtttctatctccttcagttctgctctgaccttagctatttcttgccttctgttagcttttgaatttgtttgctcttgcctctctagatcttttaattgtagtgttagggtgtcagttttagatctttcctgctttctcttgtgggtacttagtgctataaatttccctctatacactgctttaaatgtgtcccagatattttggtacatcatgtctttgttctcattggtttcaaagaatatctttatttcagccttcatttcattatttatccagtagttatttgggagcaggttgttcagtttccatgtagttaagtggttttgagtgagtttctttatcccgagtcctaatttgattgcactgtggtctgagagaccgtttgttgtgatttctgttcttttacatttgctgaggagtgctttacttacaactatgtggtcaattttggaaaaagtgcaatgtggtgctgagaatgtatattctgttgagttggggtggagagttctgtagatgtctattaggtctgcttggtgcagagctgagttcaagtcctagatatcctttttaaacttctgtcttgttgagctttctaatattgacagtggggtgttaaattctcccattattattgtgtgggattctaagtctctttgtaggcctttgaggacttggtttatgaatctgggtgctcctgtattgggtgtatatatatttaggatagttagctcttcttgttgaattgatccctttaccattaggtaatggccttctttgtctcttttgagctttgttgatttaaagtctgttttatcagagagtagaattgcaacctctgcttttttttcctttccatttgcttggtagatcttcctccatccctttattttgagcctatgtgtgtctctgaatgtgagatgggtctcctgaatagagcacactgatgggtcttgaatctttatccaatttgccagtctgtgtcttttaattggagcatttagcccattacatttaagattggtattgttttgtgtgaatttgattctgtcattatgatgttagctggttattttgcccgttagttgatgcagtttcttcctggcatctatgatctttacaatttggcatgtttttgcagtggctggtactggttgttactttccatgtttagtgcttcattcaggagctcttgtaaggcaggcctggtggtgacaaaatctctcagcatttgcttgcctgtaaagtgttttatttctccttcacttatgaagcttagtttggctggatatgaaattctgggttgaaaatttttttctttaagaatgttgataccttacatctacaaccatctgatctttgacaagcctggtaaaaacaagaaatggggaaaggattccctgtttaataagtggtgctggaaaaactggctatccatatgtagaaagctgaaactggatcccttctttacaccttatactaaaattacttcaagatggattaaagacttacatgttaaatctgaaactttaaaaaccccagaagaaaacctaggcaataccattcaggacataggcatggataaggacttcatgtttaaacaccaaaggcaatggcaacaaaaaccaaaattgacaaatgggatctaattaaactaaagagcttctgcacagcaaaagaaactaccatgagacttaacaggcaacctacagaatgggagaaaatttttgcaatccactcttttgacaaagggctaatattcagaatctacaaagaactcaaacaaatttacaagaaaaaaacaaccccatcaacaaatgggcaaaggatatgaacagacacttctcaaaagaagacatttatgcagcccacaaactcatgaaaaaatgctcatcatcactggccatcagagaaatgcaaatcaaaagcataatgtgataccacctcacaccagttagaatggtgatcattaaaaagtcaggaaacaacaggtgctggagaggatgtggagaaataggaacacttttacactgttgggagtgtaaactagttcaaccattgtgaaagacagtgtggcaattcctcaagggtctagaactagaaataccattggacccagccatcccattactgggtatatacccaaaggattataaatcatgctgctataaagacacatgcacacgtatgtttattgtagctctattcagaatagcaaagacttggaaccaacccaaatgtccatcaatgatagactggattaagaaaatgtggcacatatgcgccatggaatactatgcaaccattaaaaatgatgagttgatgtcctttgtagggacatggatgaagctggaaaccctcattctcagcaaactatcgcaaggacaaaaaaacagacaccgcatgttctcactcataggtgggaattgaacaatgagaacagttggacacaggaaggggaacatcatacactggggcgttttgtggagtggggggaggggggatagcattaggagatatacttaatgtaagtgatgagttaatgtgtgcagcacaccaacatggcacatgtatacatacataacaaacgtgcacgttgtgcacatgtgccctagaacttaaaaaaaatgttgaatattggcccccactctcttctggcttgtagagtctcccaagagatctgctgttagtctgatgggcttccctttgtgggtaacctgacctttctctctggttgcccttaacattttttccttcattttaaccttggtgaatttcacaattatgtgtcttggggttgctcttcttgaggagtagctttgtggtgttctctgtatttcccaaattttaatgttggcctgccttgctaggttggggaagttcccctggataatgtcctgaagagtattttcctagttggttccatccttccttgtcactttcaggtacaccaatcaaacgtagatttgttcttttcacatagtcccatatttcttggaggctttgttcatttctttttactcttttttctctaaacttgtcttcgttctttatttcattaatttgatcttcaatcactgataccctttcttccactttagcaaatcagctattgaagcttgtgctttcatcatgtagttctcatgccatggttttcagctccatcaggtcatttaaggtcttttctacattgtttattctagttagccattcatctaatcttttttcaaggttccttgcaatgggttcgaacatcttcttttagcttggaggtttgttattaccgaccttctgaagcctacttctgtcagctcatcaaagtcattctccagccagctttgttccgttgctggtgaagagctgcgatcctttggagggaagaggggctctggtttttagaattttcagattttctgctctggtttctccccatctttgtagttttatatacctttggcctttgatgtcggtggccagaaatggggttttggtgtggatgtccttttagttgatgttgatgttattcctttctgtttgttagttttccttctaacagtcaggtccctcagctgcaggtctgttggagtttgctggaggtccactccagagcttgtttgcctgcatatcaccagtggaggctcagttggaaatgcagaaatcacccatcttctgtgtcaatcatgctgggagctgcagatgggagctcttcctatttggccatcttggaacgtaatattttagttctataattttaagaatataataccttggtctggcatgtttaaatgccattttgtataatttttataacctttaaaatatacaattgttacttaaaatttgaaaactgcaccatttatataaaattataaactactatttcttatctatcactagtccatgactgtggaagaaaattacatcattcactgtcatgactcctaaatatgatgtccttaaaagaactgtctgcactcacaaactgaaattttctttccattcattcttgatcttatttcagtagtcttcaatttcagcactcctccaaagttgtttttctcaagattatcacaacttttattgtgtaataaatctaggcattttttcttacatctcattttatttaatttatcagcagtatttgacccagtggaggatatctccttcataacagcatcttcacttggttttcaagacctcactccctcaggctttttctcctgccttcgtagtccattcatcatggtctgtttttgttgctcctcctcatctttcaccttttgcacattgttgtttcccagggctcagtccctaatcttctttctcatgacttttttttttttttgaggtggagtctcactctgtcacccatgctagagtgcagtggtgaaacctcagctcattgcaacctgtcttgtgggttcaagcaattctgctgcttaaacctcctgagtagctggaattacaggcacctgccaccatgcctggctaatttttgtctttttagtagcagcatggtttctccatgttggccaggctgttctcaaactccggatctcagatgatctgcccacctcagcctcccaaagtgctgggattaaggtatgagccagcaccccagcccctcatgactttttctaatgtgtatatgctagtgatttccaaatgtatgtctctagctcagacctctcaccttaattccagatctctatatcaacctgcctacttgacatctctttttggttggctattgggcatcacacacttgccagatccaaaattgggctactggtgcccttcctgaaatcgacacctcatgcaatctttcctaatttggttagtggccactcttccagttgctctaccaaaaaccttggtgtcattcttgactcatctttctttctctcttatacctcacatccaatctatcagtaaatcttgtcaggtctactggaagaatatatccagaagccagtcatatcttttatatctgagccaccatcatctgtagtctagatgagtgtcatagactggtaatggatagtcctggtttttaaaaaatttcctttaaatctattcttaactcagtggcaaaacataagtcgaattgtgtcattcctctgccccaacccttctgattgccttccatttcactctgagtatgtgacaaaattcctcctaataactaaaaggcagtacaccatctagcatgttttctctcctgcttaaacttctattacttctctcctttgctctgcttcagccacactgaacttctcgctattccttatctatctctcttgctgaacgactccaggtacacctctatacttggcagttccttgtgttcttcagttctttacttaaaaatcccctttctcagcagggacctttctggccatcccaacttttccaccacccttcccctcaaacacataatcatttcattttcctgctttagtttttctcctctaacatactgtatattttgccttatctgtctattgttgtgtgtttatctcattctcatgaataggatttttattgttcactaccatatcctcagtgcctagaaaaaggcctagcatatcggatgtatctacctaacaaatactcgtgggtatattacatttgattgattctcacttaaaaaatgtttgacaaggttcactctaacaacttagcctggtaattatatgcataaattcttttggctctttataataagctacattcttaatattttttcatttagggagaaaatcccaatattgtggttattcaccatttattattttactggtaatcatgataattttaattatggtaaaatgcatcagaggaattgcaaactttactggtattttatctgaaaaatattagggtggtaaatttaatggacttacaaattctttccaacggattatgaaacttcagtatttgaaataaaaaaacagagttggaattttttgcttgctgtataagaggtgtactgatcaggcactgtctgctctgatggagcagctgctgctgcttggctgtctttcagaagcaagctgctcacattgatattggtgggcaagcaagggcagcggtcattgatcgattgactagatttagaacttgccctgggtggcttcttgttatcatggctacaggtcagttcttttctaagtttgtgctgtttaaaggttgccttccattaactattttcaaaatgaaactattttatattccagaattgcatacttaattttaaagttttttcaagatgaattggttaataatagctctcaggaagacctttttttttttttttttttgctacatagtcttgtcttaaccagaagagttctctgtataatttatttcttaaaaataatggttttgtttttgttttcagtgtttttagaagcttttgctcaagtcctaacataaactccaatgggagattttaatctctttgtcagttcatggatgtgtatgatagtgatattctctctttttaaattccttttcttgttcactttcttctttgtacaataatagtgatattcttgtgcatgtttacctcattaaaaagtaattacaattttctgctggcaaatccagctttttatattttgactaaataggaggctaaaagtgaagaacatttaccagattgttttattttcaaacaaaatcataactaatcaaaaattgctatttttgaaatataaataatgacatttagatattttaaaagtaaggatagcccccgatgtaggttggctttgtgtccccacccaaatctcatgtcaaattgtgattcccaggtgttgtgagaaagacctggtgggaggtgattagatcatagggttggtttcccccatgctgttctcatgatagtgaatgagttttcacaagagctgatggtttcttaaagggctctatccccttcacttctctctctcctgccaccttatgaagaaggtgtctgcttccccttcaccttaccatgattgtaagttttctgaggcctccccagccatgtgtaactgtgaatcaattaagcttctttcctttatgaattaccccatctcagatatttctttgtagcagtgtgaaaatggactaatacagagaattggtaccagggatagtggggtattgttaaaaagataatgtgaaaaggtggaagtgactttggaactgagtaacagaggttttaacagtttggagggctcaaaagaagacaggaagatgtgggaaagtttggaacttcctacagacttgttgaatagttttttttaccaaaatgctgatagtgatatggccaatgaagtccaggctgaggtgatcttaggtggagataaggaacttgttggggactggaacaaaggtgactcttgatatgctttagcaaagagactgacagcattttgcccctgcactagcaatctgtaaaactttgaacttgagagagatgatttaggctatctggtagaagaaatttctaagcagcaaggcattcaagaggtgacctggttgattctgaaagcattcagttttatgcattcacaaagagatggttttaagctggggcttatgtttaaaagggaagcagagcataaatttggaaaatttgtagcctgaccatttggtagaaaagagaaacaacacattttctatggacgaatgcaagttggctgcagaaatttgcataaataacgaggagcggaatgttaattgccatgaaatggagaaagtgtctttagggcatgacagagatcttcgtggcagccactcgcatcacaggcccagagtcctggaaggaaaaaatggtttcataggtttgggtccagggccctggtactgtgtgcagcctcaggacttgctgccctgcattcagccactacaggtccaactgtggctaaaagggaccaaggagaaacttagcctttatgaattacccagtcttcagtatttctttatagcagtgtgaaaatggactaatacaccctccctgaagacattttcctgatttcgtctttcatgttttatgtgccacagctacttttgaaattgtatttaaaggtaaacattattatattgaataatagaaacagaaatatagcccaaatctaattgtgattttcatgtttaacagtcatttctcatattcagtggactccagctttttaatatagcattcaagtgtagtgtagattcatctcctattcttagcttccaagtattttacacttttcctttcaagttcttagtaagcatctagacttcatgtgcttaatctttgtgctcacattctgttctctaactggaaggattttctctcactgtttttccctagtgggcccttcttatattttgcctcttctctaaagccttccttgtgctaaaatataactttttaatatatcaactcttacagaacacaatgtattataattgtatattaccttgtttttgaagcaggggatgcacatttccttttatgttgtttgtagttctaaacatttaaaaaattaatcagtgcaatgagatggaaaacagttggagttttacaaaaattgtggtttttttgttcattgtcaatagagttattaggaaacattggctttttatagagtttttaaagtagagcttttgccttgcatatgaagaaagaaacatgaaaataaaaaacggacctcaaaataatctgtgattacacccatatttgagaaggccaatttactaactcatggtctgcaacaagtaaatgatgatagcagtttaagtgaaatagatggtaaagaaggtaaaatttataagtcctttataagaaatatctgggaacaccccctcaaaaagtgggcaaaggatatgtgcagacacatctcaaaagaggacatttacgtggccaagaaacatgaagaaaagctcatcatcactgatcattagaaaaatgcacatcaaagccacaatgaggtaccatctcatgccagttagaatggtgatcattaaaaagtcaggaaacaacagatgctggtgagcctgtggagaaacaggaacacttttacactgttggtgggagtgtaaattggttcaaccattgtggaagacagtgtggtgattcctcaaggatctagaaccagaaataccatttgacccagcaatcccattagtgggtatatacccaaaggattataaatcatgctactataaagacacatgcacacgtaagtttattgcggtattatttacaatagcaaagacttgtaaccaacccaaatatccatcaatgatagactggataaaaaaagtgacaaatataatccatggaatactgttcagccataaaaaagaatgagttcatgtcctttgcagggacatggatgaagtgagaaactatcattctcagcaaactaacatgggaacagaaaaccaaacactgcatattctcactcacaagtgggagttggacaataagagcacatggacatagggaggggaacatcacacactggggcctgcctgggggtgagggagcaaggggagggagagcattaggacaaatacctagtgcatgcaggacttaaaacctagatgacaggttgataggtgaagcaaatgaccatggcacatgtatacctttgtaacaaacctgcacgttctgcacatgtatcccagaacttaaggttaaaaaaattttaaagtcaaaaaaaaaaaaaaaaagaaagaacaaaaaagaaagaaaagaaaataaatctctaggaaagaacgttaacaccaattacttttcctggaactagaataatatagtctcctcaaactggaaatactcaactgtatcagtgctgttgaaagattgattataataaggattagtgactttgactaggagaagtttcaacaaatgatagccatggaaatctgtagtggatgaatgtagacaactcttgagagaaaatttgctgggaaaggcaatatagaaatgggcaataattaaaaaagagtgtgggatttgagggagttttctctctttgtgtttcaaaacagaaatttttagagtttattttttactgttgggaatgatccataagagaagaacatggttatgaaaggtaattttgtttgcttggttgcatgtctaagcattagacagcttgattcattatcttttatggatttttagcaaactaattgcccttagaacttctattcatgtatagttttatgattagagttgttttttcagaattggttcagaagtgtaacatgttagtgtaactgtacatgccgatgatgacctaaaacttaaactgtcatacacagatttttaaaaagaattataataaacattcacacacttaggccatgctgaatagaatttaaatgttccttcataattgcacatcttgcactacctttgacagtagcatcatgaatagccatgatttgcttaggtacttactctaaaatatcaggtgtatcaactttatgattgtttagattctggggagtagggaaggattttgttcatgaagttgagaaaagcaaactattgacaatctattgcagattattacttcaggattataaactcctaaagcatcaaagccatattttcctgggccagcaatgttatcagcatatattgtatgctcaatgagtatttgttgaatgcatgaataaacagttgaagaaataaatgaatgacattgataaatttcttttaaaaactaatttttagttttttgaaagtagtaggtttccaaacttgcctctgtataaagtctttattttttaaaaaagtgcaggattcatgttctcactcataggtgggaattgaacaatgagaacacatggacacaggaaggggaatatcacataccagggactgttgtggggtggggggaggggggagggatagcattaggagatatacctaatgctaaatgatgagttaatgggtgcagcacaccaacatggcacatgtatacatatgtaacaaacctgcacgttatgcacatgtaccctaaacttaaagtatgtatatataaaaaaaagacactgcaattttcaaaaggtgaaaaaaaagtgcaggattcagaaattattagttatagccaaaaacagaatgataatcagaaatttttagttatagccaaaaacagaatgataatatggatttgtctgctatcatatctcttaaaaacacttgaatataaatattaccttcacagcatattgcaaaacacatgttttggagggagaattcttggatttcaatgctgtgtcaattactgaccagctctatgggctgggaaaatttatatggcctttctgggcctagtttctttctttatagaagccctaatattacctacctcaaagaattgttatgatgattaaaatgagcttgacacatgcacagtgcttagaatgatgcatagtgtctgcataataagtcctgaaaaagctaatattatcatttaaaaaagggttcccctcacataagaacataaataatgttttccaaataggtttcagtgccagtaaaagcttgtttttattgaaaaggacagcaatgagaagtcctggtatatgtctttctatcacataatatcagtaacatgtttttccttttgccttgactgtcagaaagcttgatctaaattcaattctttgtaatgatattattattatcatattttctttctcccttaatgttactctttctgtttatagtttaattccccatgtggaaaatagttatatttacattacctgttaaaaaatgacctgaacacttaatggatagaataaataacttataaatgccgagattttatataataaaataatagatttggacattatttgtattttatgtatttgtttgtctaagaagaattgtttcttttttcaggcctgaaaagaaatctaatgaaaagaacaaggtattgtaataagtaaattatctgaaacattattgttaaaaaaacacattataaaaggtaaagtgagaaccttttttaataaagacaattagttagaataaaagggcttaataacaagtacccattgataacggtacccttttaagaaaaatctgttgttttaagaagcacctgtggttttgctcatataaaaatatgaataaataccacttctgtacaactggtatattctatgaatattttgaggacatttgaggcagtattatttatcttacaggtcaaaagccaaatacattcagtggataaccttgatgacataacatggccatcagaaatagcgtcagaggattatgatttgcttttctctaattatgagacttttacattgctcattgaacaactcaaaatggattttaacggtaggaccattgcataagtagaaggccttttaatgtatcccacagtaatattcacacacattgcttagtattgcaccacagagcactgacgtgtgatagggatgatcatctcagaaacgtgtttgacattaaaatagactgagaaataatgtatattgtataccaaagagctatgataactccactgtacctttctcagtgtgaagggcagtctcagcctttttattgactctgcttctcccagatcgggttaccattctctcccactcagaatactgcagtaaccttagaactatttttcctgctaccccacttcctgagaccatggtctactctgaaactataattattaatttaaaaaaattcagatctgatgttgtctcttccttgtaactcagcataccacttgccattgctattaggttaagatctgaatattctagctctctcttgcatcatttaatacccttttttccctgccctagccattgtcttagatgtttattcctgcaatttatagctttagtgaggtataactgatatatgataggctgaatgtacgtaaaatatacgatttgataagttttggcatacgtatgcacatgtgaaaccatcaccataatcaagagcagtaacatgcccatcatccataaaaatctcttcctgtccgtttgtattctccttattaagaaactactaaatgtttaagtatttatactgtattccattcccatcagcagtatatgacaattctcattgtgcaatgtcatcatgagctcttagtattgctgtttattagtttttactgttagccattccaatgggtgcatattgtgcgtgtcactgtggtgtgaatatgcattgacctaaggactaagaatgttgaacatcttcccgtgtgctgatttgccacctgtatatcttctttagtgaactgtcttttccaatctggatagcttataaagatttaaaaattagatagtttttattcttatttgctgagttttaagagttttttaaaataaattctggatatcattccattattatgctttttcagaaagattttttcccagtttgtagcttgactttttgttttcttaataatatattttaaagagctgaagtttttcgttttgatgaaatgtgatatatctgttcgtttaattacagactttgctttttgtctcatgcctaaaaaaagtctttgtccagcacagggtcccagagatttttctcctctgctttcttgaagaatttttatagttttaggttttatatttagatctgtgatccacattgtgtacatttttgcatatgagtgaggtgtgatgtaagttcattgtatggatgtggatatctatctgttccagcagcatatgttgaaaatgctgtcttttctccatacattgctattgtccctttgtgaaaagtaagctggcatatgtgtgtgtgtctatttctggaccatttgttgtattccatcaatctgcgtattcttctagagttatactgatgaaccaatcataatttgaaaatcaatttaataccccaataaacccattgtacagttgaaaaattctaagtagaaccatcttaaactggagactatctctatctggctttcttcatgtaggtctagcatccctaatccaaaatccaaaatcagaaatgctgcaaaatccaaaactttttgagtgccaaaatgatgccacaagtagaaaatttcaaactagacatcaggtacacaaactttcatctgcaaatttactaaaagtgttccataaaattacctttaagccctgcatataaggtgcatgtaacataagtgtattttgtgtttagagttcgattccatttttgagatatctcattatatatgtgcaaatattccaaaacccaaaacacttttggtaccatgcacttgtagagatattccacccatatcacactgtttcattactgtaaatttatactaaatcttgacaccagcccttcagttttcttcttttttaagggttattttgattatgttggatcttttgcatttgcacttgagttttagaatcagattgttaatttttttttgtagttcaaatttaactttttaaaaaattttatcattattatactttaagttttagggtacatgtgcacaacgtgcacgtttgttacatatgtatacatgtgccatgttggtgtgctgcacccattaactcatcatttagcattaggtatatctcctaatgccatccctcccccctcccccaaccccacaacactccccggtgtgtgatgttccccaccctgtgaccaagtgttctcattgttcaattcccacctatgagtgagaacatgtggtgtttttttttttgtccttgcaatagtttgctgagaatgatggtttccagcttcatccatgtccctacaaaggacatgaactcatcctttttatggctgcatagtattccatggtgcatatgtgccacattttcttaatccagtctatcattgatggacatttcggttggttccaagtcattgatattgtgaatagtgctgcaataaacatacgtgtgcatgtgtcttcatagcagcatgatttataatcctttgggtatatacccagtaatgggatggctgggtcaaatggtatttccacttctagatctctaaggaatcgccacactgacttccacaatggttgaactagtttacaatcccatcaacagtgtaaaagtgttcctatttctccacatcctctccagcacctgttgtttcctgactttttaatgatcaccattctaactggtgtgagatggtatctcattgtggttttgatttgcgtttctctgatggccagtgatggtgagcatttcttcatgtgttttttggctgcatgaatgtcttcttttgagaagtgtctgttcatacccttcacccacattttgatggggttctttgtttttttcttgtaaatttgtttgagttcattgtagatagccctttgtcagatgagtaggttgcaaaaactctctcccattctgtatgttgcctgttaagtctgatggtagtttcttttgctgtgcagaagctctttagtttaattagatcccatttgtcaattttggcttttgttgccattgcttttggtgatttagacatgaagtccttgcccatgcctatgtcctgaatggtattgcctaggttttcttctagggtttttatggttttaggtctaacatgtaagtctctaatccatcttgaattaatttttgtataatgtgtaaggaagggatccagtttcagctttctacatatggctagccagttttcccagcaccatttattaaatagggactcctttccccattgcttgttttttgtcagatttgtcaaagatcagatagttgtagataatgcagtgttatttctgagggctctgttctgttccattgttctatatctgtgttttggtaccagtaccatgctgttttgtttactgtagccttgtagtatagtttgaagtcaggtagtgtgatgcctccagctttgttcttttggcttaggattgacttggcagtgtgggctcttttttggttccatatgaattttaaagtagtttttttccaattttgtgaagaaagtcattggtagcttgatggggatggcattgaatctatgaattgccttgggcagtatggccattttcacgatattaattcttcctacccatgggcatgaaatgttcttccatttctttgtatcctcttttatttcattgtgcagtggtttgtagttctccttgaagaggtacttcacgtcccttgtaagttgtattcctaggtattttattctctttgaagcaattgtgaatgggagttcactcatgatttggttctctgtttgtctgttattggtgtataagaatgcttgtgatttttgcacattgattttgtatcctgagagtttgctgaaattgcttatcagcttagggagattttgggctgagacgatggggttttctagatatacaatcatgtcatctgtaaagagggacagtttgacttcctctttccctaattgaatgccctttattaacttctcctgcctgattgccctggccagaacttccaacactgtgttgaataggagtggtgacagagggcatccctgtcttgtgccagttttcagagggaatgcttcctgtttttgcccattcagtatgatattggctgtgggtttgtcatagatagctcttattattttgagttatgtcccatcaatacctaatttattgagagtctttagcatgaagtgttattgaattttgtcaaaggccttttctgcatctattgagataatcatgtggtttttgtctttggttctgtttatatgctgtattacatttattgattttcatatgttgaactagccttgcatcccagggatgaagccgacttgatcatggtggataagctttttaatgtgttgctggattcagttggcggtattttattgaggatttttgcatcaatgtttatcaaggttattggtctaaaattctcttttttttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttagttggtaaactattaattattgcctcaatttcagagcctgttattggtctattcagagattcaactcttgctggtttagacttgggagggtgtatgtgttgaggaatttatccgtttcttctagattttctagtttatttgcatggaggtgtttatagtattctctgatggtagtttgtatttctgtgggatcggtggtgacattccctttgtcattttttattgtgtctacttgattcttctctcttttcttctttattagtcttgctagtggtctatcaatttttttgatcttttcaaaaaaccagctcctggattcgttgattttttgaagggtttttttgtgtctctatttccttcatttctgctctgatcttagttatttcttgccttctgttagcttttgaatgtgtttgctcttgcttctctagttctcttttattgtgatgttggggtgtcaattttagatctttcctgctttctcttgtgggcatgtagtgctgtaaatttccctccacacactgctttgaatgtgtcccagagattcttgtacgttgtgcctttgttctctctggtttcaaagaacatctttatttctgccttcatttcgttatgtactcagtagtcattcaggagcaggttgttgagtttccatgtattttagcagttttgagtgagtttcttaatcctgagttctactttgattgccctgtcatctgagagacagtttgttataatttctgttcttttacatttgctgaggagtgctttacttccaactgtgtggtcaattttggaataggtgtggtgtggtgatgaaaaaaatgtatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaagtctctttgtaggtcactaaggacctgcttcatgaatctgggtgctcttgtattggtggcatatatatttaagatagttggctcttcttgttgaattgatccctttaccattatgtaatggccttctttgtctcttttgatctttgttggtttaaagtctgttttatctgagactaggattgcaacccttgcctttttttgttttccatttgtttgttagatcttcctccatccctttattttgagcttatgtgtgtctctgcacgtgagatgggtttcctgaatacagcacactgatgggtcttgactctttatccaatttgccagtctgtgtcttttaattggaacatttagcccatttatatttaaggttaatattgttatgtgtgaatttgatcatgtcattatgatgttagctggttattttgctcattagttcatgctgtttctttctagccttgatagtctttacaatttggcatgtttttgcagtgtctggtactggttgttcctttccatgtttagtgcttccatcaggagctcttttagggctggcctggtggtgacaaaatctctcagcatttgcttgtctgtaaagtattttatttctcctttgcttatgaagcttagtttggctggatatgaaattctgggttgaaaattctttctttaagaatgttgaatattggcccccactgtcttgtggcttgtagagtttctgctgagagatcagctgttagtctaatgggcttccctttgttgttaatccgacctttctctctggctgctcttaacattttttccttcatttcagttttggtgaatctgacaattatgtgtcttggagtttctcttctccaggagtatctttgtggcattctctgtatttcctgaatttgaatgttggcctgccatgctagattggggaagttctcctggataatatcccgcagagtgttttccaacttggttccattcttcccatcactttcaggtacaccaatcagatgtagttttggtcttttcacatagtcccatatttcttgaaggctttgttcatttctttttattcttttttctctgaacttctcttctcactcatttcattcattttgtcttccattgctgataccctttctgccagttgatcgcatcagctactgaggcttgtgcatttgtcacatagttctcataccttgggtttcagctccgtcaggtcctttaaggacttctcttcactggttattctagttagccattcatctaattgtttttcaagatttttaacttctttgccattggttccaacttcctcctttagctcagaatagtttgatcttctgaagcgttcttctctcaactcatcaaagtcattctccgtccagctttgttccattagctagtgaggagctgtgttcctctggaagaggagaggacctctgatttttagagtttccagtttttctgctctgttttttccccatctttgtggttttatctacctttggtctttgatgatggtgacatacagatggggttttggtgtggatgtcctttctgtttgttagttttccttctaacagttaggacccccagctgcaggtctgttggagtttactggaggtccactccagaccctctttgcctgggtatcagcagcagtggctgcagaacagcggatattggtgaacagcaaatgctgctgcctgatcgttcctctggaagttttgtctcagaggagtacccagccatttgaggtgtcagtctgcccctactgttgggtgcctcccagttaggctactcagcagtcagggacccacttgaggaggcagtctgtccattctcagatctcaagctgtgtgctgggagaaccactattctcttcaaagctgtcagacacggacttttaagtctgcagaggttactgctgcctcttgttagtctgtgccctgcccccagaggtggagcctacagaggcaggcaggcctgcttgagctgtggtgggctcctccgagttagaacttcctggcagctttgtttacctactgaagcctgagcaattgtgggtgcccctcccccagcctcactgctgccttgcagtttgatctcagactgctgtgctagcaatgagtgaggctccgtgggcataggaccctctcagccaggtgtggggtataatctcctgatgtgccatttgttaagcccattggaaatgcaaagtattagggtgggagtgacctgattttccaggtgccatctgtcacccctttctttcactaggaaagggaattccctgaccccttgtgcttcctggtgaggtgatgcctcaccctgctttgcctcatgcatggtgtgctgcacccactgtccagcactcctctgtgggatgaacccagtacctcagttggaaatgcagaaatcacccatcttctgcatgtctcacgttgggagctgtatactggagctgttcctatttggccatcttggctccacccctctcccagatagttaattttttaaaaacctgctgtgctggaaattacactgagttagtgatgaatctatacattaattgggggaagatttacattttaatgagaatgcattttttgactcctgtgaaatggtttctatttatataggtcaaatttaattttctcagtaatattttatagattttaaaatatggctttcctttctttttgagacagtttcactccaggctggattgcggtgcctcgatcttggcctactgcaacctctgcctcctgggttcaaatgattctcctgcctcagcctcctaagtaactgggattataggcatgagccactgcacccagctaagttttgtatttttagtagagatggggtttcaccattttgtccagagtggtcttaaattcctgaactcaagtaatcctcccggcttggcttcccaaaatgctgggattacaggcatgagccactgtgcccagccttggtgtttccttattttatcagattcatctgtatctcattttttaatgaagttataaatgacatttaaaaaaatttcaagttgattgtttactgctaggatataggaatacagctgatttttgtatgttgatttttgtatcctccctccttgctaaacttagacttacttattagttctagtagcttttttggtagatttgatcagattttatacatacaacaaagattatcaaatcttttcattctcaaactactttcttactatggataggaagtcttttagacttgtggcaaagcagtctctgttgcagctagtcaactctgccattgtagtatgagagcagtcagggaagttacctacattaataaactcagctgtgttccaataaaactttatttacaaaagccagaagctggcccagaggctgtagtttatctgcccctattatgtgatcatggttgtgaataaagacagttttacttcttctttccaacctggataacttttatttatttttcttgtctgacagcactggctagaatcttcagcacaatgcttactaaagtgttgaaagcaggcattattgtgtcattcctgatacggggaaagcattcagtttgtcatcatgatacacattaactgtaggtttattatagatgctttgtatcatgctgatgaagttcatttgtattcttaggttgctgagtttttttttctttttaaatcaagaatgaagttgaattttatcaaatgtctttatttactgagataatcataaggttcttctcttttagtgttttaatggggtgaataactgatattttaatgttaaaccaacctttcattttagaataaaacttattttcttaggatgtaggcttttaaaaagtatatcattggggccggacacggtggctcatgcttgtaattttagtactttgggaggtcaaggcaggaggattgcttgaagctggagttcgagaccaacctgggcaaaaaaatgagaccctatatttatttgtattcagtttgccaaaattctgtttagaaaattttaaaagactatgtaaatgtagttttaggttcacagcaacattgaaagtatggtacagagattgtctgtgcttcctgtccacagacatgcatagcttcccccattatcagtatctctcactatagtggtacagttgatatgattgatgaaccaaaattgcatgtcataatcatccagatttcatagtttatattagtgtgcactcttggtgttgtacattctgtaggtttggaaaggactgatattcatcattatagtattgtacaaagtaattttactgctctaaaatttatttatgtttcacctatctgccctttcatgccctcctcaaccacaggtaaccactgatctttttactgtatccatagttttgccctttctacaatgtcatatagctgaaatcatacagtgcatagccttcagattggcatctttcacttagtaatatgcgtttatgtttccatcatgtcttctcatgacctgatagctcgtttctgtttagaactgaataatggttcattgtgtaactgtaccagaggttgttcactcacctattgcaaggtatcttggttgcttcagaaatttgtgaaatattttgtcaatgttcatgagggagttttcttttttgtaatatcattgtttggttcagggtaatgctagcattatagaatgagttgtgttgtatttctcctctttattatttgggagagaggttgtgtaaaattatattacatctgcctaaactgtttgatagaattcactagcatagctatctgggcctggagttttctcaactttattttctttcatagatatagggtgatttggattatctatttcttcttgattgagctttggtaatttttattttttaaggaacgtgcccacttaatctaagtggtaatggttagttacataaagcttgcactattatcttgctattcttttaatatctgtagaatgtataaaaatgttacattaattatctctgaagttagtaatttattctcttttttatgatcagcctggctaggtcaaggtttatcacttccactgatgacctcaaagtatttggttttattgattttccctattgttctcctgtttcatctttgatgtcatcatcggtttggcctgctctcacaaaataccatagacttggtagcttataaacaacagaaactgatttcatacattcctaaaggctgcaaagtccaagatcaaggtgccagaagattcagtgtctggtgagggacaaattcctgatttctatattcctttatttcccctgtgtgcttcatatggcagaaggggtgaatgagctttctggggtctcttatataagaagggcactaatcccattcattagggcttggattccatgagctatcacctccacaaagctgcagtatctaataacatcacctctgtgattaagtttcagcatatgagttttgggaggacaaaaatgttcacactatgttctgatgtttattattttctctgcttctgttgggtttaatttgctctctttttttgtagtttcttcttttttacttacttttcgtttgtttgcttgtttttgagacagagtctcattctgtcatctagcctggagtgcagtggtgtgatttcagctcactgcaacctctgcctctggattcaagcaattctcatgcctcagcctcctaagtagctaggactacaggtgtgcaccactgcacccagctaatttttgtatttttagtagagatggggtttcaccatattggccagggtggactcgaactcctgacttcatgacccatccacctaggccaccgaaagtgctgggattataggcatgagccactgtgtccagaccttttttactttcttaagatagaagtcaaggctattgatctgaatgtcttccagtatagacattccgtgctaacttttcatttaggaactgttgtagctatattccacaaagtctaacatgtagtattttcatttttattcagttcaaaatagtttccaatttctctttgtgtcaccactttgcctaggattatttagatatgtgttactttgtttccaaatttttgagtattttgatgagctattttgttactgatttctaattttattcttttgtggtcagggaccatactttgtatgacttaaatacttttgacttaatactttcatgaagatttattgtatggcctagaatgtggtctgttttgctaagtgttccaagggcacttgagaagcatagtgttcttcaagtctactcttgtcttgctgattttctgcctccttgttttatcatgtattcagtacgcaatattgaaatctcacactatacctgtgaatttgtcaatttcttctatcagtttttagctcatatttcgaagccgttatgttaccaggtacataaacatttaagattatgtgttcttgaataactaaatattttatcattctgaaatgatgttgtttataactagtaatattttttgttgtgaaatctactttagtattaatataatgattcctgattagatttcttttgtcatctgtttgcatgggatatatttttcttccttttaaccaatttgtgtctttatatttaaagtgtgtttcttataggtagcatggagtaggatcttgctttttatacagtttgacaatttgtcttttaatttaggttattagacccatttcatttataatgtgattattgatatattaatatttaagtttatctgtcatcgcgctgtttgattttcattagtcccagctattctttgttcccttctttttctaatttcctttcaattagttatgtaacttttatggtttagttttatctctcattttttggcttattggctctatttttttttttgctatcttaatggttgcattacaatttgtactgtatgattttaacttatcacagttcactttcagacaatattatatcatatcacatatggcataagaaaatcagaatagtatgctttcatttcctctctcccagccagattcttcctggatttgtggaattatggttttcattaagtttagaaagtttctgttcattttctctttatgttttgtcattgtctctccctccctctttggggacaggtatattattgcttaaagtttttgcataattctctgatgtcccaaatttatgaatcttctcttttgtggtatctagtctgtatttacttctaccagtgtcctttccgtcatgactttgtttttgtttgtttgtttgtttgttttttgaaacaaagtctgactccattgcccaggccggagagcaatggctcgatcacctctcactgcatcctctgcctcctgggttcaagccattctcctgcctcagcctcccgagtagctggggttacaggtgcctgccatgatgcccagctaatttctttgtacttttagtagagatgggatttcaccatgttggccaggctggtctcgaactcctgacctcaagtgatccacctgccttggcctcccaaaatgctgggattacaggcatgagccaccataactggcccagtcctgacattttaatttgaattcctactagtgtaattttctttcaagaaatatcttccatgtctctacttgagatttatttggggacacagttgacttataaacaacttgatctttctggtcttgttttttgatttggtctaattttccactcctgaatcaaggtgtttctgataactctattctttgccctgtgaagtcttgagttttttcagcatcattcagacgaatggacactcttcctggtacactgtgagcaacaggcactgtttcttacaattttttaaggattttttccccctggtctcaagtagtttcctaggacaaatatactgttcattattctgctaaataaatacccaatgagattctcagcttcattgttcgaactcagagaatctggggctctacctcagtttttggtagactctacctcagttttttttccttcaattgtcatggcctggaaactttgccaagtcagggggctggggtgtttgtaaggcttatttctcttgtttcctatcttacagggttcattgtcttcattacctgaaatccttgttcttgaaaatcgtggtattatgtattttgtcttttttggttttgttttaagtgagaaggtaaatcagtatctgctgctccatcgtggccagaagcagactgcagcagagcttcagtacatgacatagactagctagaatgcttttctaccccctttacttaacagcttccttctcacccttcatttctcagtgtagcccgctcttccccaggggaatcttcctgagcccagtatagatcaaatcctgtgtgatcatagaactgttttcttgcagcatctatctgaatttgtaatttcacttctttgtattttttcttcactacacctaaagctaaacaagagcagagttactgtttgttttatctgcagagctcagtagactgtgttcgccatggtaggaactcagtgcatatttgtttggtgtatggatgggtgaaggttaaaatgcacgggactttatatccaaaaactactcttatattttatttccaccttgtttccccccgatgcagattctgctagcctatcaaaaatccaggatgcagttatttcagaagaacacttactagaactcaaaaatagccactatgagcaacttacagtagaagttgaacaaatggaaaatatggttcatgtactacaaaaatagctatctgaggcaaaagaaacacaattacagttagctcctcagaaaggtgaatgtgagcaagaacgctacagttcgaggtatgacattctagttttagagaaatattttaactctttattctaaatatatatgtgagaattgtgattgctgactttctggggcttaatgggagaaaacgtcttggtcttatggagtctgaaaatcttggaaataatacaacaaattcttaactgtgcttcttttatttattgcatatgcttttaaattgtgattttaatggctatttagaagtttaccatatagaaatctcattatttaacaaacagaatttggggtttttgattcttttgtattagaattaatgctgcaagaaatactttttattattactattatcattattattatgattattattattagaattttgctctgtcactgaggctgcagtgcactggtgcaaacatagcttactacaactttgaacttttggggtcaagggatcctcttgcctcaaattcctaagcagctcagactgtaggcacatgctcccatgcctggctaacttttgaaatttttcattgagacaaggtctcactatcttgcccagtctgatctccaactcctgacctccaacagtcctcctgccttggcctcccaaagcattgggattacaggagtgagccatcacgcccagcccagaatatcttttatataaatcattttctgcatttctaattatttactttgtataaagtcttcaatatagaattttttggttaaaatatagaaactttttcaaaaaggccttggatcaatatttctaaattgtcctcaagaatatttgtattgaatgcatgctgagcttaatacctaggtgatgggttgataggtgcagcaaaccactgtggcacatgtttacctatgtaacaagcctgcacattctgcccatgtactctggaaattaaaattaaaattaaaaaaagaatatttgtattaatttacagttcaaccaacagagcatgaaatggccatttgtctcaaaccagaatactttttaaaaactttatacagttttattctttttttaactctctgtttaaattgatttatttttatttcaatagctttaggggtacaagtggtttttggttacatggatcaattttatagtggtgaagtctgggattttagtgtacccatcacccagtaggtagttttattgctcacttttcttctccccttccttcttctgagtctccaatgtcattataccactctacctgcctttacataacctagcatagctcccacttataaatgagaacatgtggtatttgtcgttccattcctgagttacttcacttagaataatggcctctagctccatccaatttgctggaaaaaacattatttcattcttctttatggctgagtagtattctgtggtgtgtgtgtgtgtgtgtgtgtatatatacgtatctatacatgtatgtatatgtagatgtatgtatataagtatatatatacacacatagatatatggactcacacacatatatgtgtatatatatcacattttctttatgccattcatcagtcaatggacactggttgattccatatattttcatgttgtaattgtgctgcagcaaacatatgtatgaaggtgtttttttgagagtacgatttcttttgtagatatccagaaatgagaatgctgggtacaatggtaggatctacttttagttctttgagagtctccacagattttgtactaacttgcattcccatcagcagtgtataactgttctcttttcaccacatccacaccaacgtctgttgtcttttgatttttaatagtggccattatggctgcagtgaggtgatatctcattgttgttttagtttacatttccctgatgattagtgatatttagtatgtttttatatgcttgttcagcatttgctcatcctcttttgagaaatgtctattcatgtcatgtgcacactttttaatggaatcatttgtatttttcctgctgatctgtttgagattcttgtaggttatggatattagtctttgacagattcataatttgcaaatatttttcccattctataggttgttggtttactcttatgattatcaatttgcggtgctgaagctgaagctttttagtttaattaggtcttatttatttattttcatttttgttgcatttgcttttagggtcttcatcataaattcttcacctaggtcaatgttttcaggtcttagttttaggcctttaatccatcttgaattaatttttgtatatgataagagatagagatccagtttcattcttctacatgtggctatctttttttcctagcgccatttattgaataatgtgtactttctccagtgtatgtttttgtatcctttctcagagatcatttggttgtaagtggctttatttctgaattgtctattctgtttcattgatctatgtatctacttttataccagtatggtgctgtttttgttactgtggctttagagcataatatgaagtcagataatgcgacgccaacatgtttgttccttttgcttggtacatctgttgttattcaggctcttttatggttctacataaatgtcaactttttttataattctgtgaagaatgacattggtactttcataggaattgtatcaaatctgtagactgctttgggtactatggtcatttttcacaatatcagttctttcagtccatgaacataggatgtattttcatttgtctgtgtcatctattattttcttcggtagtgttttccagttatccttatatagatcactcacctccttcattaagtatattcctaggtattttacacttttgcagccattgtaaaagagattgggttcttgatatgactctcagcttggttgtatttggtgtatagttgtgccactgattggtattcatttattttgtaacctctgagactttactgaatttatttatcaaatctaggagtgttttgtaagagtctttggggttttctaggtataagatcatatcattggtgaagagatagcttgacttcctcttttaaatttggatgccctttatttctcttgcccaattgctctgcctgggacttcccagttttattcttaatatgcatgaaataaaagtaaaatggaaaatgattcacgattagtttatttcacatctctgtctcataaacagataaaattaattcaccttgaattaattttgttatatgttaaatacatatattatatgtataataaaaacatgtaatatattatatgtataataaaaacatatatgttaaaaacaaaatattagaccctgtcttgttcaaaagaatgtctaagttgcttataaaatacataggaattaagaatataagttaaaaatgtttccaaaaaataaacatgaaaattatgggttaacacaggggttcccaatccccaggccaaggaccagtaccagtccctggtctgttagaaactgggccacacagcaggaggttagtggcaggtgagcaagtgaagcttcatctgtttgcagtccctctccatcactcacattaccgcctgagctcctcctcctgtcagatcagtggtggcactagattgtcataggagtgtgacctgaaccctgttgtaagttgctcatgcaggggatctaggttgttcactccttatgagaatctaatgccttatgatctgtcaccatctcctgtcacccccagatgagaccatacagtagcaggaaaacaagctcagggcccccagtgattcttctacattatggtgagttatagaattatttcattattaataatagtagaaataaagtgcagaataaatgtaatgtgcttgaataatcctggaagcatccccccacctcaggtctgtggaaaaattaccttccacaaaaccagtccctggtgccaacatggttggggacagctggcttaacagatgtgagacccctttgccttttcttggattaatctgcaagatatacattgtgtgaatgatatctgatgatgacaccttggcctgtaaatcattttagggataccttcagtatctcatgaaaattaaaatttcttctagtgaagaacaaaatgatacccggaagcaactttccaaggaacagaatgctagaatattacaagatgagattctgactactaaacagaagcagatagaagtggccgaaaaaaaaatgaattttgaggtattttctttagtcattttcaaatgcttttatataaaatgtatgtatttaaaaaaacaactatatatttcagaaagtataaaggatttttaaatcacatatatatgtatatatgtatatatcatttatcatgtgtctatatatgtacatataggataaagccatgttcttaattcaactccatttgcctgcaacagttgagtagtgacattcacaatggcctaaatccaaagaagcatttgatattttccataagaattgatgatctttccaatatcaaaaataagttttgctaacaacagattttccagtttttggacattagttcatcttttaaaaatattaatagagaagtcagtttattattttcactgctaagaaagtaggaaatgtatagttgggtcagaggccatattgtggatatcattatccttacttttgaggacagtaacagtttgctccaagtagtttctcatttcaatgcaaagagctttgaaaacaatgacatgcatgatatacattgagtgataatttattgataagtattttgttcccagagaaagagttcagtatattttcctctatttcacacttattactgtttcaaacattataaagaagaaataagttattgcaatggcaaataatctcatgatttctaagaaaagctctataagttgtatgctaccattcatattttgaaataaaaggcttcttttgtatttatatatttacaccacagaagtaactgtgattttgtggaggatcactagaagtagcatcagaagacctggagaaaatcctgcatcttgtgtatatacatatgtgtatatttgaatatatatgtatatattcaaaaatatgtatatatttttgagatggagtctcgcactgttgcctgggctggagtgcaatggcacgatcttgactcactgcaacctttgcctccctggttcactcgattctcctgcctcagactcccaagtagcttggattacaggtgcacaacaccatacctggctaattttttgtatttttagtagagacagggtttcactatgttggccaggctggtctcaaactcctgaccttgtgatctgcctgccttggcctcccaaagtgctggtattataggtgttagccactgcaatcagctgcatatatatttttttaacttcttttaagaattgtgatcttaaatgagttcagtgtcgtacatagaggtgcaatgtttagatgcagatgtgtacaatgtagaagggtacaatgtttagatttaacagttatgaataagtgtaattctcataactgactataacatattagaaaagtagaatattgataaaacattcttgagaaaaagtaacttaaagaattttgagaaattgcttctgccctaacatatgtatagctaaggctcctacaatgttatggtttataggtgagatatcagagtgtaaacccaatttaaaaaatatagtcaaatgtattaatcttatattttatgcctctgggttttttgtaattcagagaaatgcatttacaattctgagtttcttaaaaatcctccagtgatttaattttcataatctttaaataaatatttagatttgtggagtttacactctattaggtttgaagttttgtccaacttgtttttaggtaaatatccactatgggaattctttcattatacaaacatacaggttactttttaatttcagaagaaattatgatatgtccctctattgagtgctaactaaaatttccctttgtttactcagatttctcttagccataaggaagaaaaagaactcttgcatgaaaatagcatgatgcaggaagaaattgccatgctaagaatagaactagacacaataaaacatcagaaccagctaagggaaaagaaatatctggagtacattaaaagtgtgaaagaaaagaatgataatcttctaaaggctatacaattgaatgaggaagcactaacaaaagcagtagttcagtacagtggacagcttagcattttgacaactgagaataaaatgctcagttttgaactgcagaatgtaagacacaacaatgaaacactggaaatggaaattcaatcatgtcattttagactggctactgctctacatgattgtgactgaagtcagatagcagaaagagacttctttccagagaacaagacatgaacaggtttatttacaggagacaatgaattctcatatatctaacctaaaaggtaacagtgagattctttctgagcaactctaatgctaacagtaaaattaacagcctgaaaattaaggtccatcacacaagataaactctgagagaaaagacggggcaggccaccatttttcctttttgggcaacttagtcattccagcctgcaggctttggagagtacaaaccgaccaggggaagaagacatcctgcagcacagcacagctgctttatcaaatcatggccagactgcttctgtaagcaggcccctgatcctgtttctcctcactggaaaggacctcccagctgaggcctccagctacccccaccagtgttccctggccaacagagatttaaatcccccctgggacagagcacccagagagaggggtgggtcaccacctttgctgtttgggcgactagccattcaggcctgcagactttggagagcccaagctgaccaggggtggaagtggtacctcagcacagcacagctgccctatgaaaatgtgaccagactcttttttaagtcagtccctgaccacatttgttatcactgagtggagtctttcaaccagggtctctggctaccttcagtgctgttctctggctgacagaggtttcaggccttcctgagtcagagctcccagggggaggaccagattgtcatctttgctgtttgggcaactcagccatttcagccttagggcttcagagtgtctgaggtgatgaggagctgaagtgaacccccagcatagcacagctgctttaccaaaaagtggccagacctacattttaagcaagtccctgttcttgttcctcctgattaggcaagagttttttccacttgcctccagccacctcctacaggtgtgttcagattggcaacaagtttgtacctcagtggtacagtactcccagaggaaggggcaggctatcatctttgccttttcacagccttcattggtgataccttcaggccctggaaaatatgaggcagttagggactggagtgcacccccagcataccacagcccccctacggaaaagtggccagactgttacgtgggtgccagtttccatatcttcttgatgggcaggtcttcccatcctgggtctctagccagcaccccactggagctaccaagccagtagcaactcagcaattccctggacagagcttccaggagcaactgaaatcctctatgccactgcctctgcagtggaactgtccttgctacccttggaatatcaagggagcaaagactttaagtgctgtattgacatgtccaacaagttgcagttgacccagtgagcaagccagtccatctcccatgggtcccacacactctccactgttcatcacccgacagggaacgctggcttgggcccacagcacagacactccatcctgggctgatcgcactaagtgattgctaactcacatctctctggggtggagcccctaggagaaaagccaagtggtagagcagcaagccagctgatgcggagcccaaagggcagggacagctatctctctaggcaccatttgctcttatgagacactttatcccagcactttaggagtgctgaggtcagaccagccacatcttatgtgcaagattgcccagcagagatcaggtctgagagttcccctcttaaaaaaaggggacttgcttaaaaaagaagtctggccacatttttgtagagcagctgtgctgtgttggggctttagttttgagagagttctcctctgagacctgatctttgctgggaagtcttgcatatgagatggggctggtctgacctcagcactccttagtctgtttgcctctcccagggccccagcctggccacacctgcttacagggcactctcaggtgctcacaccatagcttctgtgccagtggaccatgtctgaccaatggagggttgcagcaaggtggcccctacagccatggaccagcctgcatattgcctctacatactgcagctctttatatgcaaacttcctacatccctttgctggtgtgtgtttacatgggtgggttttgctgtacttgccctaccagcacacgggagtgcatcacacaccccaacccacaccaactgccattgaagatggagccctggcaggcacagagccaaaaatcccccacccccaccagcacctcacccttgacctaatgctgcagagaggaaaagggaccctcttatatcctgagggaccactgttgcttggggagcacagagaaggcacctagacccgtgctggccagcacctcaccccaaaccaacactatctccagtgcaacagcacacacagtcagcaggggccccctggtccccaccctagctgtcttgcctccaccactgggtgaatgcccacagggaggcaggcacttttgcatccgctagcactctgctgcagttgccgcactttggtcccctcagtgcagtggaccccaaacctcgaggagccagagaacaaagttggggcccagtacaatttcctcagagttaaagcacacagtccaggaattgggagctgaacactggctccctaaaatcctccagaaacaaagccagttggctgaatccacctgacaccacaatcaaaccctcaaggtcatcaaatgtgataaaagaaaagtactctgtccaaaggtcagcaaccgcaatggttgaaggtggataagcctataaagatgagaaagaatctgtgcaagaacactgaaaactcaaaaagtcagcgtgtcttctttcctccaaatgactgcatcaactctccagcaagtgtttggaactgggctgaggctaagatgtctgaaatgatacaagtagaattcagaatatgagtaggaacaaagttcactgagtgagagaagtatgttgtaatccaatgcaaggaagctaaaaatcactgcaaaacattgcaggagctaacagacaaaatagccattataggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcaagactctgtctcaaaaaaaaaaaaaaaaaaaaaaagccattataaagaagaacataaccgacctgatagagctgaaaagcacactagaagaattttcataatgaaatcacatggtgattatgtgtgattgcattatgaaaattcttgtagtgtgtgtgggcacctgagagtgccctgtaagcaggtgtggccaggctggggccctgggagaggcaagctgactaaggagtgctgaggttagaccagccccatctcatgtgcaagaccacctagcagaatagaccaagcagaggaaagaatctcagagcttgaaaactggatttctgaaataaaacagggagacaagaacgggggaaaaagaatgaaaaagaattaacaaaacctctgagaaatatgggattatgtaaagtgaccaaatctatgactgattagtgtacctgaaagagatgaggaaaatggaaccaacttggaaaacatatttcagaatgtcattcatgagaatgtccccaacctagccagacaggccaacattcaaattaaggaaatccagagaacctcagttagatatgccacgagaaagacatccaaggtcaaaatgaaagaaaaaatgttaaaggcagctaggaaaaaaggtgaggtcacctacaaagggaatcccatcagacaaatagtggacctctcagctgaaaccttacaagccagaagagatattcaacttcttaaagaaaagaaattccaatccagaatttcatgtccagctaaactaagtgtcataagtgagggagaaataagattcttttcagacaagcaaatgctgagggagttaattaccaccaaatctgccttacaagagctcctgaaggaagcactaaatatggaaagaaaagaccattaccagccactacaaaagcccactgaagtgcacagaccagtgatgctaaaaagcaaccacatacacaaatctgcaaaataaccagctaacagcatgatgacaggatcaaatccacatatattattactaaacttaaatgtaaatgggctaaatgctacaactgaaagacacagcggggcaaggtggataaagaaccaagacccgtttgagtatgctgtcttcaagagacccatctcacctgcagtgccacacacaggctcaaaataaaggaatgcagaaaaatctttcaaacaaatggaaaacagaaaaaagcaggtgttgcaatctagtttctgacaaaacagactttataccaataaagatttatcaagacagagaaggacattacaaaggtggccctgacctttgataaatctcattattggttgataccaacctgggctgtctttttttgttgttgttttttgtttttacttttgagaaggagtctcactctgttgcccaggctggagtgtggtggcatgatctctgctcactgcaacctccacctcccaggctcaagcaattctccttcatcagcctcccatgtagctgggattataggtgcatgccaccacactcggctaatttttatagttttaatagagaccgggtttcaccatgttgggcagactggtcttgaactcctgacctcaagtgaaccgcccaccttgtccatccaaagtgctgggattacaggcacgggccactgtgcctggtcaatctgagctatatttattgctgaaaccaataggataatttgctgaggttgagaagtttctcccctccagagagtccctgatcttccaaaattaggttgagatctaaggttgattttactgtacaactccttttctgaagttctacttatttccaacaaggaatgcaagttttcctgcttccatgatgatggagagcaggcacctcctttcttaagtttcagcttgcagggaaggtgagtgtgaattttttcctgcttctaagatgatagagagtgatcatcagcctgagactttttccaggtaagtagctgaagtagagatttgtcttaaaaattttccttaatgactaaaagttaagattaccaaccaactggttttaatttctccttgcctttagaacagccagtaatcatatgaattgtgcatttgtttgttttgcttaacggtttttgtttgtatatgtttggggtttattgttgttgttttacttttctcccatcaagtatgatcatctcttcctgacttggtcaaatccaaaggaatgttccaaattgtgaggaacaaggcatcagaataggccaaaactcctgtagctgcaaaaaaaaaaaaaaaaaatccagttagaaataatttttataaaacttagaaaaaattaaaaaaaatttttttttcttaagaggtttcatgtacataaccaggccatcttttgccagccaagagcaaattgaagaagcagtggtggccacccagtgctaagattctgcccaaacaatgtttactacagcaacctgagtttgtttcctaagtctagttctttctggtttggtatttgtgttacttttaaaatgccagcagtttgtcctagctatgaggctgtagtaagagattcaaatgattttttttaagagctccatgataaaaagcttcattaaaaacaggtattatatatatgtaaaaatatatttaaatataattacatatatgtcaaaaatatataaatatatgacatatttatatataaacatataaatacacatatttatgttagaaatatgtttataatttgttatatatattttttgtatttgtgtgaatctaaaaggcctttctctttttggatttttttttttgagaaacatttgattttgttctcagtcaactgaattctatctctccattttacgtatgtctgtcctttctttttcttgctacccttaatgcccacataaaagacgtaaagtaatttctgataactggggattgcttaaaacagaaagggcaccagacttctttttgcaaggaatcactgtttttgtttctaaaatcccaatagttgtaaacagacaagtttttttgcagctcttaaactgctcactttttaaattgcattattggatcttaatggcttttttcttttttttttttttgagacggagtctcgctctttcactcaggcagactgcagtggcctatcttggctcactgcaagctccacctcccgggtttatgccattctcctgccttagcctcccgagtagctgagactacaggtgcccaccaccgtgcccggctaattttttgtatttttagtagaggcggggtttcgccgtgttagccaggatggtctcgatctcctgaccttgtgatctgcccgcctcgggctcccaaagtgctgggattacaggtgtgagccactgcacccggcccttaatggcttttgagggtttcaagaatcactttgcacagtgagaaagtttttgaccttggagtgtgtaatagctaagtaggagatatatttttagggctggttattatgggatatattttttcttccttttaactaatttgtgtctttacatttaaagtgtgtttcttataggtagcatggagtaggatcttgctttctacatagtttgacaatctgtgttttaatttaggttgttaggcccgtttcatttataatgtgattattgatatattaatagataagtttatctgtcatcatgctgtttgattttcattagtcccagctattctttgttcccttctctttctggtttcctttcaattagttatgtaacttttatggtttagtttcatctctcattttttggcttattggctctaattttttttttttgctatcttcgtggttgcattacagtttgtactgtatgattttaacttatcacagttcactttcagacaatattatatcatatcacatatggcataagaaaatcagaatttctattcattactactttcatttcctctctcccagccagattcttcctggatttgtggaattatagttttcattaagtttagaaagtttctgttcattttctctttatgttttgtcattgtctcttcctccctctttggggacacgtatattattgcttaaagttttcgcataattctctgatgtctcgaatttatgaatcttctctttcttggtatctagtcagtatttgcttccacccagtgtcgttttcagtcatgactttgtttttgtttgtttgtttgttttttgaaacaaagtctgactccattgcccaggctggagtgcaatgactcgatcacctctcactgcaacctctgcctcccaggttcaagccattccttctcctgccttggcctcccgagtagctggggttacaggtgcctgccatgatgcccagctaatttctttgtatttttagtagagatggggtttcactgtgttggccaggctggtcttaaactcctgacctcaagtgattcacctgcctcagcctcccaaaatgctgggattacgggcatgagccaccatatctggcccagtcctgacattttaatttgaattcctactagtgtaattttctttcaaaaaatatcttccatgcctctacttgagatttatttggggacacagttgacttataaacaacttgatctttctggtcttgctttatgatttggtctaattttccactcctgaatcaaggtgtttctgataactctattctttgccctgtgaagtcttgagttttttcagtatcattcagaggaatggacactcttcctggtaggttgtgagcaacaggcactgtttcttacaatttttttttttttttttgtgtttaactcatctgcatgtattttcttttttgcattttttttttaatgttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgcttggttttttgttcttgcgatagtttactgagaatgatggtttccaatttcatccatggattttttccccctggtctcaagtagtttcttaggacaaatgtactgttcattattctgctaaataaatacccaagagggtgtttttgcagatctccagtgttctttccctttactgctgtctcctttcaagtattctgtgatttctgtctgccttggttttttgagactctcggcttcattgttcaaactcagggaatctggtgggctctacctcagtttttggtagactctaactcagttttttttttctttcattgtcatggcctggaaactttgtcaagtcagggagctagggtgtttgtaaggcttatttcacttgtttcctatcttacaaggatcattgtcttcactacctgaaatccttgttcttgaaaatcgtggtattatgtattttgtcttttttgtttttgtttcaggtgagaaggtaagtcagtatctgctgctccatcatggccagaagcagactgcagcagagcttcagcacatgacataaactagctagaatgtttttctaccccctttacttaacagcttccttctcacccttcatttctcagtgtagccatctcttccccagggaaatcttcctgagcccagtatagatcaaatcctgtgtgatcatagaactgttttcttgcagcatctatctgaagttgtaatttcacttctttgtatttgttcttcactacacttacagctaaacaagagcagagttactgtttgttttatctgcagagctcagtagactgtgttccccgtggtaggaactcaatgcatatttgttttgtgtatgtgtggatgaaaatagccactatgagcaacttacagtagaaattgaacaaatggacaatatggtttgtgtactacaaaaggagctgtctgaggcaaaaggaacacaattacagttagagactgggtttcaccatgttggccaggctggtcttctcacctcaaatcaaccacccgccttggccttccaaagtgctgggattacaggcatgagtcaccgcgcctagccaacctgagctatttgtattgctggaaacaataggataatttgctgaggttggggagtttctcccctccagagagtccttaatcttccaaaatttggttgagatccaaggttgattttgctctacgactttttttctgaagttttactcatttccaataagaaggcatgttttcctgcttccatgatgatggagaacaggcacatcctttcttgagtttcagcgtgcttctgacagggagggtgagtgtgagatttttccttcttgtaagatggtagagagccatcatcagcctgagccatatttccaagtaagtagctgaattagaattttgtcttaaaaattttccttaatgactaaaagttaagattaccaatcagctggtttttatttctccttaccgttagaacagtcactaatcatatggattgtgcatttgtttgttttgcttaaatgttcttgtttacatttggtgttttattgttgttgttttacttttctctcatcaagtatggtcgtctcttcctgacttggtcaaatccaaaggaaagttccaaattgtggggaacaaggcatctgaattggccaaatcttttgtagctgcaaaaaaaaaaaaaaaaaaaaaaaaagttccagttagcaaaaatgatgttgtaaaacatttttttttttttaacctaagagttttcgtctacataacaaggccatcttttgttagccatgggcaaactgaaggagcagtggtggctacccaatgctaagattctaccgtattcactacagcaacttgagttttgttcctgtctagtgctttctggtttggtatttgtgttactttaaaaataacagcagtttgtctgagttatggtgtgttagtaagagattcaaaagttttttctaagagctccatgattaaaagcttaattaaaagcaactttgatatatatgtaaatttatatttataattacatatatgtcagaaatatataaatatatgacatatttatatataaacataaatgtacatatatatgttagaaatatgtttacacattatatttttaacctataattttttttgtgtttgtgtgtgtctaaaaggcctttctctcttcggatcttgttttttgaggaatatttgtttttgttctcagtcaactgaattctgtctctttattttacttatgcctgtcccttttttctcttgccacccttgatgcccacataaaagatgtaaaataatttctgataactggggattgcttaaaacagaaagggcatcagacttctttttctccaaatcactgaaatcacagattttgtttatcaaatcccaagagttgtaaacagacaagtttttttgcagctcttaaactgctcactttttaaattgcattactggatcttaatgacttttgagggtttcaaaaatcactttgcataatgagaaggtttttgaccttggtgtgtgtaatagctaggtaggagatatatttttagggctggctatcagaagagatatttgtatgcctttggctgcctggaaggtatggaaacatcccaatgctccactgaatagtgagactaccatgggatatgagctgattattgaatgggctaattggcttttcttggctaccaacctcaggggaaatgtagtgaaatgcatgttaaaaacatggcattgtctcatcccataatgttttcctcttttcagggcctgaggattttatgtaaaaatcaaatacttgatttttggatatctgttctgccttacagctgtgccttcatgttaggccctagaagctgcatgcttccttggccctgtttcttaaaaggctccagcctaaagccagtaagccaatttttaaaaatcttcaaggaaatcacatttaagtgtgtctgctttccttggccatcttaactgaacttttacaccatttttttttttggctttagtaaaatataaatcctccatcttgtttcacatgagtcatctctttaaaaatgcaaatttagaattgcctcactaataactgtttacagtagggaacaagtattcaaaagacgaatgtgctaaagtggagaggaaaaactggcaaatgaaaaatcttttgaatccctaagatctacttctgtgtgcctatatgtctaaatatttatatgaattatgcatgtaatgtttgaataccaaaaatatgtgaaaaggctctaattggctttttaaaaagttcttaaatattgtatcagaaattagaaattagaaacttattcccaaatactttttcaagttttggttaaaaagaaacttcaagatgtcttcacaatagttagcatacattattgtttagatgtattggtccagtggtttttttccttttttcttttttttattttctggtcaagtggttttattttatatcttctagctactataacatgtcaaaatttgccacaaagttacaaactataaacccagacccaaacaataatttttgttcatgtaatttttgataaatatttaatattgttgatttaatgaaaacagctcaatccagagttatcagtaaataaaactattaataataagttaggtaaatgtaatagaataaaagcttataaatgaacttgtcatataagttaaatcttaacattatattaaatcaaataatagatattagatgtctggatcattatcaatttttaaactatattattggaaacattttcaaaataattataagatagtcctcatctataaaatgctgatgtgacaataaagatttcttacttcttaggttttcaccaaaaatttattaccaaaaatcaaaattttagttaatatgtgattttacatataaagtgtgccaaaataagttttattctgatgaaaaaagaaaaattgtgagaaataaaaatgaaataaagaaatgataagaaacagaatgaaaataattgttgtccaattcaaagattattgaaggattccttatgaaacaatgtaaagggaaccagtaagtgacagagagatttaaagaaagttataaagagattataaagagatacattcagtaagaaataccacaaagatgctgggcacggtggcttatgcctgttatcacagcactttgggaggccaaggtgggcagacaagatcaggagtttgagaccagtctgtccaacatagtgaaatctcgtctctactaaaaatacaaaaattagctgggtgtggtggtgtgcacctgtaatcccagcaacatgggaggctgaggcaggagaatcacatgaacccagaaggtggaggtttcagtgagccgagattgcaccattgcactccagctcaggtgacagtgtaagactctatctgaaaaaaaaaaaaaaaaaaaaaaggaattattacaaggaaaataattttgtataaaaaattgtatggtagatttttatcctaaaacaaaatggctggttatttaagaaagaggatatttaggacaaaacagaaagtctaagcatgttataattggtctgtgtaataatacgcttcattaaaaagaaaattcttttaagaattttgtgtgtgattcagttggctagaatggaaggaaaattattcataatagcctttctgaaaaattaagctttgatttttaaaatacactagaagaaaacaaaaaaattgattagaaccacaagatgcttttaagcattaatttaataaaattgtaagattttttaatgtttaattctataatctgtttctaaaaggtttctcagatgaatatctcaaaagtttaatttttgctgaaccccattgcttccagcttactcagcttattctccctttgagaaacctgggatagtaactctcttcttcaacttttcttgactccagtagcattttttttcttcctccaattctaaatctgttgttatggcctgatgatgaaatgttttatcttgaaaagtatttttttttaaaggcaatgttttcctccagtataagttaattctacactgttgccttttcttaatatgtttatgggccttgagccctctgaaggttagcttaaaaatcaactcagaaaagaccaatcgattaaagagaggacaggcagatttgtttctgaatatatacatgaaagttttcaaaatagaggcccaatatataggagaaattgtctatttttcattgtttagtttcaacaaattatggaaagccttgtaaacaatatgcttgaaaaaactttataatgtagttctggtggactttgagggaatatccaagaaggcctgtctctctagattcttctaaacctttctgagttagcatttcttctttttagctatggggcacctataacctatagtacaacaaggaaggtcagataagttctttatggccagttcttagacagaaatttgaagaaaaaattagattaatactttaaaagttttatggctggctctgaacaaaaagttacagattctagggcccacctggaaaatgaagattctagtttctgtggccaggcttgagggaaactggaactgaggaacacaaggacaggagaaagccaaataaaaagttttatttctgagggtgcttctgaaggtttcattttggggtattgtttttttcagtccaacatatgtccaaagtgttcaatataattaggcaacttcccatgctgtggctaagagtcacatattctgctcaagacttctatgatatagtgtttgcatgttacactgggcatactctttctgtatctgactagttcacgttttcttttcatcaggtttgactgtcaggttgtccaaataggcttcccataaaggagaaacagtcactgaagaaggttacttttttcttttattgttaactaatcaacaaacactttaagataattcctgtgttgttttaattagtttttaaaaattattacaaaactaaactttaacagggttaagggccttacatccatgtaacttcctatattgctgttaagatcttttcatttcactctggttaaatgaagaactattattttataatggcccgtgattctgttgtaatcaaacattttgagttttctaatatcttttgacaaacagcctcaaatatcaaatactgaataaagtctctgacttagacttgtagctggtggcttatcaaaactataaaaattaaccactgcaaggtcataaaatcttcttacagcttccagttaagtcatgaactccagtatcaccctctccaggctgatgattgggcatcagctgagagactcctccagcgccattgaaaagggtttttatcaaatagtgtaaattaaactttttgctgttaagttgcagggctttgactcctgagtacttctatctcatctaaaaggtagcactggctcctgctgaaacttaaacatcaatgctgatatctggcaccaaattctagttaatgaaagccccaccttcaaacctgggagaagatgagagtcaaaacaacttgctaatgctatactttcatgggtcatttctatagtttgttattagagaagtttctctgaatgtgttgagcaccagaaaccacgaggagatgcagcattctctcctgaacgggaagccagcttttggcattgctttgatgcaactaccatttgccattgatggcaatgcatcgcttcctctaggagtgtaagagggagtggatgcagtcagagtggttttttaaattaaaaaaatttaaaaaaaaatccaggctgggcatggtggttcacacctttaatcccagcactttgggagaccaaggcaagcggatcacttgagctcaggagttcaagatcagcctgtgggcaacatggcaaaaccccgtctctacaaaaaatttaaagtagctgggtgtgttggaatatacgtgtagtcccagctacttgggaggccaaggtggtaggattgctttagcccaggaggttgaggctgcagtgagtggagatggtgccactgcactccagcttgggtgacaaagtgagaccctgtctctctctctctctctctctctctctctctctctctctctctatatatatatatatatatatatatatatatatatatatatatatatactttcttgtgatactgtgctaggcctctatacaaagacataaatactaaatcattttcctctattttaatataatttgttctatgccttaaaactagataatttaaatgtttagctacctgtgggttttttttttctgttattgtcagagctaggcagggcttatgtcctttgtgtttaaacatttttaattctgggccaggtgcggtggctcacatttgtaatcccagcactttgggaggccaaggcaggtggactaattgaggccaggtgttcgaaaccagcctgtccaatgtggtaaaaccctgtctctactaaaaatacaaaaattagctaggcgcagtggcacacgcgtgtaactccagatacttggggggcatagagaggaggatcacttgaacctgagaggcagaagttgcagacagctgagatcctgccactgcattccagcctgggtggcagagcaagactgtacaaaaaaatgccaattctatatgtagcttataaaattgggtaaaacaacaaaacttacctttctctttctatgtggtatttccaaaatttaaaactattttaaatctcactgggcccaatctatttttattgctaatgtaccactgctaaaacgatataaacaccttttcttacaggtgcaggcactcatgtagaaaaattgagcatgtggaactgtaagggccagttttgagagataaaattagtttagccccttcaaataaaggacaggcacacatgcctaaacagctgacaaaataagaaactttgcctcctgggttctttccattcatcctaatataaagaattacctactctccataaaattaaaaaagaattacttacaggatattaagatacttaagtgacaaagcctcctgggtagagtgctccaagttatgaaatttttacagatacatatagaaagctgttttaaatcagcgatcttagtacaaattactaaaaagactacacaccaaaaaactttgtggaataacagaagtgtctaaattccttaacttaaatggttttaataaaatgtttgtgtttcacataactaattactatagtttgtaactaaaaccaaaattatgctagcttaacacacagaagttgttataagaaaaacttcagccaaattaaacttcaaagaatattgagcaataaataatttgcaaattggtctgcctcctgagccagagtagactcagagactcagtgaagctgtgtggtggaagaaggtttatggacagaaaaaggaaagtgatatacaaaaaattgaaatgaggtacagaaacacctggattggttacagttcaatgtttgctttatttgaacatggtttctacatttgattagccaaatctcagtgattggcacaaatgtaggctacagtctgtttacaagtttacttgttatagttcaaggacagggaaatctttggcctaaacatttaggccaaacttaacatttgtagggaggcagctttaggttaaacttaacaatttccctctttggtcatcttctcaattttgagagactgacaaaaatttagtcattgatgtcactattagtatgtacttacttggtcttgaaacccactgggaagtgggttttgtaaggtgggagcagttggttttgtaaggtgggaacaaggacttgggattattttattttatttttatttttgtaagggttatagtagagggtacctccttatgctggaacatctttttatatgagaaaaaaacaaaacctgatccattctaggatctgtgtgtttccttaaagtcttagtttatgtcatgagtgactcagtttggtttggtctggtctgttgaggcctgatgcatgagctgagtccaaaaaaatggcctctcataactttgtttaaaaattctccccttttggtcaggttctcacttaggtgatttagactgtgaccaaaacttagggtctgagtgccactcttagttgccatcactttggatttctggtctcagcatgccatttataggttacagtgtcctcatggtcacacatattttgtttcagctcttgtcattccagttgaagagagatcatttgacattccagagatggctgcatggaaacattcaaaattttaaagagaatacagtgtaccaggaagactattattactatcagaaagataataacaagattttggagtagttccttacttagtgtcctcataaaccaaaccactgaaaatcaaaagaatgagctaaagagtctgcttgattaactaagcagtctcttcattaaaactctacaaatccatataatacctggtgtgatgtatttctctgtaggccacacatgccagcagctgcacagataatttctctgtttagccagtaagtaatctagagcaattctatcattgagcataactttcccaagataaagtctgttgtgtaactttagcctttacagtagaatctgctataacacctatcattagggatacatttgtaatcattccctcttgtacttcaaaccatggagaaaatagggcttaacaaatgatgcccttctagaagagtgaaggcctcctctcaatgctctcttaaacccatgatgtaggttaagaggagtgaacaaatattctgtttctgactgattatgaggcaacatacgtaccattaaaatttctcacatttggcctctatcttccatcaaagaataaggttatccagatgtgagggtaatctggctgtgacatctgtcactcagttgatctccagggttgatttggctgatctggctggccaggcacactttcccttcctccctcaccactccatgtgcatccctcctgaagctgcatgctcagtccaagaggatgaccatctctgttagaggaggaccattctttggtcaagggtatacgagtagctgcactcccctggtagaacttccaaacaagctttcaagttataaagttgtatatgtataagactagctacaaaatctatcacaaaagtatatcccatgagtgtgcacaacagaccccccctttcacatctattgttcataaaggcataagcaagggaaaaaaatattcagaatctaatgttagcagagcagtctttatccgttgttcacatcaagtttgccatcttctggggagaaacttttctggttagctttaccttaagggttatagtgggtgtacagtttcaagactgtggagggacccttcttagttgtaagattatgaacccagagttcaaggttccaaagcttttctgtagtgtggatgtcaagggcagtctttctctgatgttctcagaagatccaatctataggctctagattatgaagaggtgttgatctcagtgaatcataaaaaagctttttttacctggtgaaaatacactgtggcataataatctgttataacatcagctctcttgcatgggaaagctttaatacaaccagaaaacacgcactgaaaatgataattcaatgaaatccctttataaatgtttaaatggcccatcaggtagtggattgtatctgaagctttcattgtccttccaggaatatgagtttgacaaaccaaacattggtcataagctattttagcaatttagaattcaccacaccaatatatatttaacttggatcattttatcttttctatgataagtcatggaatgcagaacttttaataatgaaagctttaaggatggactcaggaaggataaggcagctgtcctggttctccatgagtccatgcttaacattgaacttatgtagtcttgaattccagttgtttctccaatttaggtttatagcagtaacaactgaagggttgtcataggtaatttgacttagaccaaggcgttcattcaaactgtgtatttaaacaatttcagtattggttaatttagcgtgaaagtctgacaatgtgttttcttggtattcagttaattttcgttctacttttaaaaacaagtaagtcttttcgttaaagttccaggtactctgacacagtccaaatgatatgattctaaaatttccagaaatctgtattcaagagctcttttcagggtctttccatcctttcaggaatctcccaaaagacaccatattctgggacattttgggcttgtgaagttttcagaaactgcatcagtattaagcaattaactgtggaaatgatgttaaatagtcatagttacccaattaacaggaaaatttggttatttctgtggtctacaatttatcatgataaccataattataattcatagcatatgtttatacatattagaattttagaaattccatataattttggaacatatattaacattcattagaatataacctgaataaggttaaacatttcttattttgacagtgtttcccatgtaacttaatgtgtcaaataatcctgtttacccctgttttgaattcttcagggccctctgtagcatcccaaagttagaagtcaaaaagacttaattttgaaactgaaatttgattttgggaagcccataaaatatattaaaggtttaaaacacttgatattataaagtggaattccagatcacaatgtcattcatttagccaaaatgataactcaaaaaatgtttaaaggcaaaaacccttactcattgatagatgacttagcttttcaagcaatctgtctttcccctctttttcctgtagtttatttggaggggaaaaagacatcttttattatcctttagtattacatgaaaatcttattcaaaagagaaagccaaatttcatccttgcattagtgtactattaaagtcaactccaatttttagtaaaaccttatagacaaatttatccagtctttatcagtttgaccataaggtgagattctcaaaaacttctgataatgttttacaaatttgcattaaagagcagatgagtgctctaagaaaaccctgttttgatttcattccaatgttcaatttatggaaaagctgaataatactcctttaaatttaaccaatatgttcacacacagtatttctcttacaagattatttttttcacaaaccttccacaacttgctcaaacttttagctttattttatctaaattaaaacaatcctttaactctctaaattaggcaaaaatttacattttaatgccttcttataatcttttactgaaagcacatttcactttcctcacacagcttccatagataacttttttcagtagtctgaattacatgttacaatgttaacccttagcaatttttatttttggtgaaaaatctggcaagtaagtgactttaattatgtactaggtgtggagcctaggacaccagacagaagtgcagataaagtctgaccctttcaagcatagccaggggcatggctaactccacatgtccccaggcattacctagaatctaatggctccagagcaggtaaactgaacagattttaaaactcaaggaagcagtttattactttaaagcattttacagacctaatatctgacctgcctaatttagaccaaatgtctttattttaccaataaactttaaagctatctttattttcaaagcttactaaagtcatgtgaactaaaaggcattacagtttttatttctctgaaaaaaatttgatttaagcactcattgtttttaagccaattagagcttttttatttataaacatcacacacaacacatacacagaagtagacccagtagttgtaagacttttcatttgccagtttttaagtttcttagttggattactagcttcagggtggagtcccctgaggaagaaggctaggaaaatatgcagtttctaggacctaataaacaggcacaactgaaaggcaaaacagatccccaaaaatttagggtcccattttatactggatccccaaagagaaatgctatggagcaggacagttcaatgatccttaccatgcattttgttgcagagcaatagaaagccaattagttcattttgtgatcagcccatccctatgggagccttatttctcagtggtgggggaacattgtcatactttctaggtaatcgagaatgtgcttctctgattgagatgtgcaaagagctgaatatccccccataactgccatttgccatcccccaaaaatatatttagccttagactttgtgaggaatctatctgctttcaattcctgggatttcatgaggaaaacaggtttttcccaaaatggggtctgtggtgcctcctctgtttttcccaaggagtcccaggctgttagaaattaatcttatgtcctctcatgcatgcatcaagtttggcaagccaaaatggagaaaaacaattgagttgactgaagagaaaaaagagatccaagaagagaaaaaatcatgaaggacttttaaatacacctatatctttgatatcctattttaattaagctgacttttaactatagtgctctttaaaaaaatcgttttaaatctcttattacctgactttacctaggccaaacagccaatatttctggcttttgaacttttacaaaattaatctcccaggtgaaaccaataagtcataactaaggttatgacttaaccacgagtgatgaggtattttcaaagaggtagtaagcaatttttacaaaatctaaaatctccaaaaatagcttagagaaagaaaaattcaagatggatgtcagaagttgtttatggagagaaagagaatcaataaatggcaaaggtcacacagatatcaaaccagaaaggactgattccctgagccaagaattgaaaccaggttgccgttgtaaaaaggcaaaaccttagccactaagccacagtattgggtagtttccattgttcttcccagaaggagcctagagcagctgattttgaacttgcagaggcttttaactgctcaagataatttttagaactatgacatgaactctaaaattcctgccctccagatggtggagaccaaggaaagtactaccatgtggtaacaaggtcaagctcccaaggacataaaactagatgagagggaaacctcatctttatttatatatttatttatttatctttttttttaatgtttcaggaagctgcagcaaagtttgtaaatgaccagtttgctgggctggcttgaacttcgagcttttgggggtcctaggcctgcattctatccaatggtacccccacagaccaattggtagcacaaagtacaccaggtttgccatagtttaagactagtcacacatatccttgttttcattatttaaaactttgcagaggagactgatttttaccatttctacaactagttcacacacacacacacacacacacagaggccagaagtctgaggatacccttttggaggcatgtcaggcttctgggcttcctttcccttagtgttcctagcaaccctgctcactgcaccatagcctggggggcctaactttttctattttataaaaccataggtataggtgaatttaaaatgttctggttgagaattggtggagtttgtctaaagacctgggattcatagaaagggaatattcaggttaagataaaggttgtggagaccaaatttcttttgaagtcttatagtggctgccctgcccttagagacaatagatgacaaatgttttctattcagatttagttaatctctttacatttgggggggtctggaagaaaatgatccagctatattaatagagattctttacagatgtaaattctcccctacaaataacaggtttgcagggccatttcaagatatggcaaagaaatatgttttgggataaaatattttgattttcttccttgtctcataatgttatgccagagtcaggttggaaaataagtcatgacatacaagtttaaataaaacccttctgatgggaatttacgttttgtaggacatgactacccagaccctttagataggaatttggacaagataaaattagagtttagccctcaaacatttaaactggctataagccttttggctttaagtctgttggtcatagcagccccaccaaggaacagaatgattccagggcagggagctgcaccaccctgacaacagggacaaaattaaactttgacttttttgtttgtttgtttttctgggacagagtcttgctctgttgcttaggctggagtgcagtggcatgatcttaactccctacaacctctgcttcccgggttccaacatttctcctgcgtcagcctcccaagtagctgtgattacagatgcccaccaccacacctgactaattcttgtgttttttgtagagacagggttttgccatgttggccaggctggtcttgaactactggtctcaagagatccacctgcctcagcctcccaaagtgttgggattacaggtgtgagccactaagcccagccaaagtttgactattgatgttgccttgcaaatatttgccagaaagagcaggatgtaaaccacaaataaaattctaagttccccaactgactaagtggacctctcagccaaggaggaccaaacaaacctgaaacactagctcaggccatgatgggaagtgaggatagacatgcctcattgtacccttctatccttggacttgaggcccgagtaaacagtattaacattacaattataactgacataacagactctgtaacaataagaccagctccaacctgactgtggtataacttcacatgacaaataacaggccctaaaagaaaaagtattgtaagccaaaatatattactttgacatattttgaaatggccctgcatgtctgtctcttggggaaatttgcattctctaaagaatctccctccctcactaggtctctccagagagtctgacacctctgataagagatattcatatctattctctctgaaacctgctatctagaggcttcatctacaagagaagaaccttggattctgcaaccttccccccttaactgaagctgattccaactaggtgatactaatttacattgcaaacaatactgtttatgcattcacttttttctggatcctcaccaacattttttttttctttttaaattttaaaaatagccattcaaactggtgttaagatgatatcttactgcagcttaaatttgcatttctctgaagattagtgatgagcatcttttcataagcttgctgcccacttgtatgtcatcttttgataaatatctgattatgtcctttgcctactttttaatgttttttgttgttgttgttaagttccctatagatattagatattacttctttgtcaaatgcataatttgcaagtatttcctcccattgttcaggtagtctgtttgctgtggtaattatttcttttgctgtgcagaagctctttgtttaatataatcccatttgtgtattttttactgttgtttcattgacttagttataaattctttgcataggccaatgtcctgaagaggttttttaggttttcttttagaatttttatagtttccagtcttaaatttaagtctttaatccattttctgttaatttttgtatatggtgggtatagggattcagttttattcttctacacgtggctgtttaatttattttaggacaagttatatagattgttttttctatacatatgtacatatgagggccctggtctgttccattatcctatgggtataattctgtaccatcatcatgctgttttggttactacagtcttgtagtgtaatttgaaatcaggtaatagggtgccttcatctatgttatttttgcttaggctttttttttcattccatgtgaatcttaaattattttactaattctttgaaaaatgatggtaatagtttgaccagaatgcattgaatttgtatattgccttggacagtatggtcgttttaatgacattgattctttcaaatccatggttataggatattttttacatgtttgtttcatctatgatttctttcatcagtgttttgtctttgcctggagtgtagttctcctaacacagatcttccacctccttgactaaaatgaacttctaggtatttcatgtttgtgtggctattgtaaataagattgagtccttgatttggttttcagcttgaacattaatgatgtatagaaatgatacttctttttgcacatttattttgtatcctgaaacattactgaagtcatttatcaagtctaggagtttcttgtaggagtctttagggtttaccaggtataagatcaataagcaaacagagataatctgactttctcttttccaatttggatgccttttatttctttcccttgcttacttgcttagtctaggacttccagtagtatcttgaataggagtggtaaaatttggtatccatatcatgttccagttcttagggagaatgcttttaacttttgcccataaatatgatgtagggtgtgggttcagcatatgtgacatttttttgagaaatgttccttcaatggcttgttttttgagaatttttatcatgaagggatattggattttatccaatactttttctgcatctattgggatgatcttatggtttttcttcttagttctctgtgtggtgaatcacatttattgatttgcatatgttgaaccatccttgcatcccttttttttttaatttctgtgttaattttttttttgtttacccaaagatcattcagaaatggtgtttagtttccatatatttgtgtagttttgaggtttcctcttggtattgatttctaattttattcaaaattagaataagattactgtagtctgagaagatatctgatatgattttggtctttttaaatttggtttaaagttcattttaagtgaagactttccttgtggatttttatcctcgatgatttgtctactgctgtcaatgggtgttgaagtgccctgctattactgtattgctgtctatgtctttccttcagtctatttgtatgtggttaatgaacctaggtttccagtttggggtgtatatattttaagaatagttatatctttttgttgaattgttgaattgaatcctttatcattatgtaataaccacctttttttcccactgttcttaatttaacatctgtattatctgataaaagtacaactgcttctgctcattttcattttctgtttgcatggtacacctttatccaccccttgactttcagtctaagtgtgtttattcactaggtgattctcttcttggcagcaaatggatgaatcttgttgtcttacattcaatttgccattctctatcttttaagtggagcacttaggccatgtacattcaaggttttcattgatacttgagattttgttcctgtcatagtgttgttacctagtttcttcagagtctcaattgtgtcatcatattgttacctagtttctttggagtctcaaccacttcataggatttgtgaggtttgtactgatatgttttttaaaattttaacaattatttatttatatatttgtgtgagacattgtctcactctgtcacccaggctggagtgcagtggcatgatcttggctcactgcaacctccacctcctgggttcaagcgattctcctgcctcagtctcttgagtagctaagattacagacatgtgccaccacacctggctaatttttttttgtatttttagtagagatgtggtttcatcatgttggccagactgggctcaaacccctgacctcaaatgatccacccaccccagcctcccaaagcactgggattacaggccactgctcctggctaacaatgatttttgatgcagaggtacatgtgcttgatcattgcaagggtatattgcacccagttagtcagaatagtactcagtaggtagtttatcaatccatattcctctttcttcctcctcactctagtagtatatatattttattcccatgtttatgtctcagtgtggtgaatgtttagctttcactcataagtgagaacatgtggcattttattttctgtttctgtgttaatttgcttaagattatagcctccagttttatccatgttgctgataagaacatgattttattccttttatggttgtgtagtattccatggtgtatatggaccacaatttctttttttttgtttaattatactttaagttttagggtacatgtgcacattgtgcaggttagttacatatgtatacatgtgccatgctggtgcgctgcacccactaacttgtcatctagcattaggtacatctcccgatgctttccctcctccctccccacaccccacaacagtccacagagtgtgatattccccttcctgtgtccatgtgatctcattgttcaattcccacctatgagtgagaatatgccgtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgtcgtaataaacatacgtgtgcatgtgtctttatagcagcatgatttatagtcctttgggtatatacccaggaatgggatggctgggtcaaatggtatttccagttctagatccctgaggaatcgccacactgacttccacaatggttgaactagtttacagtcccaccaacagtgtaaaagtgttcctattactccacatcctctccagcacctgttgtgtcctgactttttaatgattgccattctaactggtgtgagatgatatctcattgtggttttgatttgcatttctctgaaggccagtgatggtgagcattttttcatgtgttttttggctgcataactgtcttcttttgagaagtgtctgttcatgtccttcgcccactttctgatggggttgtttgtttttttcttgtaaatttgttggagttcattgtagattctggatattagccttttttcagataagtaggttgtgacaattttctcccattttgtaggttgcctgttcactctgacggtagtttcttttgctgtgcagaagctctttagtttaattagatcccatttgtcaattttggcttttgttgccattgcttttggtgttttagacatgaagtccttgcctatgcctatgtcctgaatggtaatgcctaggttttcttcaagggtttttatggttttaggtctaacctttaagtctttaatccatcttgaattgattttcatataaggtgtaaggaagggatccagtttctgctttctacatatggctagccagttttcccagaaccatttattaaatagggactcctttccccattgcttgtttttgtcaggtttgtcaaagatcagatagttgtagatatgcggcattatttctgagggctctgttatgctccactgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagcagttttttccaattctgtgaagaaagtcattggtaacttgatgggggtggcattgaatctgtaaattaccttgggcagtatggccattttcacgatattgattcttcctacccatgagcatgaaatgttcttccatttgtttgtatcctcttttatttccttgagcagtggtttgtagttctccttgaagaggtccttcacataccttgtaagttggattcctaggtattttattctctttgaagcaattgtgaatgggagttcaccatgatttggctctctatctgtgtgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgaataccctttatttccttctcctgcctaattgccctggccagaacttccaacactatgttgaataggagtggtgagagagggcatccctgtcttgtgccagttttcaaagggaaagcttccagtttttgcccattcagtatgatatcggctgtgggtttgtcatagatagctcttattattttgaaatacatcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcctacttgatcatggtggataagctttttgatgtgctgctgaattcgttttgccagtattttattgataatttttgcatcgatgttcatcaaggatattggtctaacattctcttttttggttgtgtctctgcccggctttggtatcagaatgatgctggcctcataaaatgagttagggaggattccctctttttctattgattggaatagtttcagaaggaatggtaccaattcctccttgtacctctggtagaattcggctgtgaatccatctggtcctggactctttttggttggtaagctattgattattgccacaatttcagctcctgttattggtctattcagagattctacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcgtctatttgattcttctctgtttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaatcgtgatgttagggtgtcaattttggatctttcctgctttctcttgtgggcatttagtgctataaatttccctctacacactgctttggatgcatcccagagattctggtatgttgtgtctttgttctcgttggtttcaaagaacatctttatttctgccttcatttcgttatgtacccagcagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttcccagtacgtggtcaattttggaataggtgtggtgtggtgccgaagaaaatgtatattctgttgatttggggtggagagtcctgtagatgtctattaggtctgcttggtgcagagctgagttcaattcctgggtatccttgttgactttctgtctcattgatcggtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttattttccatttgcttggtagatcttcctccatccttttattttgagcctatgtgtgtctccgcacatgagatgggtttcctgaatacagaacactgatgggtcttgactctttatccaattttccagtctgtgtcttttaattggagcatttagtctatttacatttaaagttaatattgttatgtgtgaatttgatcctgtcattatgatgttagctggttattttgctcattatttgatgcagtttcttcctagtctcgatggtctttacattttggcatgattttgcagcggctggtacccgttgttcctttccatgtttagcgcttccttcaggagctcttttagggcaggcctggtggtgacaaaatctctcagcatttgcttgtctgtaaagtattttatttctccttcacttatgaagcttagtttggctagatatgaaattctgggttgaaaattcttttcttgaataatgttgaatattggcccttactctcttctggcttgtagagtgtctgctgagagatccgctgttagtctgatgggcttccctttgagggtaatccgacctttctctctggctgcccttaacattttttccttcatttcaactttggtgaatctgacaattatgtgtcttggagttgctcttctcgaggagtatctttgtggtgatctctgtatttcctgaatgtgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcacttcatttcattcatttcatcttccatcgctgataccctttcttccagttgattgcatcagctcctgaggcttctgcattcttcacatagttctcgagcttaggttttcggctccatcacctcctttaagcacttctctgtattggttattctagttatacattcttctaaaaatttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggtgctctgctttttagagtttccagtttttctgttctgttttttccccgtctttgtggttttatctacttttggtctttgatgatggtgatgtacagatgggtttttggtgtggatgtcctttctgtttgttagttttccttctaacagagaggaccctcagctgcaggtctgttggagtaccctaccatgtgaggtgtcagtgtgccctgctggggggtggctctcagttaggctgctcgggggtcaggggtcagggacccacttgaggaggcagtctgcctgttctcacatctccagctgcatgctgggagaaccactgctctcttcaaagctgtcagacggggacatttaagtctgcagaggttactgctgtctttttgtctgtctgtgccctgcccccagagatggagcctacagaggcaggcaggcctccttgagctgtggtgggctccacccagttcgagcttcctggctgctttgtttacctacgcaagcctgggcaatggtgggtgcccttcccccagcctcactgccaccttgcagtttgatctcagactgctgtgctagcaatcagcgagactctgtgggcgtaggaccctctgagccaggtgcgggatataatctcgtggtgcgccgttttttaagtccatgggaaaagcacagtattcgggtgggagtgacctgattttccaggtgccatccatcacccctttctttgactcagaaagggaactccctgaccccttgtgcttcccaagtgaggccatgcctcaccctgcttcggctcgtgcatggtgtgtgcacccactgacctgtgcccactgtctggcactccctagtgagatgaacccggtatctcagatggaaatgcagaaattacccgttttctgcgtcgctcatgctgggagctgtagaccggaggtgttcctatttggccatcttggctccttggatccacattttgtttatccaatctactgttgatgggtacttggtttgattttccatggctttgctattgtgaatagcacagtaataaacatatgagcacaagtaggttttggtataataacttattttcttttgggtatattcccagtaatgggattcctgggtctaatggtctctctgttttaaattatttgagatgtctcaaaactgcctttcccaccaacagtgcataaacattcccttttctccacagccccaccagcatctgttgttttttgagtttttggtaatagccatactgactggtgtgtgatggtatttattgtggttttgatttggatttgtcttatgattactgatgctgagcagttttttatatatttttggccacttgtatgtgctttatgatgttatgattcttttgtttccatgtttagaattcttttgagcatttcttgtagggttggtgtagtggtgacacattcacttaacatttgcctgactttgaaatactttatctctccttcatttggcaggatataaaatttggggctggcatttttgctttaagaaggcttaaataggtctttaatttactggtctgtagactgtctgctgagaaatctgctgttagtccaatgggatttactttatagatgatttgatgcttttctctacgtgctcttaagatttttttcatgttgactttggataggcagatgactgcatgccttggtgatgttcaccttgtaaagtatcttctagttattctctgagcatcttgcatttgcatgcctacatctttatcaagaccatgaaaactttcctaaagtgtctcctcaaatacgttttccaagcctttaacattttctccctcaggcatgcttataactggtgggtttggtcactttacgtaatcccatattttccaaaggctttgttcatttttgaaaattcttctcttatttttatgtgagtaggtgaatttgaaagaccactctttatgttctaaaattgtttcttgtgcttgatcctaggacagtgtgaaaacctttgactgtatttaacttttcattttcagaatttctgctttttcaaatttgtctttccttttacattttaaactgtttttggtgttttgattttttttaaaattttaacttttattttaaattcaggggtacatgtgcaggatgtgcaggtttgttatatagataaacatataccatgttggtttgctgcacagatcatcccaccactcaggtattaagcccagaatccattagctatttttcctaatcctctccctttttccaccccctgccctcctacaggttccagtgtgtccccctgcccaatgtgtttccatgtgttctcataatctatctcccacttagaagtgagaacatgcagtatttggttttctgttcccacattagattgctaaggacactcacctccagttccatccatgtctctgcaaaggacatgatctctttccttttatggctgcatagtatgccatggtgcatacttaacatattttcttcatttaatctgtcattgatgggcgtatatgtttcttccacacctttgctattgtgaatagtgcttcaatgaacgtgtgcgtgcatgtgtttttataatagaacaatttatattcctttgggtatatacccagtaatgggattgctggtttgaatggtatttttgcctctagacctttgaggaatccccacactgtcttttaaaatggttgaactaattcatactcccactatcagtggaaaatcatgcctttttcttcacaacctcaccagcatctgttgtttttttgacttttaaatcatagccattctgactggtgtgagattgtatctcactgtggttttgatttgcatttctctaataattagtgattttttttcatatgtttgttggccacatgtatgttttctttttttttttttttttttttttgagacggagtcttgctctgtcgcccaggctggagtgcagtgacgcaatctcggctcactgcaagctccgcctcccaggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgtatgttttcttttgagaagtgtctttgcccacttttgaatggggttgtatggtttttttctgataaatttgtttaagtttcttatagatcctggatattagacctttgtcagatgggtagattgcaaaattttttttcccattctgtaggtttcctgtttactctgttgatagtttcttttgttgtgcagaagctctttagtttaattagatcctatttttcaattttgcttttgttgcaattgcttttttgtcttcatcctgaagtctttgctcatgcctatttcctgaatgatattgcctaggttttcttctggagtttttacagtgtttggtttttcatttaagtctttaatattgagttgaatttgtatatggtggaaggaaatattacagtttcaattatctgcatatggctagccagttctcctagcactatttgttaaatagggaattctttccccattgcgcattcttgttaagtttgtcaaagatcagatggtggtaggtgtgtggtcttatttctgggttctttattctgttcttttggtctatgtgtctgttcttgtactagtaccatgctattttggttactgtagctctgtagtacagtttgcattcaggtagtttgatgcctcgagctcttttttttttttttctttttacttgggattgccttggttattcaggctcttttttggtttcatattaattttaaaatagttttttctaattctgtgaagaatgtcagtagtagtttaatgggaatagcattgaatctgtaaattgctttgggcagcatattagtctgtttacacactgccatatagaactacctgagacatagtaatttataaaaaaagaggtttaattgattcacagttatgcatggctggggaggccttaggagacttatgattatggcagaagctgaaggggaagcgaggcacatcttatctagtggcaggaggtagatagcaagggggagactggccatacacttttaaaccattagaccttgttagaactcactatcatgagaacagcatgggaaaaaccactctcatgatccagttacttcctactaggtccctttcttggcatgtgggaattacaactggacatgagatttgggtggggacatagagccaaaccttattatttaactcctggattctcctaaatctcatgtccttctcatgttttgaaaccaatcacaccttccaaacagtcccccagcctcttaatttattccaacattaactcaaacgttcaagcccaaagtctcatgtgacactatgcaagttcctatcacctatgagcctgtaaaataaaaaaaatttagtgatttcttagatacaatgggagtacaagcattgggtaaatgctcccattccaaatgcaagaaattggccaaaacaaagaagttacaggccccatgcaatccagaacccagcagggcagtcattaaatcttaaaactccaaaataatctccttcaactccatgtctcacatgcaggccacactgacacaatgcatggccttctaaggccttgggcagatcctccccagtgattccacagggtagagcccctgtggctgctttcttgggctagcattgagtgcctgtggcttttccaggtgcatggtgcaagctctcagtggatctatcatcctaggttctggagcatggtggccctcttctcatggctccaccaggcagtgccccagtgggcactctgtgtggggccttcaaccccacatttcccctctgcactgccctagtagaggttctccatgacggctttgcccctgcagcagacttctgcctggacatccaggcgtttccatacatcctctgaaatctaggcataggctcccaaactgttgccttctgtgcacccacaggctcaacagcatgtagaagccaccaagacttgggacttgcatcctctgaaactactgtctgagctgtaccttggcctcttttagtcacagctggagctggagcagctgggacacagggcaccatatcccaaagctgcacagaccagcaaggtcctcggcccagcccacaaaagtatttttctctcctaagccttcaggcctttgatgggagtggctgccataaagatctttgaaatgccctggagacattttccccattttcttggttattaacattcaccttctctttacttatggaaatttctacaggcagcagcttgaatatttccccagaaaatccatttttgttttctaacacatggtcaggttgcaagttttccaaacttttatgctgttttcctttaaaacataagttccaatttcagaccatccctgtgaacacacatgactgtacacattcagaaacagccaggtaatgtcttgaatgatttgctgagctgcttagaaatttcttcttcaatgggcaccatggatcatgcctgtaatttcagcactttgggaggccaaggtggggatgacttgaggtcaggaatttgagaacagtctggtcaacatggtgaaaccccatctttacaaatcatacaaaaattagctgggtgtggtttcatgtgcctgtatttccagctactcaggaggctgagacatgagaattgcttgaatccaggaagcagaggttgcagtgggccatgatcacaccactgtactctagcctgggtgacagagcagaactctctcagaaaaaaaatttgttctgcaagataccctaaatcatctctctgaagttcaaagttccacagttctctagtttaggggcaaaatgctgccagtctctttgcttaagcatagcaagagtgacctttactttacatcccaataagctcctcacttccatctgagttcacctcagcctggacttcattgtccatatcactatcagtattttggtcaaatccattcaaaagtttgtaggaagtcccaaactttccccaatattcctgtcttcttttgagccttccaaactgctccaacctctgctcattacccagtttctatgttgcttccacatgttcaggtacctttatagcagtgccttactcccagtatcacttttttgtattagtctgctttcacacagctataaagaactacctgagcctgggtaattcataaagaaaagatgttttgttgactcgcagtgacacacatctggggaagcctcaagaaatgtacaatcgtggcagaaggtgaagagaagcaaggcacattttacacagtggcaagagagtgaggggggaactgccacacacgtttagtccatcagatctcatgagaactcagtatcatgcaaacagcatgcgggggtgcgggttgctcccatgataaaattaccttgcaccaagttccaatctccatgtagggattacaattcgatttgagatttgggcatgaacatagagccaaaccatatcaggtagtatggccattttgatgatattgattctttatccatgagcatgaaatgtttttccactcgtttgtgtcctctctggttttcttgagtagtgttttgtagttcctgaagaggttcttcacttttcttgttagctgtattcttaggtattttcttgtgtggcagttgtgaaggagaattcatttactatttggctcttggcttgcctcttggtgtataggaatgctggtgatttttgtacattgattttgagttctgagactctgctgaagtggcttttcagtttcttctgtgaagttattgggctgatatgatggggttctgttgaaataggaatagaatcatgtcatctgcaaacaaagatagtttgacttcttctctttttatttgaatatgcttaatttctttcttttgcttgattgccctggccagaacttccaatactgtgttgaataggagtggtgagagagggaaactttctcttatgccaattttcaagggaaatgcttcttctttttcttcttcttcttcttcttcttcttcttcttcttcttcttcttcttcttcttcttcttcttcttcttcttcttcttcttttttttgagacagagatttgttcttgttgcccaggctggagtacaatggtgctatctcagctcactgaaacctctgcctccagggttcaggagattctcctgcctcagcatcctggtgttttgggtagctgggattacaggcatgaggcaccatgcctggctaattttgtatttttagtacagatggggtttctccatgttggtcaggctggtctcaaactcttgacctcaggtgatccacccacctcggcctcccaaaatgctgggattacaggcccgagccactgcacctggccctcaaggcgtcaagatagaataagcttctatcttttgcttattcaacatgatatttgctgtgtgtttgtcatatatggcttttattattttgaggtttgttctttcaatacctgtttattgagagtttttaaaatgaaaggatgttgaattttgtcaatggcattttatgcccctattgagataatcatgtggttttgtctctagttctgtttatgtgatgaatcacatttgatttgcatgtgttgagccagccttgcatcctgggaataacttctgcctgattatgtgttgcgggaagtcagggaccccaaacagagagactggctgaagccatggcagaagaacataaattgtgaatatttcatggacattgattagttcctcaaattaatacttttataatttcttacacctgtctttactgcaatctctgaacataaattgtgaagatttcatggacatttatcccttccccaatccatactcttgtgatttcctatgcctgtctttactttaatctcttaatcctgacatctttgtaagctgagtatgaatgatgcctcaggatcctgtgatgattgcgttaactgcacaaattgtttgtagagcacgtgtatttgaatgatatgaaatctgtgcaccttaagaacaggataaccacgattttcagggaacaagggagatgaccttaaagtctggctgcctgtgggcaggaaggacagagccatatttctcttactaccaaaaatgggtaagataaatgtcactgaactctttccccagtaaggaatattaataattaacagccctgggaaaagaatgcattcacagaggaggcctctgaagtggccgctctgggggtgtctgctttatgcagatgtagatagggatgaaacatgccctcgtctcctgcagtgcccccaggcttgctaggattaggaaattccagcctggtgaattctagtcagaccagttctctgctcttgaagcctgacaatgcgtgcacagtgggacatagaagttcattagtgattctagtttcaccctgaccttctgccttgtgatcttttgttgcccttgaagcatgtgatctctgtgacccacaccctatttgtgcactccctcccctttgaaaattcctaataaaaacttgctggttttacagctcaggggcatcatggaacctaccgacatgtgatgtctccctgggcccccagctttaaaatttctccttttgtactctgtccctttatttctcagactggctgacaattagggaaaatagaatagaacctacatgaaatattgggggtgaattttgcccaataattatggtggataggctttttgctgtggtggataagctttttgctgtgctgatggattcagtttgccagtattttgttggggatttttgcattgatgttcatcaagaatattggactgaagttttcttttcttgctatatctctgccagggtttggtatgttggcctcatagaatgagttatggaggagtccctcctttttaatgttttggaatagtttcagtaggaatggtaccagctcttctttgtacctctggtagtattaagctgtgaattcgtctgttcctgggctttgtttttggtttgtagagtattttttactgtctcaagttcataactcattattggtctattcaggattcagtttctccgtgcttcagtcttcagagcatgtatgtgtccagcattttatccatttcttctcaattttctagtttatgtgcatagaggtttttgtagtattctctgatatttgtatttctttggggtcagtggtgatacacttcttattatttctggttttgtctacttgaatttttctctcttttcttcattagtctagctagtagtctctattttaataatttttttcaaaaagccaacttctggatatgctgatttttgttaagggtttttcgtgtctctatctctttctgttctgccctgatcttgactacttcttgccttctgctagctgaggggtttgtttgctcttggttctctagttattttagttgttatttatgttattaacttgagatctttctagctgtttgatatgggcattttagtgctacaactttccctcttaacactgctttagctgcatcaaggagattcccagatgtgttgtatattctcattagtttgaaagaacttcttgatttctgccttaagtttattatttactcattcagaagcaggtggttcaacttccatgtagttatatggttttgcatgtatttcttaatcttgagttctaatttgattgtgctgttctctgagagactgtttattattatttcagttcttttgcatttgctgaggagtgttttactttcaattatatggtcaattttatactaagtgccaagtggtgatgagaaggatgtatattctgttgtttgggtgtggtgagttctgtacctatcaggttcacttgattcagagctgagttcaggccctgaatatgtttcttaattttctgtcttgatgatctgtctaatattgtcagtggggtgttaaagtctctcactattattgcctgggagtctaagtctgtttgtaggtctctaagaacttgttttatgaatctgggtgctcttgtactgggttcatagatattccagatagttagctcttcttgttgaattgagccctttaccattatgtgatgcccttctctgccttttggatctttgtttgtttaaagtctgttttttcagaaactaggattgcaacacctgctttttgtttggtaaattttcctccatccctttattttgagcttatgtgtgtctttgcacatgggatgggtctctggaaggcagcataccatttgttcttggttttttatacagcttgctattctgtgtcttttaattggggcatttagcccatttacatttaaggttagaattattatttgtggatttgatcctgtcatcatgatcctgcctggttattttgtagacctgtttatgtggtctacagtgtcacttcatagtgacactggtctgtgtacttcagtgtgtttttatagtggctggtaatggtttttcctttccatattcagtgctttcttcaggagctcttgtaagtcaggtctgctggtaacgaattacctcagcattagtttgtttgaaaaggatcttatatcttctttgcttataaagcttagtttggccagatatgaaattctgggttggaaattcttttaagagtgctgaatagtggccttcaatctattctggcctttaaggtttctgctgagaggtccactatttgtctgctgggcttccctctgtaggcgatgtggcctttctctctggctgccctgagcattttttccttcatgtggaccttggagaatctgctgattatgtgtcttgaggacgatttttttttgtggattatcttactggggttctctgcatttttgaaatttgaatgttggcctgtctaggtagatcagggaagttctcctcgatggtatcccgaaatgttttccaaattggttttactctcctcatctctttcatgtacctcagtcagttgtagattcagtctctacataaccccatatttctgtgaagttttgttcattcctttgttctttgtttttattcttgcctgcctgtcttatttcagaaggtcagtcttcaagctctgagattcttccctttgtatggtgtattctgctactagtacttgtgattgcattatggagtttgttagtgtgtttttccgctctatcaggtcagttatgtttctctctatgctggctatcagctcttgcattattttatcaagattcctagcttccttacaaggggttgcaagtggcttttttagctcagtgcagttcatttttacccacattggaagcctacttgtgtcatttcagctatttctagcctcagtccagttctgaatccttgctggagaggtggtgttgtggccatttggagaaaagggggcactctgggtttttgaatttttattatttttgcactgattctttctcatctttgtggacttatctacctttgatctttgaggttcctgatcttaggttttttttttttttttttggatgtttatttgcttgggtgcttttctttcagcagtctggccactgtttcataggggtgctgcagtttgttggggttccattctagacccttgttgcctcagtttttccagtacctggaagtatcaccagagaaggctgtgaaacagcaaagatggcatcctgctccttcctctggtagcttcattccagggggcctgaatgcacctataggagttggctggagacctgggttggaatacctcacccagtcagagggaaagggatcggagacaaacttgaagacgcagtctggctgaattttgtagagcagctgtgctgtattggggatcccttcagcctcccagttggtttggatcctttaaggttcacaggttggaccagctcagatgcccaaataggaaaggtggtggcctgcttcacccatcaggcactccatcccagggataaattagaactttgtttgcaatagaacatgagcagtggtgaccagaggctttggctgggagagccagcaaggaggaatggatctgagtcctgttgaaagaagcagtctggccacttctcaacaaaacagctatatcatgctgtggaattgctttttgccttgtctgcttatactctccaaagcccacaggcttgaagggctgagtcatccaaacagcaaagatgatgacccacccctccccacaagcactttttggcagaaagatatcagaacgctgtccatagtatacaggtgagggtggccagaggccttggctaggaggactgaccttgtgagaaggagtagatcagggacccatttaaagaagcagtctggccatgcctcaacaaaacagtcatgacaggctgtggaaccacctttgccctgttggtgttggactctccctaggcctaaggctggaatggctgagttgtccaaacaaccaaggtggcagcccatcccaaggagagatcagaactctgtctatagaatatgagtgggagggggtggctggagacccaagttgggaggtctcacccagtgaggaagaatggattgaggtttcacttaagcagtctggccacgttctggcaaagcagctgtgctgcactgtgaggaccttttctcatttgtaccatctggactctccaaatcctgctggctggaacagctgggttgaccaaacagcaaagatgatagtgtgccccttgtcttgggggttccatcccatctcaggcaggctccaccctgtttttagtggctggctggaattccaagccaatgggtcttatcttgtgacatgccatggaagtggggcccgcagactgctgctgctcagctccttcaattctgcccccttcctatgggtatgtacggacctttgaccttgcctgagttgcagtcacctttgtcagggatcctgggctcagagtctataaagctcctgggtttctgtgcatgcctgagcagttgctctgccaagactccacacagctgtgtgttggacccaaggcccctgtagtgtgggctcacaaggtaatctgctgattggagggttgcaaagatctgggggagaagtgtggtttccctggggttgcacattgactcactgcttttcttggctgggggtgaggggctccctttccaaattgttaatctgatttctttgtggtggttttcaactctcttgtatctcattgggctttcttacaagccatagtttgccatttgtggaattggtggaatttgtcctttcagaatttttattttgtttaggacccatgtctagaccgctagtgtgatccttatgggtgctgcaacactctgttttttgtgatgccacagttcttattctgattttttttgaatttacttctgttcagatggggattttaccccccgagggtttatttcatatgttgagtagcattttttttggctttgcttctttatgctattagggggcaaagctttgtttgaattccttggtagtagatagcctttgtgtagtggtgttctcaaatgccggttgtttgtagcatgtagtagtggtgtactatgcatgtgagtaggcttgctgtcttctgcagagatgggtaggaggctcatcattttttacagcagtgtgaacttctgtcagcaggaattattttaaattctgccgtccatcctatagaccagtaggtggcacttgtaagagctagctgaatgctgcacagatgtgtcagcataagctgtaatcatttttgcagactggcatcaaagtcagtaggttgtacttgcaagaaagaggcagcttcagtggtggcagtgagatttttacttggccatttaaaaccaggagaagtgccagggtatctcagtgatgggcagggctgtggagctcctggggatccctgtccggttctttgctaccaaggtgactagagtgggcaatgctggtcatggctgggttggtatgtcagtgagcaggctcttgaaggcaggcataagtaccaacgtttgcagcagtctaggcacagctcccaggctgctggagcaactcttaagggaggaatagaggtgtctgtccaccacagagcctactgaggtgaagaagggcatggcccagagtgttcagcatagtaggtggctgtgggatccacctaattcccacacccctgacctgaaagttctccctccaggcgctagctgctgccagaatgccagaatgcttagactggtcccaaagagtctacattcagattgttgaacagttccagaaactgtagctatgaggccacaccctctcaggactagtcttgtgatgaaaggcgggcccagctcctatgccacagcatacattcacacaacagtcttctctgtgttctgtcagtgggaattcctcccctgttggaggtcacataacaaatctcatcttcatgcacctgagtgattgtgttgagtcctggggaactgggataaggtcagtaggtttttcccctggccactcaggctgtagcacctgctgtgatcagaaggggtaaacagcttccaggccaccaaaagaacactcaggtgtggcaacagcaactgtgccacatatctcaacttcctgtgagaatgggaaggcaggcagtcttgggatgaactggcaggcatgggatgtgtggcttgaatgtacttcattcccaacacaatggtggtggaacctgtttagggagcaagagagtgccttgggccccactcattccctggcctgacaggcaacagcagcatcacctcaaaataggatgcaaagccttcagggatgggcaccaaaattgtgctttgctacagcagcccagcacatggaagtccttcatgttttgtttaaatgcatacatttgtttgagggatggagaaggtgtacttatatacctcagcatgtttcatttttctttttatcatgcaaggagttgatttggttcaggcaaatattcattgaagtttaaaatgtacatacctcaccatgcagtaaacacctgtttaatgtctgacctgctcagatttcatttacttgtactgataatgcttttttgttttatttattcataacattttacatatttatcaggtacttgtgattgttacatgcatagaatgtattatcaagccaggagtatttgaggtatccatcaacttgagtgtttgtcatttttgtgttggtaccatttcaagtcttctagctactttgaaatatactctgctatctgaagtcacccaactctgctatcaaacattagaatttatttcttctaactgtatgtttgtatccattaaccagcctctcttcatcctcccttctaccctcacatcttcccagcctcaggtagttatcattctctgtcttcatgagatcaacttttttagctcctccaaatgagtgagaacatacaagatttgtctttctctgcctggcatgtttcacttagcatggtaacctccaggtacatccatgtcattgtaaatgacatcttatttcttcaattactgaataataatccataatgcatatataccacattttctttatctgttttattgatacttctgttgatttcatagctttgctgttgtgaagagtgctataaacaattgagtgctggtatctcttggatatactgttttcttctcttatggataaataccccatagtgggattgctagattgtatgatagttctacttatagcttttaaataaatgtttacgctgtttttcatagtagttgtactaatttacattcccacaaactgtgtaataagcattccctttatccgcatccttgccagtatctgtttttgtttgttgttgtttttgcttgttttgtctttctaatcattttagctggggtaagatgatgtctcattgtggtttcaatttgcatttccctgatgattagtgatgttgagcgttttctatgtaactattggtcattagtatgttttcttttgataattatttatttatttatttattacttttgattatgaatcctcctggaacttgattctttaaaaatttattattattatactttaagttttagggtacatgtacacaatgtgcaggttagttacatatgcatacatgtgtcatgctggtgcactgcacccactaactcgtcatctagcattaggtatatctcccaatgcttcccctccccactccccccaccccacaacagtccccagagtgtgatgttccccttcctgtgtccatgtgttctcattgttcaattcccacctatgagtgagaatatgtggtgtttggttttttgttcttgcgatagtttactgagaatgatgttttccaatttcatccatgtccctacaaaggacatgaattcatccttttttatggctgcatagtattccatggtgtattgtgccacattttcctaatccagtctatcattgttggacatttgggttgcttccaagtctttgctattgtgaataatgccgcaataaacatacgtgtgcatgtgtctttatagcagcatgatttatagtcctttgggtacatacccagtaatgggatggctgggtcaaatggtatttctagttctagatacctaaggaatcaccacactggcttccataagggttgaactagtttacagtcccaccaacggtgtaaaagtgttcctatttctccacatcctctccagcacctgttgtttcctgactttttaatgattgccattctaactggtgtgagatggtatctcattgtggttttgatttgcatttctctgaaggccagtgatggtgagcattttttcatgtgttttttggctgcataaatgtcttcttttgagaagtgtctgttcatgtccttcacccactttttgatggggttgtttgttttttttcttgtaaacttgtttgagttcattgtagattctggatattagccctttgtcagatgagtaggttgtgacaattttctcccattttgtaagttgcctgttcactctgatggtagtttcttttgctgtgcagaagctctttagtttaattagatcccatttgtcaattttggcttttgttgccattgcttttggtgttttagacatgaagtccttgcctatgcctatgtcctgaatggtaatgtctaggttttcttctagggtttttatggttttaggtctaacgtttaagtctttaatccatcttgaattgatttttgtataaggtgtaaggaagggatccagtttcagctttctacatatgactagccagttttcccagcaccatttattaaatagggaatcctttccctattgcttgtttttgtcaggtttgtcaaagatcagatagttgtagatatgcagtgttatttctgagggctctgttctgttccattgatctatatctctgttttactaccagtaccatgctgttttggttactgtagccttgtagtatagtttgaagtcaggtagtgtgatgcctccagctttgttcttttggcttaggattgacttggagatgtgggcttttttttggtttcatatgaactttaaagtagtttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttacttccttgagcagtggtttgtagatctccctgaagaggtccttcacatcccttgtaagttggattcctaggtattttattctctttgaagcaattgtgaatgggagttcactcatgatttggctgtcggtctgtctgttgttggtgtataagaatgcttgtgatttctgtacattgattttgtatcctgagactttgctgaagttgcttatcagcttaaggagattttgagctgagacaatggggttttctagatatacaatcatgtcgtctgcaaacagggacaatttgacttcctcttttcctaattgaataccctttatttccttttcctgcctaattgccctggccagaacttccaacactatgttgaataggagtagtgagagagggcattcgtgtcttctaccagttttcaaagggaatgcttccagtttttgcacattcagtatgatatcggctgtgggtttgtcatagacagctcttattattttgagatacgtcctatcaatacctaatttattgagagtttttagcatgaagtgttgttgaattttgtcaaaggccttttctgcatctattgagataatcatgtggtttttgtctttggttctctttatatgctggattacatttactcatttgcgtgtattgaaccagtcttgcatcccagggatgaagcccacttgatcatggtggataagcttttggatgtgctgctggatttggtttgccagtattttagtgaggttttttacatcaatattcatcaaggatattggtctaaaattctcttttttggttgtgtctccacctggctttggtatcaggatgatgctggcctcatgaaatgagttagggagggttccctctttttctattgattggaatagtttcagaaggaatggtaccagttcctccgtgtacctctggtagaatttggctgtgaatccatctggtcctggactctttttggttggtaagctattgattattgccataatttcagctcctgttattggtctattcagagattcgacttcttcctggtttagtcttgggagagtgtatgtgtcgaggaatttatccatttcttctagattttctagtttatttgcgtagaggtgtttgtagtattctctgatggtagtttgtatttctgtgggatcggtgttgatatcccctttatcattttttattgcgtctatttgattcttctctgttttcttctttattagtcttgctagaggtctatcaattttgttgatcctttcaaaaaaccagctcctggattcattaatttttggaagggttttttgtgcctctatttccttcagttctgctctgattttagttatttcttgccttctgctagcttttgaaagtgtttgctcttgcttttctagttcttttaattgtgatgttagggtgtcaattttggatctttcctgctttctcttgtgggcatttagtgctttaaatttccctctatacactgctttgaatgggtcccggagattctggtatgttgtgtctttgttctcgttggtttcaaagaacatctttatttctgcctttatttcgttatgtacccagcagtcattcaggagcaggttgttcagtttccatgtagttgagtggttttgagtgagattcttaatcctgagttctagtttgactgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggggagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtgtctttctatgtcactcaggacttgcttttcgaatctgggtgctccagtattgggtgcatatatatttagcatagttagctcttcttgttgaatggatccctttaccattatgtaatggccttctttgtctcttttgatctttgttggtttaaagtctgttttatctgagactaggattgccacccctgcctttttttgttttccgtttgcttggtagatctacctccatccttttattttgagcctatgtgtgtctccgcacgtgagatgggtttcctgaatacagcacactgatggttcttgactccttatccaattttccagtctgtgtcttttagttggagcatttagtccatttacatttaaaattaatattgttatgtgtgaatttgatcctgtcattatgatgttagctggttattttgctcgttatttggtgcagtttcttcctagtctcgatggtctttacattttggcatgattttgcagtggcatgtaccggttgttcctttccatgttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcctccactctcttctggcttgtagagtttctgccgagagatccgctgttagtctgatgggcttccctttgtgggtaacccgacctttctctttggctgcccttaacattttttccttcatttcaactttggtgaatctgacaattatgtgtcttggagttgctcttctcgaggagtatctttgtggtgatctctgtatttcctgaatgtgaatgttggccttccttgctagattggggaagttctcctggataatatccttcagagtgttttccaacttggttccattctccctgtcactttcaggtacaccaatcagacgtagatttggtcttttcacatagtcccatatttcttgaaggctttgctcgtttctttttattcttttttctctaaacttcccttctcgcttcatttcattcatttcatcttccattactgatatcctttcttccagttgatcacatcggctcctgaggcttctgcattcttcacgtagttctcaagccttggttttcagctccatcagctcctttaaggccttctctgtattggttattctagttatacattcttctaaacttttttcaaagttttcaacttctttgcctttggtttgaatttcctcccgtagctcagagtaatttgatcatctgaagccttcttctctcagctcgtcaaagtcattctgcttccagctttgttccgttgctggtgaggaactgcgttcctttggaggaggagaggcgctctgctttttagagtttccagtttttctgctctattttttctccatctttgtggttttatctacttttggtctttgatgatggtgatgtacagatgggtttttggtgtggatgtcctttctgtttgttagttttcctctaacagagaggaccctcagctgcaggtctgttgaagtatccggccatgtgaggtgtcagtctgcccctgctggggggtgcctcccagttaggctgctcggggttctggggtcagggacccacttgaggaggcagtctgcccattctcagatctccagctgcatgctgcgaggaccactgctctcttcaaagctgtcagatagggacatttaattctgcagaggttactgctgtcttttcgtttgtctgtgccctgcccccagaggtcgataattatttattaatgtccttagcccacttttagataggattttttaaaattgttgagttccttgtatattctggatattagtgccttatttgatgaatagttttaaaatattttcttccattcaacaggctgtctcttccatctattgattgtttcttttgctgtgctgtgattgtttcttttcggtttctttgtatcatctataatttctttcatcaatgttttacagtgttttcttgtagagatctttcacgtccttcattaaatatagtcctcggtattttatgttttgtttctattgtaaagaggattgagttattgacttggttttcagtttgaccattattggtgtatagaaatggtactgattttttgtatttttgtatgttaattttgctgtatcttgtaactttactgaatttgctctcagctcttagagggttctttttggtgaagttctttggtttttctaaatataagtttatgtcatctgcaaagagggatgagaaaggtttaattgaaaaagcttatccccatcttggaaatttatggagccattaacggtgggctttttgcagctgtgacatgttagctacaactctcattggaaaatgggaaaggcttttctgacccataagggctgtctgatacatgaagataaaaacctaatgtttggccactttgttgttgtttcttgttctgttgttaattttagggaatttatttatttatttatttatttagtgtgtgttatagcagtgatttattttattattattattattattattaatattattattttttatttttttattgatcattcttgggtgtctctcccagagggggatttggcagggtcataggacaatagtggagggaaggtcagcagataaacaagtgaacaaaggtctctggttttcctaggcagtggaccctgtggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacgggatcccaaggcagaagaatttttcttagtacagaacaaaatgaaaagtctcccatgtctacttctttctacacagacacggcaaccatccgatttctcaatcttttccccacctttcccccctttccactccacaaaaccgccattgtcatcatggcccattctcaatgagctgttgggtacacctcccagacggggtggtggccaggcagaggggctcctcacttcccaggagggacggccgggcagaggtgcccctcacctcccagacggggcggctggccgggtggggggctgacccccccacctccctcccggacggggcagctggccgggcggggggctgacccccccacctccctcccggacggggtggctggccgggcagaggggctcctcacttcccagtagggacggccaggcagaggcgaccctcgcctcccggatggggcagctggccgggtgggggctgacccccccacctccctcccggatggggcggctggctgggtgggggggctgaccccccacctccctcccggacggggtggctggccgagcgtggggctgaccccccccacctccctcccggacagggcggctggctgggcggggggctgacccccccacctcactcccagattgggcggctgccgggcagggtgctgacccccccacctccctcccggacggggcggctggccgggtggggggctgacccccacctccctcccggacggggtggctgcagggtggagatgctcctcacttcccagaaggggtggctgccgggcggaggggctcctcacttcttagatggggcagttgccaggcagtgggtctcctcacttctcagacggggcagctgggcagagatgctcctcacctcccagatggggtcacggccgggcagaggcgctcctcacatcccagatggggcggcggggcagaggcgctccccacatctcagacgatgggcggccggacagagatgctcctcacttcctagatgggatggcggccaagcagagacgctcctcacttcccagactgggcagccaggcagaggggctcctcacatcccagacgatgggcagccaggcagagacactcctcacttcccggacggggtggcggccgggcagaggctggactctcagcactttgggaggccaaggcaggctgctgggaggtggaggttgtagcgagctgagaccacgccactgcactccagcctgagcaccattgagcactgagtgaaccagactccgtctgcaatccctgcacctcgggaggccgaggctggcggatcactcgtggttaggagatggcgaccagcccggccaacacagcgaatccccgtctccaccaaaaaaatacgaaaaccagtcaggcgtggtggtgggcgcctgcaattgcaggcacttggcaggctgaggcaggagaatcaggcaaggaggttgcagtgagctgagatggcagcagtacagtccagcttcagctcggcatcagagggagaccgtggaaagagagggagagggagactgtggggagagggagagggagagggagagggagagcaattttagggaatttattaagcttcataaatttatgggataaatggaggcccctaggttaggggtgatgccactgtgagattcagagtcacttcagtgtaaggaggctgcagcagtgtttagaaagtgtgtcataattatagccatattttgacttctggaggcaagggcaggaagtgtggcttttccctgacatacagttgccaggtaggcagttatttggttgcataaataattgtaattttatggaaaaattttggagattgaaaatagaaattaaaattactccaccattcaaaagcaattgttattaccatgtttgtataatttactttagagtttaaaattttcatgtatatatatttttaacttacaatgtagattaaataaatagagatgaggttttgccacattgcccaggctggtcttgaactcctgggctgaagctatcctcccacctcagcctcccaaattgctaggattaaagacatgatttattgtgcctggcctcatgtatattatggaaactgttaagattattttacatgagagctttatatttgcttaaggtttgaaaggcttcagagtttatgtaggaagttacagacaatgtttctgttcatgtatcaaaagaaaaataatattcagagactgaagtttttctagggcagtgccacaagggttcatgtccttagaagttagcagtggcctatctaggacagtgtaattgtggtgattgttttttgttttgttttccctattatctcttatccctggaaaacatctttcagcattaggcaatgtgctatttgacattgatcagtcccttaatttatggccacttttcctgcaggtttttatgcagccagtgttaaacagctgctggtcttaagctaaaggtgggaaggtcatggcacgcagtgtgggctggatttagaatatgaattgctacagttttattttgaagaacatagagcatcagtagatgatgggcatttagggcctccataaagactgcagctgaggaaaagattcacttataagtacaggagcatcatgttgggaggggtcaagttaattattgaccacagcttttacaatctgctttatcaaccagggctgcaggctgggaacttagtacagctaaattttatgtataaagaactagtgtgtaagtgggatttatgttatgtgtgcagaggtaggctggcactcactttttgcactatttttggctgaattaagggcctaaagatgggctaattcatggatatacatggcttccacataggcttttaaaagccactccccactctgtagtttcaagttggccatggatttgttaatcaaagtcaactgtgatcttagtactagaccattctgagacatacaatgcacccttgtccacagaagggtggtagaattttattaacaatcttgcaaaaagacatgagacttattattaaaaatggtccctttttgggttgaagtagaaaaacacctcagtgaagccattaccacaccaaagtctagaaagccggtgcctggaggactacatctcaagaatcagctttgctgaggaagccagagatgagtttgaagagtatgcttcaacccttctataagaacaagtgcaacagaatattgagaataacagaataagacatttaggaatatttaactgaaggaagcaaaggatttccttatgagaaaggttgaggttttattggttaaaatcaacagatgtgaaggggaagcaagaactgtaaggacagacaaatgtagatggtctacctgttctcagaaggttttagaaaatgcgttgtgctttcattgttgctatatcagaaagaaagaccggagcctgacaaaatttagagaggaagcaaggcaggatctcataaagtagagtgatccctgagagggtgtgcccaaatgctgcagactctctcataagtgttaggagaaaccaattctccaagcatatattgggacaacagtatgacttgatccagaatgttaggacaaatttgagggggaaaggtggggcagaacagagaaaaactcaaaacataggaggtgacttaactattatgtactgtattaaaagtattatatgctgttccttgaagaaacatccccaagcaatttttggttaggactcaaggtaaagcacagaaaagatgagttatattggagggatgtagacagaagaactataatatgtactgagcccattatagatgttgagtgatggaagggtatcttctgggatggataatcttcctaggagcctggatgtacacaaaatatgtttaaacagcagatatttttggcagacccagaacctgatgttttcatgtatctcaccatggaaaactctataaccacaatctaacagaatacactagtaaaatgtccgggcctgagagcaatgccaaagtaaaaagaaagaactcggatcttacaaacattgtgatcctacttggcagaagaaaagaaacctctgaggtaggttaatcagctaagtcttcttgaaactattagaggggaaaatgaaaacacttgaggcatatagcataaaagacatagcatacagaaatattcagagctggtagcatcctaaaccagaggaaatgtcatttcttggggagtaatcatgagggaaattttttccgtgagggtgctaggggtgcaattcaccagaaacagctttatttaaggaagttgctgaaggtgattctctagctggaacacttctagggactgagggacaggaggatcttcactgggaggcaggtttcacaggtccaaacaattctgtagtgagtgacagcagccactgtggctcaggaccaaaactaccagttcctgggatacagtgttagctacctggccagatggagtccactcttagtatagcattagaagggtactcagtggggagattgagactaaaaggctgagaaaatactgaatgggaagaacttctcagtagtacctgatgcccagtgagtggggtggggggtgatttcattgcaaattttagagattaaaaagccaggagtatctcagatgacaataattgggaaagaagataagcgaataagcctttaacccactctggtgccatagttatgataaatcccatatggtcaaatttaatctcttatgacaggtttctctcaatgtaagggttttttttttaatgtgatataatctatataacgtaaaattcactgtttaaaagtgtagaattcagtgatttccagcatattaactatgtagtgcaaccatcactattgtctcactctagagtatttctgccacccccccaaaaaaaaccctgtaccaattagcagtgagtcccaatttttcccttctctcatctcctaatgaccagaaatctgctttttgcatctacaaatttacatagtctggatagttcatgtcaattgaatcacgttatatgtagccttttgtgactggcttctttccattagcacagtgttttcaagattcatctatattgtatcacatagcaatattcatttctttttatagctgaatatgttttggatatataccacattttattcatttatgcatcagttgatgggcattacattgtttcagttttttagcaattatgcataatgctgctgtgaacttttctgtacaactctaatggatttttagggtaatgctcatataccccagacaagcatctcctgtagagatcttttacctccttgggcagatgtattcctaggtttttatttgttttattgtttgttttggctataagtgggattgcattcttgatttggttctcagcttgaatgttgatggtgtatggaaataatactgatttttatatgtagattttgtatcctgaaacttcaccacatcatttgtcaagcctaggagtcttttggagaaatcctttgggttttctatgtacagaattatatgttcagtgaagagagatagtttgacttctttttctatttggatgccttttatttctttctcttggctgattgctgtggttaggatttccagtactacattgaataggagtggtgtaagtggacattcttgtttattccagttctaagagggaatgtttctaaatttgtcttttcattatgatgtcagctgcaggtctgtcacagatggctcttaatattttgaggtatgatgcttagttcattgagggtttttattataaaggggtgagttgatcagctatttagtaaagttgaaactaatatttctttttcagatacttttgagtttctataatgacctttacaacagtatatactaggttctagaacataattatgtttgcgataacattactagcaaatgggattgctttattttctaaaacgtgtgggtgcggaaaacatgatgttcagttttgtatgttctagtaatgcatttgatccttaaaaatgaggcttctgagttgacttaggagtgaacaaacacaatttctgaggtcctgaagaaactgcagccactcctgagaaagagtcaggctgtagctgctgaaagaatgcagatatggagaaaattcatctaactgaaactgaagagaatgagaagttggagagaataagtttagaatttaagttgggatttgagacattaatttctttggattcatactgcacaacaaagacagcaggaatttttcagactttagcttttatggattttaaggttaagaatttgaattttttaaagcttttaatatttgaatttaattataattcctgggaaactattaatgagagggaaattatatttaattttggagtatcaatatgtggtgacatacgattattggactatcttacggtcattatttaatatcattgcagaagctttgaaaggatatattaggtaatatggctggatacaatttaagataggaaatagaacagaagtgaagttccagctttactgatctctcagcagaaactctacaagccagaagagagtgggggccaatattcttaaagaaaagaattttcaacccagaatttcatatccagccaaactaagcttcataagtgaaggagaaataaaatactttacagacaagcaaatggtgagagattttgtcaccaccaggcctgcccaaaagagctcctgaaggaagcaccaaacatggaatagaacaacctgtaccagccactgcaaaaacatgccaaattgtaaagaccatcaaaggctaggaagaaactgcatcaactaatgaccaaaataaacagctaacataatgacaggatcaaattcacacataacaatactaaccttaaacataaatgggctaaatgctccaattaaaagacacagactggcaaattggataaagagtcaagacccatcagtgtgctgtattcaggaaacccatctcacgtgcagagacacacataggctcaaaacaaagggatggaggaagatctaccaagcaaatggaaaacaaaaagaggcaggagttgcaatcctagtctcagataaaacagactttaaccaacaaagatcaaaagagacaaggccattacataatggtaaagggatcaattcaacaagaagagctaactatcctaaatatatatatgcacccaatacaggagcacccagattcaaaaagcaagtccttagtgacctacaaagagacttagactcccacacaataataatgggagactttaacaccctattgtcaacattagacagatcaacaagacagaaagttaacaaggatgtccaggaattgaattcagctctgcacctagcagacctaatagacatctacagaactctccaccccaaatcaacagaatatacattcttttcagcatcacactgcacctattccaaaattgaccacatagctggaagtaaagcactcctcagcaaatgtaaaagaacagaaattataacaaactgtctctcagatgacagtgcaatcaaactacaactcaggattaagaaactcactcaaaaccgctcaactacatggaaactcaacaacctactcctgaatgactactgggtacataacaaaatgaaggcagaaataaagatgttctttgaaaccaacgagaacaaagacacaacataccagaatctctgggacacatttaaagcagtgtgtagagggaaatttatagcactaaatgcccaaaagagaaagcaggaaagatctaaaattgacaccctaacatcatcattgaacgaactagagaagcaagagcaaacatattcaaaagctagcagaaggcaagaaataactaagatcagagcagaagtgaaggagttagaaacacaaaaatcccttcaaaaaatcaaggaatccaggagctggttttttgaaaagatcaaaaaaattgatagacctctagcaagactaataaagaagaaaagagagaagaatcaaatagatgcaataaaaaatgataaaggggatatcaccaccgatcccacagaaatacaaactaccatcagagaatactataaccacctgtacataaataaactagaaaatctagaagaaatggataaattcctcgatacatacaccctcccaagtctaaaccaggaagaagttgaatctctaaataggccaataacaggctatgaaattgaagcaatcattaatagcttagcaaccaaaaaaagtccaggaccagatggaatcacagccaaattccaccacagatacaagggggagctgataccattccttctgaaactattccaatcaatagaaaaagagggaatcctccctaacacattttatgaggccagcatcatcctcataccaaagcctggtagagacaaccaaaaaagagaattttagaccaatgtccctgatgaacatcaatgcaaaaatcttcaataaaattttggcaaactgaatccagcaacatatcaaaaagcttatccaccatgatcaagtgggcttcatccctgggatgcaaggctggttcagtatatgcaaatgaataaatgtaatccagcatataaacagaaccaaagacgaaaaccacgtgattatctcaatagatgcagaaaaggcctttgacaaaattcacagtgcctcatgctaaaaacctctcaataaattaggtattgatgggacataactcaaaataataagagctatttatgacaaacccatagccgatatcatactgaatgggcaaaaacttgaagcattccctttgaaaacggtcacaagacagggatgcccctctcaccactcctattcaacatagtgttggaagttctggccagggcaatcaggcagaagaaagaaataaagggtattcaattaggaaaagaggaagtcaagttttccctgtttgcagatgacatgattatatatctagaaaacgccatcatctcagcccaaaatctccttaatctgaaaagcaacttcagcaaagtctcaggatacaaaatcaatgtgcaaaaatgacaagcattcttatacaccaataacagacagacagagagccaaatcatgagtgaagtcccattcacatttgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatgaagctaccaatgactttcttcacagaattggaaaaaactactttaaagttcatatggaaccaaaaaagagcccacatcaccaagtcaatcctaagccaaaagaacaaagctggaggcatcacactacctgacttcaaactatactacaaggctacagtaaccaaaacagcatggtactggtagtaaaacagagatatagatcaatggaacagaacagagctctcagaaataacaccgcatatctacaaatatctgatctttgacaaacctgagaaaaacaagcaatggggaaaggagtccctatttaataaagggtgctgggaaaactggctagccatatgtagaaagctgaaactggatcccttccttataccttatacaaaaattaattcaggatggattgaagacttacatgttagacctaaaaccataaaaaccctagaagaaaacctaggcattaccattcaggacacaggcatgggcaaggacttcatgtctaaaacaacaaaagcaatggcaatgaaagtcaaaattgacaaatgagatctaattaaactaagagcttttgcacagcaaaagaaactaccatcagagtgaacaggcaacctacagaatgggagaaaagttttgcaatctactcatctgacaaagggctaatatccagaatctacaatgaactccaataaatttacaagaaaaaaacaaagaaccccatcaaaaagtgggtaaaggacatgaacagacacttctcaaaagaagacatttatgcagccaacagacatatgaaaaaatgctcatcgttactggccgtcagagaaatgcaaatcaaaaccacaatgtgatatcatctcacaccagttagaatggcaatcattaaaaagtcaggaaataacaggtgctggagaggatgtggagaaataggaacacttttacactgttggtgggactataaactagttaaaccattgtggaagacaatgtggcgattcctcagggatctagaactagaaataccatttgacccagccaccacattacttggtataaacccaaaggaatataaatcatgctgctataaagacacatgcacccatatgtttattgcagcactattcacaatagcaaagacttggaaccaacccaaatgtccaacaatgatagactggattaagaaaatgtggcacacatacaccgtggaatactatgcagccataaaaaaggatgtgttaatgtcctttgtagggacatggatgaagctggaaaccatcattctcagcaaactctcacaaggacaaaaagccaaacactgcatgttcttactcttaggtggtaaatgaacaatgagaacacatggacacaggaaggggaacatcacacactggtgcctgttttggggtgggggaatgggggagggatagcattagcagatatacctaatttaaatgaggagttaatgggtacagcacaccaatgtggcacatgtatacatatgtagcaaacctgcacgttgtgctcatgtaccctagaacttaaagtataataaaaagaaaaaaaagtatgtgtatgtatctatacatatttataaaagaaggcaacatagtgacagcctgttagagacccaatttgcataataaaagatcagggtggggtggccagcctcttcacgtactatataaagggcacacctggtttaaccaatcctctgtgccctatataaggcagacatgacttcctcaagctcatctataaaccaactgcatcttgctatgaacctggaaaccatttgggatctcttcctctgcaccagaaagctctcttctttgtttcacttattaaacttctgctcttaaacccactccttttgtctgtgtctgtgtccttgatttcctcggtgtgaggcaatgaaccttgtgtattaccccagacaaatgaggcagcttcattgtgggggcttgtccaggattatcaaaagggtgagtataggagtggacctcaactctgtccttttatttcagggctctcagcctccattttaattatttaattattttatttttttgagacagagtctcactgtatcactcaggctggagtgcagtggcattatcttggttcactgcaaccaccacctcccaggtttaggtgattctcatttctcagcctcctaagtagctggaattatgacacatgccaccacacctggctaatttttgtatttttagtagagatggggttttgccatattgggcaggctggcaccaaagttctgggatgaggtgtgagccaccacacctggcccttaacctccattttaaagtcaaatcaaaccatatactgtgtgtctgatggccacctagatacctctagtgtgagccatgcttctcaaggctcagatgacaggcttgttgggctgtcatgatagtgaatccactagtgccctcaggttgctgggcttattggttatgtttcaaaccaattttccttcatggaggaactagccatctcatggggcttgaagaagtcctagggcaactgacaatttctggccagggctaaaccttgatgtaattcaaaagctttgggactgaactcagcctccagctgctcaattggatcagcaacagaatctccagcttttctattgcagaatgttctcctttcctatccaccaccatcatgtctcctctctctgtatgcaatatcatgggaatttttacagttcagagaaatagtcctgttaggaaagatcaaaaaatgctatagtaactacaaatatagctcaagggaatgccacttttgtaactttctagaagcagaggtctcccccagcgagtgtttctacccttcctctggcaagcatatggtatttctaggtcagcagcgtcaactagtggagtatccttaccatgagtctcagtgttggtcctttgctgagacactccagcttcccaattctccctttttgtgcccctctaccagattccagggtttatggctttctgtaaatgggaaaaactatgccatgaaagatcaggaggaaaatgtcctctgaaactgttttagtctgaacactgtcccatcagcaggaaaaccaccatttgatccctatgttcttttaacacaccaatcctgcttgcagttaagacaatacttaaatagtaagggaattttaagtccagaagttaaccactaccattctctaggggtaaatcctttagcacgacccacaatagcaggatatagagttcaatcttgtacaccccctccattaaaggggccatgcccaaattcaactattacatagtctttcctgagatccatttttcagggagccatgaagatcatacaagtctaggaagtcagggtaatcaaaaacagagaactagggctgcatgggtacacatgactaaactcatcacttaattcctctggttccatggctggggaatcatgcctgcaaccatgggtagcatgtttaacaaggtgccaggagcccaggaaccaaagagagaaaacagtagggggaatgcccccactgtcttcccctccaccctgggccatcccaaggaaaggatccttttattctcagttctctttctagatgggtaacagaccatctttggcctgtactcctctcaagtgtattctaaagcactgggactcatttaaccccaaaactttgaagaaaaaagcagctcatttttctttgcacaaggggatggcattctttctagacctttgcaagcattgcaaaatcaacccagcttttttagcagtcatatcaggcaggtctgtagagaatgatttcccacagtaagagaagcaacttttgagggaaccatctgagaattccccttatctgaggcccctttaagttcccttctcattacagaaccttaggcagattaagggggtcttaggccatgctgctcctaagccaaaccctcactgctactcaaaaacaggcagctctgtaggcagtagaacattttggagatgaacaatatatctcctataataggccaaaaaggaaaaaaggagatagggaaggtgatatggtttggttctgtgttcccacccaaatctcatcttgaattatactcccataattttcatgtgttgtgggagggacccagtgggagataatttgaatcatgggggtggttttccctatactgttctcataatagtgaaggagtcttatgagatctgattgtgctatcaggggtttctgctttagcatcttcctcattttttctagccactaccatgtaagaagtatctttcacctcctgtcataattctgaggcctccccagccatgtgaaactgtaagtccaattaaacctctttttcttcccagtcttaggtatgtctttatcagcaggatgaaaacatggtacatcctacatcagcaagatgtaaattggtaccagtagagttggcgttgctgaaaagatacccaaaaatgtggaagtgactttggaattgggtaacagtttgcagggctcagaagaagacaggaaaatgtgggaaagtctggaaattttgcaaagacttgctaaatggctgtgaccaaaagcctgatagcaatatggacaataaggtccaggctgaggttgtctgagatggaggtgagaaacttgggaactggagcaaaggtgactctcattatgttttagcaaagagactggtggcatttggcccctgccttagagatttgtggagctttgaacttgagagagatgatctagggtatctggcagaagaaatttctaagcagcaaagcattcaagaggtgacttgggtgctgataaaggcattcagttttataaggaaaacagagcataaaagtttggaaaatttgcagcctgacaatgtgatagaaaagaaaaacccactttctcaggagaaattcaagccagctgcagaaatttgcataagtaatgaggagccaaatgttaatccccaagccaatggggaaaatgtctccaggtcatgtcagaggtcttcctggcagccgctcccatcacaggcccagaggcctaggagaaaatggttttgtggcctggggcccaggcctagggacttggtgccctgcatcccagccactccagctgtggctgaaaggggccaacatagagcttcagccatggattcagagggtgcaagccccaagccttggcagcttccacgtggtgttgagcctgtgagtgcacagaagtcaagaattggctgggcatggtggctcatgcctgtaatcccagcactttgggaggccgaggcaggcagatcatgaggtcaggagatcgagaccatcctggctaacacagtgaaaccccatctttactaaaaatacaaaaaaattagctgggcatggtggcggatgcctgtagtcccagctactcgggaggctgaggcaggagaatggcgtgaacctgggaggcagaggttgcagtgagcagagatcgtgccactgcactccagcctgggcgaccttcacctagatttcagaagatgtatggaaacacctggatgctcaggcagaagtttgctgcaggggcagggtgatcatggagaacctctgctagggcagtacagaagggaaatgtggggtcccatacagagtccctactggggcaccacctattggagctgtgagaagagggccaccatcctccagaccccagaatggtagatccactgacagcttgcactgtttgcctggaaaagccgcagacactcaatgccagcccattaaagcatctgggaggtaggctgtactctgcaatgccccaaggatagagctgcccatgaccatgggaacccacctcttgcatcagcatgacctggaagtgagacctggtgacaaaggagattattttggagctttaaaatttgactgcccctctagatttcagacttgcctgggccttgtaacccctttgttttggccaatttctcccatttggaatggctatatttactcaatacctgtaccccattgtatctaggaagtaactcacttacttttgattttacaggctcataggcagaagggacttgccttgtctcagatgacattttggactgtggactttcgggttaatgcagaaatgagttaagactttgggggactgttgttggaaaggcatgactggttttgaaatgtgaggacatgagatttggaggggccaggggcagaatgatatggtttggctctgtggctccacccaaatctcatcttgaattgtactccaataatttctgcgtgttgtgagagggactcagtgggagatcatttgaatcatgggtgcggtttcccccatgctgttctagtggtagtgaataagtctcatgagatctgatggttttattaggggtttctctttttgcatcttcctcattttctcttgtcgctgccatgtaagaagtgcctttcaccttccatcatgattcttaggcctccccagccatgtggaactataagtccattcaaacgtattttttcccccttgtctcaggtatgtcttaatcagcagtgtgaaaacacactaatacaaaacacaaagaaataatggaaacacctttcccaataggaagggaaacagtccctcctgacaatccctattgaaactctggtagctctgcaaaagaatggaaaaggcaacacttttttttttttttgagacggagtctccctctgttacccaggctggagtgcagtggtgcaatctcggctcactgcaagctccacctcccaggttcataccgttctcctgcctcagcctcccaagtagctgggattacaggcacccgccacgacgcccagctaattttttgtattaaaggcaacattttttaatgtacttatgagagggcttacaaagaactagggctaaacctgttaattactctaagctgtccttgatagaccaatagccagataagaattacacagcctttatggaaaggctgagagagctactaacaaaccacccctccttatcccttgattcagttgagggacagctcatcctaaaggacaagtttatcacacaggctgctcctgatattagaaggaaactgtgaaaggaggctataggaggatacaccaccttggaaaacctcctgagggtggccacttcagtcttttataatagatatcaggaggaggcccagcagcagaaagagaggaagcacaagaaaatgacagaggctgtagtatctacctgctttgcaggcttgcaaaattcaggatccccaaggtacatctgctagtggctatcaatgtggcaagtcagggcactttaagaaggagtgctcaggcagcaaggaaatgccacctcagtcttatccagcttgtggcaaagaccactagagatcagactgcccccagtgatggaggtcactgtgttcagaaccagtctcacagatggtccaacaggactgatgggttctggggctcaaacccgtggctccagtggctcaaactgccattacagcacagaaaccccaggtgattctggaaattgaagaaaggaaggaagacctcctcctggacactggagccagcctctctctctctctctctctctctctctctctctaatccaggccttcccacttcttgtagcaccaccataagggacatctcaggaaaaactctaatatttttctcgaccccttagttgcagctagagggacctattatttacaaatacctccaagccattgtcacagtgaccctactggtcctagatgccacaaattaacctcggaaatgacttaaatgtttacacctcacataatgtggaaggattactgtcctctagggggagcctttggctaatagtcggctccttaaatattaggctctgctcttagagggttccacaatccagttaaaaacttgttctcacctaaacctagccactttcctccccaaggaaagtggggaaaatgaacatgactgtgaacaagttataatacagacctatgcagccagggaagatctcagggaaaatcccctagaaaatccagactggatcctcttcaaagatgggagctcctttgtagagaaagtaatcagtacggcaggattatgcagtagtcactctaaatggcatcattgaaaatgtgtctctctctccaggcacaagtgctcaattagctgcactgacagatcttaaaagaccacttgaattaagcaattgaaagataggtaacatttacactaatttgaagtatgctttcttagttctccatgctcatgctgtcatttgtaaggaaagacactgtcttacagataatttatggcctataaaataccaccccaaaattaactggttattatcctcagttttccttccatgagaaatagcagtaatgcattataaagggacatcaaaagagagcagatgaagtagatgaagaaaataggtttactgatcaggtagctaagtcagtggcaaggaagccttagcacatcaatatacttcaagcccctctaatctggaaaggctccataagaaaaattaaacctcagtactcccctgcagaaatagaatgcatcacttctcaaaggtatactttccagccttcagggcggctacactcagaggatggcaaactcaacctgccagcctccagccaatggaaagtccttaaatccaccaagcatttcacttaggaaaggataaaatttatcagtgtgtccagaaattattttcaagagagaatttattaagaacagtgaaactggttgttaacacttgtgaaggtgggttttttcttctcaaacccaaaggatgggaagctttccaggggaggactggcagacttcacccacatgccagagatgaagtgtagtcaatacctcctggcatgtgtagaaactttcactaactgcatagaaatctttccatgccatacagaaaaggcctctgaggcaataaaattgttaacgaaataagtcctcactttggtctacttaagtacctccaaagaggcaatggccccccatttaaggcaggtgtcatgggcggggatgtggggtggatctcaaacacactaggcatacagtgtcatctctgttgtgcttggagaccccagtcctaaggaaaggtagagaagacaaatgatactatcaaaagacacctcagaaaactgtcccaagaaactcattttccttgcactactcttcttcccatggtcttactgtgggcaagaaataccccttcaaagttaggtctgagcccttttaagatgctgtatggatgcccttttcttaccaattattttctgttagatcaggaaatatctgagttagttaagcatgtaacctctatggctcactttcaacaggaattaacacagttagccaaagcccaaccccaagaaataggaccacctttatttaaccctggagatttggtattggtgaaggctctcccttctctttctttctccctgagcccaagctgggaagggctctacactgttcttctttcaaccccctcagcggtaaaagttacaggtatcaactcctggatacatcacactggagtcgaagcctggaaagctgtgggagcaacccctgacagccctgaggaacatcctgaatatcaatgtgaataaataggagatctgaagctacaaaccataaaaggtaagtgagggctacccatcttactcagtcccacctttatctcatgaaatactttcagtcatttctacttttctgtttagatttgccaccagatattagaacttctttttaatgcatatttgcagaaagattttaattatccttgggattacatgtacaacttcatagacccccagacagaaattctatgtcttggcaagtaaaaattttcaatggaaattatctactacaccacctttgcaggactgtatactcactctatttgcagtaggactatatactgtagaatgcccagagtggaatgctggataaagagtctcaactactgtaatattttgctgaattattatccttatagcaggcataatagttacctgacaggaagtaaacataaaagttttactatcactaagtctgctaggatgttttattgggtttgtcaatatgtcacactctagttattcaaagaaggttataaagaaaggtgattttatataagaaaggatcttctatggtaaattattgtcctaaaaggaaataactggtagttcaaagagggatgtttagcacaaatcagaaagtttaagcatgtcataggtagtctgtggaggttgtgaaagtattaatagttgctggaaaatttagccaaagttaacactaaagttactctagccacccaaatccaatgccacttatcctaaaaagaatgttcctttttttttttttttttttttttgagacagagttttgctctgttgcccagcctggagttcaatggcatgatcttggctcactgcaacctccacctcccaggttcaagagattctcctgcctcagcctcccaattagctgggattacaggcacctgccatcatgcccagctaatttttgtattattgtagagacagggtttcaccatgttggccaggctgatcttgaacttctaacctcaggtgattggcctgcctaagcctcccaaagtgctgagattgcaggtgtgagccactgcacctggccaaagaatgttacttttatattaacgtttctgctaaggtacagccacatttggtggaggcaaactagtattacaatccattagaatagctaacagatatcaaactctactgccatgcttatcacctatagtacctccactaataatggtaatctcaatacttatattcaaaccctatattctaaatcttcttgtaaaatttatctcttttcatctagaagtaatcaaactccaaatggtgctgcagacagaaccatccatggacacgcctttcttctgaggacccttagattgaccccaggaggagccctaactgctgttccctacacaacactccttttcagcagtaagtaccagaaagactcatcatccaacaccccctaacagcagttagggataccactcctgagggggaaatgatacagcagctaaacataaattatttaggcagattgtgaggacaaaagagtcctcagtaaggtttccttttaacaaatagcagccccaaaattatttctaacaaaaagcagcctgaaaaatcaagctgcaagcatacataagcaagctggaagcttgcgctggcagctctgccaatagaaaagggatagctggaagccggctatagtcagcatggaggttccttttcccctttttcaccacatgtgcagtaaaaagcagacaacatggtaccagtccagtagagaccccatttgcataataaaagattacagtggggtggccagtctctttatctgctatgtaaatagcacacttgatccaatgaatcctctgtgccctacataaatcagacaacacttcctcaagctcatatataaaaccaacccagaaacctgtttgggacccccttctctgaatgaagaagctctcttctttctttcaactattgaacttctgctctttaacccactccttgcatgtctgcatccttgattttcttggcatgaggcaacgaacctcagttattaccctaaacaatgctgtgtcaactcctctcgtaatgctagtttgcacagctcatggctccaaaagagaccccttccttttgaggaaaggaagagagaagagcacggagaagtttgtcttacatcttggatatcagcttagccacagcaggacaggaactggtcagtcataagaccccaattccaggccctagcttccagatgacatttctagacacaccctgagccagaaggtaacccaatgccttgaaagaaagaatcaagttttggcagcattcatcacctggtaactgaggagctcttgggccatgaataatcagcagtaatacccaggtactctgttgaggacatttggtgattctctgagacttactggcttcaggtgagatccagcacattgccaactgtgttgactacgaggcaaaactcctgcttgagaaaagcagtagaaaaaataaaagagattttggctcgcaccttaggtactagcatggccacagggttgtagagcaccaagaaggctcatggggaccctattccatgacttcacttttgaattacatttctggatctgccctgggccagaggggagcccactgtcctgaagggtgagtcccagaccaggcaacatttaccacaagctgactgaagagcccatgggccttgagggaacactggtggtagtctgtcagtactccgcgtggcctggtgtggtggtggcaatgaggtgaaacttttcttcctttggaaaggggaagggagagtgagaagaactgcatcttgtgctttgagtgccacctcagctgcagtataatagaacaccaggcagacctctaaggttttttactttagtctctgacacccacatggcaactctggacccacatggggcctgggggagctggctgtcctgaagggaagaacactggcctggctggcttgccataagctgattatagagccctagggccttgagtgagcataagtagtagccagaaagtggtcacagcagaccttaggtgagacccagtgctctgtgggcttcagttctgacccaggacagtcacactaacagcagggagagtcatagtgttggtggccataggggtgcttgtgtcactccaccttcagcattaggtggctcagaacagagagagattgtttgattagcagaaagtaagaaaagctaacaaaagcctctgcctggtaatctaaagaattcccacagattttgtttaagaccatcaaggtggtacctctctgagtctacaagaaccatagtgttactgtgcttggggtgtcccctaaagcagatacagcttagatcacaacacccaagttctttctaatatctggaaggccttccaaagtaaaatggctacaaataagcccagacagtgaagactacaatagatacctaactcttcaatgcccagacacaaactaatatctacttgcatcagtatcatttaggaaaacattacctcatcaaacgaactaaatagggcaccagggaccaatttgccttagtatctgttttcttttggttactctttagtgccttcaggaaggtttattttggttggtttgtccagagtttatagttgttacctgtgtgtatgtgttgagaacaggggacagagaggtcagtcacttttagaagtggaaccttaaagagctttttttgtgtcatatcatgtgcaaacctgttagaattcatgttaaaattagacatgaatgataccaaaaacatttcagcactatggtataaaaccataccttactgttgacctttcttttgcctattttgttcatacttactatttatttacttaaatccctcctcagttttaattcttgttttctaatgagttactgagtacttaccagatggaaagcactatgatagattctccatctgttgaaatattgctcattcaaaatccaaatcaaatgcaaacaccctccaaggatcactcccttgcctcctcctaagcagacgtgatttacttttatctgaatgcctttggtactttgtttttaccttatgacattagatttattaatacacttgctttctccccaccacaatcagttctttgtccctattagatcatacacttcatcagtaagggcaagtctcactcatatttccatccatccatgctgccttaaacatgctttctaaagtcaggaactaaaaaataaaaagaaagaatatctttgcagctgctcagaaagaaaagaaaataggacattagtttcctgtctgtgttctcaatagtaggatcggacatcagttaacaatgcattctttatttttagcgaacatctagacagagaaaactgtcttttcccttctcctcgttatttttcctctttcttcttcctcctcttccttcttcctttttcttcctccttttttcatcttgtcctcttcctcctacttacccttccccctttatcttcctttgtccctcctctcttctcactttctttttctcactaattatagtctcatttaaactttttttgtatgcttagtctcatctttaaaatggggaaacatatatgtgtcattatgaaatgttttttgctttaaattgttaaagatcagtaagggagtcttttttcttcacctttgaaattgtagtgccaaaactcagacaaaccagtgatgttccaaaagttgatgggagaagaacccaaacatttgattcttccttcattgatttttctttcattggtaagatattttagtgaaatattatatgttgaattgtcaataacaaaagccatctacaagcattctttttcctcttttagccatagcaacaaacatgccataaaatggaagttatagaaataaggttaagtgaattaaactaggttttgtaataagctcacttcttccttagactcaggtcagaagacatttaaaagaagaggatctatcataaactggggctgttgctggggttctagcacttgcctggacaatgtgtctgcaccatcaacatcacctatgcctggacagctctttggagtttctctgccaaatatgtgtgagaatgacaatctgctcaaacctgtcctggtaaggctcacttgacctgttagctaatgggaaagggggtttgggaaaggagagctctgagaggtaaatatgtcaccaaatggaaaaattatagacgccactgtctttggctaaaaatctgatttaactactgtagaatcataaggaagacatatagggagagatcatatagtttcctgatttcaggaaagacccacataaacctactcagataaattagaattttctctttagacagagaattcacattctctcacacaaatcctttcttcaactccacattgttatgaaagtcctcttttatcagtgtagcagcagagactactcaatgttatgcttaagttttaaaaacttttattatttatatgtcaagtacttaagcataaaggtacgttccctggcattcatttatcttttgtctgtagaatgggtcagatgaaaaccactgagttatttccagttgacatattaaagaatcactactaagcagcatttattgagtattcattatccttcaggtgttatactagatgtgtggcatttaatgctatattgttcatctataagtgccagacactcatctagccaccttattatttatccttcacagcaaacgtaggaggtggttcttactatgtcaccatctctacttcatggtctgtgttttcaaaagcctcagtactttactcaaggatacatagtagctaagtggcctaactaggttttaaatcctacagattgcttgtctccaaaacccattctcttcctgcactgtaagcagaggacatactgatacaaagaaagcaaaattagagaacacttaaaatccactctcttagccatttttagaaatgcagtaccttgttattgagtatagtaatcatgttatttaatagagcacctgaccttacttctgctatctaactgaacttttgtatcctttgaccaatatctccccaacctcaccaccaccccagcccctggtaaccaccattgcgctccccaaaaaaattgacttgaatctttctagctgttcttttagtcccaatcttttagtacttttaccctagcacaaccccatagcctctggtagccaaagggggtaagtatgtgccaaaaaggataagtattcccttgtctgtatgtgtgaaatgccattttgcttatttcctttgtttccctattggatgtacttttctttcttaatcaaaaaggacccctcaccaaaggtgtcttcaggaaagcagccagtttaaaatcctgcagaaaatgagaaattaaattctggaggtgaagtaaacctagattgtgaatctatttttgagatagcctctgtattgaaggtaagaaaaattttcttttaatctacctgatggtatagctctggagcaagaaaaaggtgtttttattttttttatgaacattatttatatttgcaaagacccataatcaatttataactttaacactaaaagagtgttacaaacacttttataaagtcaacattggactttaaaaactaccaccagtgatatgacatatcaaatatgtttaaaaattttttttcccacactaacctcatctttacttctgcaaccccatgtaaaaaataaaactttgttaaaataataaaaagacacacacatttaccaaaacaaacatcatgcctattagtattttctgtcttggccaggcatggtggctcacacctgtaatcccagcgctttagggggctgaggaggggcagatcagttgaggtcaggagtttgagaacagcctggccaataatggtgaaaccccatctctgctaaatatacaaaaatttgcatggtatggtggctcacgccagtaatcccagctacttgggagtctgaggcctgggaatcgcttgattcttggagaggaaggtaacaatgagccgaggtcacaccactgtactccagcctgggtgacagagcaagactctgtctcaaaaaaaaaaaaaaaaaaaaaaaattctgtctcactaccttcataataaaggcagttttcaaaactaaacttttgttgcatgtttgaaaatagttacagaggtttgccataataaacatttgcctcacaactgaaacaaaaaaaattgctgagatcactgaaatttttgtttacataaccattacgcccaaaaatactcttttccttgttccctaatgccttttactctaaaagtggagtgggaacaatctcagcatctgagttccttttacctttaccacatttgatattctttgtggttcttaccctttagccatggctacaaaagtcacatatatagttacagagatagagttctaattttttttctgccccacattcttgcaaatgccctacctttttggaaaacctcaagtcaaaactagcttaaagcagagattttgaccctacagtatcttctgcagacctgcctcaggctcccaccttccaaagggctgaaatgcaccagagcccggagtagagacaaggccccagcccatatctcagggcctgcagcataaaaacaaaattaaggaaaatatggtgaagaagactcttgcatacccctacttcagcggagtggctagatgccgataaaatcttatgtcatgacttcatgtacaatcagacattttttgataaacgagccatgtcttttcttaaacccagccgtagacttttgcaattaaatattaggccagagaactgaagggcttgagctaaggtcatttaacctgtttgcagagggtttgtgattactcttcaatcctgcaaaacaataaagacctttttttttttttttttttgagacggagtctgtctctgtcgcccaggctggagtgccttggcgcgatctctgctcactgcaagctccgcctcccgcgttcacgccattctcctgcctcagcctccgcagcatctgggactacaggctcccgccaccacgcccggctattttttttttttttttgtatttttagtagagaccgggtttcaccgtgttagccagggtggtctcgatctcctgacctcgtgatccacccacctcggcctcccaaagtgctgggattacaggcgtgagccaccacgcccggccaataaagacatgtttgatttatttagccccagatatatatgccaaggatttttatgcataatgaatttttcttttttctttccatataattaggttttcttctacttcttagtttacaaaggtaaagcctgtgtttcatggaataattttttgaaaaccaaaaatgtctgcaaaaatttatcttactatgctatttttcatagcaccatacttcttaaaattttgtgctattgatgctgttgtaaagaagcatgattcttgaaggttaaatgtgttacaaattggagaaatatttgtccaaaaataatgaaaagacaaaaaatgatccacatgattgaagagtctgtttaaatgggttccaagtaaatgacattttatcatataagtaggttttactcacttttcttccaagtggttgcaggaagggacataatttttgccaaagtttttgagtttttgttttgtttcttgttttaaagtctattttgaagtggcacttaagttttcttgtaatttttcacttatgcactggttatgcttagatataagtttagtttaagcctcaccttgacttttcaaactataattggacaaaaatgcttgagatactatagcttggatccatcagattttgagaaaaagttcatatttactcctgcactatctcaactcatgagtttgggaattctgccgatgatctgggctctggttttggaggagaggagacttttagttacatgctgtgagttggtgattgcaattcagaaccagctttcacatccttctcagctgtgatggtggctgaatttcaaaacttgttatttcacctgtgggagagttcattgagatgttatgagttattttctttcaagtgtaggtttaagatttagtggtgtttttctttaagacagatcataagtatatttttcactgagatttaaaaggaaagctattgtcactatcccgttttgaaataacagattttgctgcttctaaactggacttctaatgtgcatacagcagctaaaattagtttggaattatgaaaatttaatagctgtatccccaaagaggtaacttttgtaattatatccctgaatcacaaatattcaggtacatttctactactggaagatataatagaacaaaggaagagtttgaatcaatcagtcttctttctttctaaaaaaggtatagcaataaattgataccactacaaagaggttcttcaaattgttttagaatctcagttccagttgattggttttttctcggctctcattaatatttggccatatgacatatgacagcacttcactaatgacctccactgtggctgggactgtgcttgacattgacatgtaaaaagaaggttaagagtctgctcctaccctggaggagctcataagcaagtgggaaagatgcctacacaatcagccaactgtaacaataagttatcacagcttccatattagtgttagaaacatgatatctaagtaaaacatggtgtgttgcctttcataagacatatagagaaagttattgatttggttttccagcaagagttaaaattgcccaattgaagacttttacctgtccccatgttgtaatcaggaaattgcaagaaggtaaacaaccatgggtacagtgcttaaatatgatattgagttcactctgcctaaagtttactgaggtggagaacagactgcaagcttgatcttggtaatgtcatgccaacagcaacagagagagttggcctaaaatcaactctctaggatcaggacaagaattgaatttagttatttttaagctttttgtaaacaaaagccaaacaacaaatgccattggtcatatccttttgtgtcatagtgtggtttcatcacactcagccctgccagtggtctcagcataatagaatctctaagaaaagaatatactgtggacatgttatttagtgtacatcaagtgtgagaatgctgcccccatgcttccaaatacagccatcacgtggaatgctttctctctccaaatgtaagagaacttttctatggggaatatagggaaaaagcttacatacctcatgatgcaatcatggaatactgctggatataaagttctaagataatagggactgtgttttatctactactctatccctagtgactcaaatagtggttggcacacaagaataaatgcacatagaatgattgactgaatgaccaccaaattattaacctcatagataccttagtgcatttccatgaactagccatctaaggaaagagaaaaaaaatgatttagtatagtttactgccagaccctgtcagatttgactagtttgctaaaatgtatgcaaacaggaggtttcagccaaattggttgttctttgcctttcccatcataatgcagacttcaattatttctataattttttttagaaaaaaacaaaaaatacttctgtttccacaagtcagtggagagttggcacagaggtctgtgtagttccctgaagagagtacttaagtgaacttttcaagaaaatactttctgatttatctaacacatacttggcatgagaataataatttaaaatacctgtttttccatcaatgtaaagattttctgcaaagtattccaggaagtgttttttgtcagatctctgtgatcactgggtctgggtaatggatgagggaaatgatgaaaagaaaataaattctgttcaaatgtaattagtctaatttggtcgtgtctcaaaaatactattaaaaagattttataagcttgtttattaaaataatgacaaatatcaaagtcatatccatggggaccagattacaatatatttatgctggcttatcattgttattgtttttctcctttagcttattaacatgaaatatttaagcattgtataccttctgtatatccgaatctgataggagttgatattcattagtctgctagctaatactgtaggcccaatctacagtttatgattgtaattttggtaaatatttaaccagacaactcatcatatatttcattcaccaggtgaagtcatagagattatgacttattctctcttctcagggaactcacactctggtaaagtagatagatgaccaagaattacaattacgatgcagtataatcagtgctgtaagagatatttggagagtgctgtggaagcatggtagagaggcagttagctacttaaaaagtgtcaaggaaaagggggattgctactctctctactcatgcaaaaaaacaaaaatgctggtagaactcaggaccccatgcctaaatatttcctgcattataaaagaataggaaagaaatatccattaacaaaaagcaatacttctagttctatgaaaactcaatatttttcacttgcatgttcttatttagtactgtgtgttttttttcttgagcaattttcaaatatgaattatctacatctttcaccaataggagaacatagtacagctgctgaggacaccagaaaccaagggcatttatcaaaacactatcttcacttacattatagtttggcgtaagtcattcagatagtgagcatcaaattctatactttatttctaattgtctaaaaccttatatatcctataagctgttaaaggattttttaaagtaaaattatgactctcatacaaatgtaaaataaacacatgaaagattttatttaagtcatttatgagggaaccagtaagatgttacaaccagttcaaaggagacttcaaagttgaaatattatatatatagttgaatcagaagtgctaaaatgtggggccaggcacggtggctcacgcctgtaatcccagcactttgggaggctgaggtgggcggatcacctgaggtcaggagttcaagactagcctggcctacatggtgaaaccctatctctacaaaaaatacaaaaattagctgggcatggcggtgcctgcctgtaatctcagctacttgggaagctgaggttagagaattgcttggacccgggaggctgcagtgagtcaacatcatgccactgcactccagcctgggtgatagagtgaaattccatctcaaaaaaaaaaaaaacaaaaaaaaacaaactccccaaacaaacaaacaaacaaacaaaaaatgctaaagtaaatttacaaattgatacaaacaaaactggccttttctaccagggcaggggtacatgcggctaaatcacttgtctctccaccagacatacttttcacatcattagaccagtgttagatgggctgctgtcagttatttataacttgtaaagttacaaaataactcttcttgtgaagaagcttggggccccgtagaagcagataacccagacgcttatgctagatgtcttattttccattgaatacacccagtaatttttttgttctatttaaaagtctttcataatttatccttacaaaaactatattcattgttagtccattgtattgcaaaagacctgcctgctatttgtggagcattattcagactaccttgtttgccctagcttgcaggtttttattgaaaaaaagaacagtcatcaatatcagcatgcacacacacacacatacacacacaagcatatatatatatatatatacacacacacacaagcacatatacatatatatgtttaaatagtagtaatcatttttggtgagtgaccatttcaaaatctcttatcaactacaaaatgagaactgtagaaaatataatactataagcaactcatatgtgaaaatggtacaatgagacagatttaggacaaaattgaccttaaggttttgattctttccaagacagcatttctgggttactgcttggaaataaaggtatactttaaatttcattgctgtctaatttgatcagaaagctttttgtgggttttagttgttaatattctgaaatgttaaagggttgacctaagtttaaatgcattgtactagtttcagggaaatatttcaggcatcatttttatgaggcattttctgcattattttacatttttgagttgtgaagacagtgtacaaaaacaaaaaaattcccagtgcttattttttctttctgtccagacagtcctcacttgtgtggtatcatgttaactgaaacttctgcatatatgaaccatgttgttgatttgcactcttccccatgcaaagtgaaaattgcatgcctttgcaagtttttaaatacaatgtcttgcttaaagagtgcatttttctttctttacgctatgagaccagcttctgagtgccaatgttgttagcctaaggtatctctttggtatattacacaatattgagcaacaatcctcaatcaatcacatgaatgcatataatttagtggtatgtgtcacttcaagcattatttggtctcctacctcctccatccaagaactaaaagatgaatttaaaagaaaggtaataaagtttttcacttttatgccttgggggactgagcccccattttgaaactgaaatccagagtatcaattctgaaagatgatttcttacataacttaagtacacatacttcttataaatttgattttactgataaactataggaaagtgatttgttaagtagaaaagtgatcacaatcaggttgcttctttcttccctttaaggagtctaaacactaagagtaaattaatcataaagtgataaaacagttgatatgagttttcagattcaaaaaacaagagaactttggagttaggccagcccagattcaattctcagtcccacttcttgccaggcgtacaatcttgggcatcattcgttacattgacctaaagtgttatctgaaaaaaaaatggggttggtgataatagagtagttacttgaaatcacagttttgcagtgcctgacagttaataaggggcttggagatatcagttgcctttgctctcaacgtttctcctgccccttggccccagtcctggagcacagaaactacagaaaggttccagtgcatctcagtggaggcacacaatgtccctagtaatctctgacctctcccccaggtgccactagttagggagtctagtgaaatgctacacaggggtagaccagtcagtccaatgcatgcatgggtagagactagacagggaaaatacaagtttttttcctagctgtctttctttttcacgatgcacccacagatgagccctcctcccaagtttatgacaacctgccctttatataaggaatacttttcataagcctttgtctaatgatgctttataaacattaataacacagtgtatttgtttaccccaaacatcctatggagaacacttatatccaaattttaaagacagagtcactggtataaaattgtagcattaagccaaggccagaagtaaaaactttagtccactaattaaatttgtatgcgcaaactacctttgagagtatcatagatttttttggggaaagtgtttcatgtacttttaaacagatataatttcttttgagtacatttgctttttttgctgttaaaattaggattcataaatgaaaagggatttataaacctaatgtgaaaagtaatacttcatttgttctttttttgtacagtattgctgattatacaatttccgattgaaaattgttgtataatatttggagaaaaaatcacttttctcttgggagaggtttcagtgagatgtgacactggggagaatgcctcaggtattgtgaataattggattggtttttgtgaataattaggttggttttcaagagaaacagacacatgtctgtgaagatgctggggcaagagtgttcctgaagcccagagcagctaaagtaaaagtagcctctgacctgggtcactggggcccagggcttctgatcctttcttagaaaatctgctaataggtcaatgtatatgaacaatatagtggcaataagaaatgtataagactgggttccagctttaaagttgttagtggcagcatgctatagtactaaggtttgatgctttttttgaacaaaacaaacattacgagtaaccctaatacatataataatagaaatgctgtggttgaaactcaagtagaaaacccagagctagaggggcaggtatgtttttttctttctctacttccttgtactggtccctgagacacatcagaattctagtgtgtatgaaacagtttgacaactactggcatcatttggttggtgggggtagacagaaatttcagatatacaaccttccagaaaatgacttcttgtatcagccattcctaaatgtgttatctttggccaggaacatcactgttttcaaccctaaaatatgagtaaaaataatgtcgaatttttatggttgttgtaaagattaaattaattaaataaaaaattattaaagaactttttagaagagatattgatagagtagtaaataattttttttaacaacagttaatattagtgtgtaaccacaagcaattgatgttggaaggcagaggcttacttagaatctgggtatacttggccttaattctttcatattttacactatttcttggttatacaacatgttcattgctttaagaaattcttacttatggaaagcccattgatcagaaactgagataaatctcttgtatcctaacagttttatttttattctgcactaacaattggggaaattataaaatattttctcttttttttttttttactatgctttaagttttagggtacatgtgcacaatgtgcaggttagttacatatgtatacatgtgccatgctggtgtgctgcaccaattaacttgttatttaacattaggtatatttcctaatgctatcactcccccctccccccaccccacaacatgccccagtgtgtgatgttcctcttcctgtgtccatgtgttctcattgttcaattcccacctatgagtgagcacatgcggtgcttggttttttgtccttgcgatagtttgctgagaatgatggtttccagcttcatccatgtccctacaaaggacatgtactcatccttttttatggctgcatagtattccttggtgcatatgtgccacattttcttaatccagtctatcattgttggacatttgggttggctccaagtctttgctattgtgaatagtgttgcaataaacatacgtgtgcatgtgtctttatagcagcattttttataatcctttgggtatatacccagtaatgggatggctgggtcaaagggtatttctagttctagatccttgaggaatcaccacactgtctcccaaaatggttgaactagtttacagtaccaccaacagtgtaaaagtgttcctatttctccacatcctctccagcacctgttgtttccggactttttgatgatcaccattctaactggtgtgagatggtatctcattgtggttttgatttgcatttctctgatggccagtgatgatgagcattttttcatgtgtcttttggctgcataaatgtcttcatttggaagtgtctgttcatatccttcgcccactttttgatggggttctttgtttttttcttataaatttgtttgagttcattgtagattctggatattagccctttgtcagatgagtagattgcaaaacttttctcccattttgtaggttgcctgttcactctgatggtagtttcttttgctgtgcagaagctctttagtttaattagatcccatttgtcaattttggcttttgttgccattgcttttgttgttttagtcatgaagtccttgcccatgcctctatcctgaatggtattgcctaggttttcttctaggatttttatggttttaggtctaacatttaagtcttcaatccatcttgaattaattttcgtataaggtgtaaggaagggatccagtttcagccttctacatatggctatccagttttcccagcaccatttattaaatagggaatcctttccccatttcttgtttttgtcaggtttgtcaaatatcagatggttgtagatacgtggtattatttctgagagctctgttctgttccattggtctatatctctgttttggtaccagtaccatgctgttttggtaccagtaccatgctgttttggttactatagccttgtagtatagtttgaagtcaggaagcatgatgcctccagctttgttcttttggcttaggattgtcttggcaatgcgggcccttttttgtttccatatgagctttaaagtagttttttccaattctgtgaagaaagtcattggtagcttgatgggggtggcatttaatctatgaattgccttgggcagtatggccattttcatgatattgattcttcctaaccatgagcgaggaatattcttccatttgtttgtgtcctcttttattttgttgagcagtggtttgtagttcttcttgaagaggtccttcacatcccttgtaagttgtattcctaggtattttattctctttgaagcaatagtgaatgggagttcactcatgatttggctctgtttgtctgttattggtgtataagaatgcttgtgatttttgcacattgattttgtatcctgagcctttcctgaagttgcttatcagcttaaggagattttgggttgagacgatggggttttctaaatatgcaatcatgtcatctgcaaatagggacaatttgacttcctcttttcctaattgaataccttttatttctttctcctgcctgatttccctggccagaacttccaacactatgttgaataggagtggtgagagagggcatccctgtcttgtgccagttttcaagggaatgcttccagtttttgcccattcagtatgatattggctgtgggtttgtcataaatagctcttagtattttgagacacgtcccatgaatacctaatttattgagagtttttagtatgaatggctgtagaatattgtcaaaggccttttctgcatctattgatataatcatgtgatttttttctttgtttctgtttatatgctggattacgtttattgatttgcatatgttgaaccagccttgtatcctaaggatgaagcccacttgatcatggtggataagctttttaatgtgctgctggattcggtttgccagtattgtattgaggatattctcatcaatgttcatcagggatattggtctaaaattctctttttttgttgtgtctctgtcaggctttggtatcaggatgatgctggcctcataaaatgagttagggaggattccctctttttctattgattggagtagtttcagaaggaatggtaccagctccttcttgtacctctggtagaatttggctttgaatctgtctggttctggactttttttggttggtaagctattaattatagcctcactttcagagcctgttagtggtctattcagggattcaacttcttcctcgtttaatcttgggagggtgtatgtgtccaggaatttatccttttcttctagattttctagttcatttgtgtagaggtgtttatagtattctctgatggtagtttgtatttctgtgggattggtggtgatatcctctttatcatttttttattacatctatttgattcttctctcttttcttattagtcttgctagtggtttatcaattttgttgatcttttcaaaaaaccagctccgggattccctgattttttgaagggttttttgtgtctctatctccttcttttctgctgtgatctagttatttcttgccttctgccagctttttctcctgtttctcctgcttctctagttctctatgtttgctcctgcttctctagttcttttaatggtgatgttagggtgtcaattttagatctttcctgctttctcttgtgggcatgtagtgctataaatttccctctatacactgctttaaatgcatcccagagattctggtatgttgtgtctttgttctcgttggtttcaaagaacatctttatttctgccttcatttcgttatgtacccagtagtcattcaggagcaggttgttgagtttccatgtagttgagcggttttgagtgagtttcttaatcctgagttctagtttgactgcactgtggtctgagagacagtttgttttaatttctgttcttttacatttgctgaggagtgctttacttccaactatgtggttagttttggaataagagtgatgtggtgctcagaagaatgtgtattctgttgatttggggtggagagctctgcagatgtctattaggtccacttggtgcagagctgagttcaattactggatatccttgttaactttctgtctcgttgatctgtctaatgttgacagtgggttgttaaagtctcccattattattgtatgggagtctgtctcttgcaggtctctaaggacttgttttatgaatctgggtgcttctgtattgggtacatatatgtctaggatagttagttcctcttgttgaattgatccctttaccattatgtaatggccttctttgtcccttttgatctttgttggcttatagtctgttttatcagagactagcattgcaacccctgcctttttttgttttccatttgcttggtagatcttcctccatccttttattttgagcctatgtgtgtctctgcatgtgagatgggtttcctgaatacagcacactgatgggtcttgactctttatccaattttccagtctgtgtcttttaattggagcatttagcccatttacatttttaatattgttttgtgtgaatttgatcctgtcattatgatgttagctggttattttgctcattaattcatgcagtttcttcctagcatcgatggtctttacattttggcatgattttgcagcggctggtacccgttgttcctttccatgtttagcgcttccttcaggagctcttttagggcaggcctggtggtgacaaaatctctcagcatttgcttgtctgttaagaattttatttctccttcacttatgaagcttagtttggctggatatgaaattctggattgaaaattcttttctttaagaatgttgaatattggcccccactctcttctgggttgtagaatttctgctgagagatccactgttagtctgatggtcttccctttgtgggtaacccgacctttctctctggctgcccttaacattttttccttcatttcaactttggtgaatctgacaattatgtgtcttggagttgctcttctcaaggagtatctttgtggcattctctgtatttcctgaatttgaatattggccttccttgctagattggggaagttctcctggataacatcctgcagagtgttttccaacttggttccattcttcccgtcactttcaggtacaccaatcagatgtagatttggtcttttcacatagtcccatatttcttggaggctttgttcatttctttttattcttttttctctaaacttctcttcttgcttcatttcattcatttgatcttccatcactgataccctttcttccagttgattgaatcaactactgaggcttgtgctttcatcacgtagttctcttgccttggttttcacctccatcaggtccttcaaggagttctctgcattggttactctagttagccatttgtctatttttttcaaggtttttaacttctttgccatgggttcaaacttcctcctttagctcagattagtttgatcatctgaagccttcttctctcaactcatcaaagtcattctccatccagctttgttccattgctggcgaggagctgcattcctttggaggaggagaggcactctgatttttaatttccaatttttctgctctgttttttccccatctttgtggttttatctacctttggtctttgatgatggtgacatacagatggggttttggtgtggatgtcctttctgtttgttagttttccttctaacagtcaggaccctcagctgcaggtctcttggagtttgctggaggtccactccagaccctgtttgcacggaggctgcagaacagtggatattggtgaacagcaaatgttgctgcctgatctttcctctggaagttttgtctcagaggagtacctggccgtgtgaggtgtcagtctgctcctactggggggttcttcccagttaggctactcgggggtcagggacccacttgaggaggcagtctgtccattctcagatctgcagctgcatgttgggagaaccactactctcttcaaagctgtcagagagggacatttatatctgcagaggtttctgctgccttttgtttggcaatgccctgtccccagaggtggaatctacagaggcaggcaggcctcctggagctgctgtgggctccacccagttcgagcttcccagccactttgttaacctactcaagcctcggcaatggcgggcacccctcccccagcctcactgccaccttgcagtttgatctcagactgctgtgcttgcagtgagccaggctctgtgggcataggaccctccgagccaggcatgggatataatctcctggtgtgtcgcttgccaggactgttggaaaagcgcagtattcgggtgggagtgaccggattttccaggtgctgtccatcaccacttcccttggctaggaaagggaattccctgaccccttgtgcttcctggatgaggtgatgcctcaccctgcttcgcctcatgctcagtgggctgcacccactgtcctgctgtctgacaagcccgagtgagatgtacccggtacctcagttggaaatgcagaaatcactcatcttctgcgtcgctcatgctgggatctgtagattggagctgttccgattcggccatcttggaacacagagccccaggaaatttttttattttctggattcaggtgaataatgacaagaccccacaatttgaaaagacgtttactgttgttccttgcaccaacttttttcacccatgaattattcttgacctcagtgctgaaagagtaagtatgcaataagactaaaagggcataatgcattcaataagaatgctttttaatgaatgccaggtgcccagcactatgatggacatcatggcacacaccaaaaaagtgcaaaagaaaatcttatttattctgaaattaaaagtatataggaatggaggacatacatgtgtgaaataatttgataaggcatgtctgtgattctcaaccatgttatttactctacataaaaatacatatttctgcacctcccattttacctctccactttatccttatttaactttaaactagattttcaactttaggcttgaaacatcatttttttctggaagaccttatctagttcctcagggtagatgttacaacagtatgttaaaatacctctctgaatttttatattttttatttttgcaattttttcaatgtccatcttctggtataagtgtattctacacagcgacagggactgtattgaccattggaatacaccagtgaatagcacttgtcattagtgagtacatgaaggtttaagagatcatttatgccattccccttatttaagggagtcaacaaaagttaaatgatgtgttgcacagacaggtgtaacagacccaccactacaatcacagctacagaccttctccagctgtcctttccactccaacatgatgcttcccctgcattatacaagaggatataagacagaatgagcaaaggaggatgttttccaggggagaaaagagtgaataggcaggacttatttgggaattatgggagatctttgctcttttttaaagcactcaacatttacaccaacagatgagcaaagtacattaagtatagtatgaaatgtaccagtcatttcccactaacatcttcaatcagagtgtccacaatcttcctttaatacttaagtcagactccatttttcatgggaacacaatcttgtttcccatttataaacaatttttttctctagaccttgtgttaaaatgatccaaaaatttctccattacatatttttaagctcatttaatacttacattttattctacttaagaataaagaaacatatatttggtcagatttttctggaaaaaatcaagttcttttttagaaaacagacttaatatatgtgaaaatttggatcatttaaaagttggaaataactagaaattaataaagagaaaaatatgtgttaaaatgttgcaacttcaaagcaaacagaaattttagtttttcttctcggcagatctgaatattgcaaaaatatttcaagtttgtagaaataattaaaacattcaaaaagaagtaacacaaatattaatatcagttaatgaagagaatttcaaagaacttcaaggaaaaatttcaagagcatacaatttatgtaaatcattgtcttctaaatacagaaacagtatgtgaatatcctaaaacattgtgaaaagaagttatctaaaaagcaatttggaggaaagagactattccaatgaacattttgcaaactgggaagatgcaaccttctgtgtaaaataaaggtgtgttccagaggacaaatgaagggtttggcttttatagagaaagttcccactcagattccaaattaggtccttttaagcaaataaagggtccagatttacttaattctggttgttcagcacagttgggttctgattggaggatgcacgccacagcctatctgttggtttaggtgatgtaaacaggaatagtcaggtataaaattctcaaagttaggcaagtgtgtggattttctggtaactcagagtaatgtgtgacctctatttagcaaatggccattggcttctttttaaagttatgcccagttagccacccaggctttctcatgaaggatgggttctttccagttctctgctttcagggactctccatatcttgcataacttttctttttgcttgttttctttcttctcttctcaaaaacctttcattaatggcaatgcttcatcccttaggaagaatgtcatatcaccgagcacagaaatttcaggcaggaagaggtttagaattttaaataatcaacaaggaaatttacataacaggagaaggaagaaatttaagagtctagtactaaaaagcttctccttctaaacccataaaacgttcacacctatttgctattttgacccagaagggctaaaagaaactaaataaaactactctacttatggagttaatctaacaaagtaatacgtatctattctgaattttgaagataaccttttaggtgatttgattttctgttggataaataaaacaagcatgctccaatgtcacacaacacacaaaagtgaataaaagggaaagttaacataggctggagatgagtactggtgagcgctcttgacaagagaagctcttgatgaattttaatgtatggatggcacattttattattttatgatgtcacttagacaaaaaattaaagcagaatggagagctgaatttgtgcttgttatgatggaaatcagagagatatgttggggtgtaactgtatatcatgagaagattgcaattatagatgatgcaatgaaagatgaagccgaagcatggttgctacatctaacctgaagtgcatgatgacaatgctaattttgtggcctcaaacataataaaaaccagtgcatccctcacctgcatgtttactcagaaagcatttagtgaaggcttaccatactcaaagcactataaaaatcttcctaggagaaacagatatggcaccaagggacagtgactgatttcaggttcatgatatattagctgcaccctggttagcattattcactctccacaaccaggaaatgtagtttgacagtggcctttctgttcagtttatttatactttctcatgttcaatttttattttaatcagtacaattttttaaagaagcctaaccaaaactaagaaagaagggtatggctttttagaaagcaaagacaaatagcaggttaggaattaaaatgtccacgtagaatttactgatatataaatcattgtattagccaagattcttttcattgcaaatgacaaacctttgaatacatttactttagaccaaatggaaagtttacttgtctgtagagcccacaggaatggttaaataatatgagcagggaaaccatgataaaaagaaattttgtggccaggcgtggtggctcatgcctgtaatcccagcactttgggaggccaagatgggcagatcacaaagtcaggagatcgagatcatcctggcaatcatggtgaaaccccatctctaccaaaaatacaaactacaaaaaaaattagccacgcgtggtggtgggtgcctgtagtcccaggtacttgggaggctgaggaaggagaatggcatgaacccaagaggcagagcttgcagtgagctgagatcgtgccattgcattctagcctgggcgattgagcgagactccaactccaaaaaaaaaaaaaaagaaagaaagaaattttgtaaggatttgaactgtggactcaaatgccaacaatgctgtctgtatctctctttgattggtttctgtcagaataccagctcaatttttatcacactcagtatatttatattgtggaaaatataaacatttattgttcacaattttatagtctatgacttgaacaaccaaatagatttcttcattggcctcatggatactacacttgctaaaataatcccctctagtaaatgtcatgggccacttagtgtatcgcaaaaattctccaataataaaatacataaataaaagtaatattttggttgtcatcttagtccatttgcactgccataccaaaataccacggactaggtgacttataaacaagtttaaaaactcacaataagtgaccagatttttttctcttagaccaatgacttgcaaccaagtaagaatgcagtgtctttcactggagcctcttggttggagctgagggagaagcactttcttaaagaaggggttggaggtgtgaaaaataaaaacaacctactagattatgtgtttgcagaacaatattcatcatgttattcagttcctctcataaaaagattcaaatgataaatgctcataatttaaaactgaaaaaggacttttttccccaaagctatttttattgggcaataaaatgacagagcccattatttttcctatttttgctgttgctaccagaagcttcagaattaaatcataatataacatcaataaccaacttgcatcaggtttatggaaaccatttccactattttctataaggtttttaaatttttctaatttttaaattatttctgtgcctttaaaatgcttttggattactttcagaaacagatgaagaaaaataagtaagtaattgacaaagaactcacaacattggcctcatgggtactacacttgctaaaataatcccctctagtaaatgtcatgggccacttagtgtacggcaaaaattctccaataataaaataaaatgcataaataaaaagaatattttggttgtcatcttagtccatttggacttccataccaaaataccatggactaggtgacttataaacaacataaatttacttctcacagttcatgatttaaaatacaaatgtcattaggtcataaacacagtagaataccttcaaccactcaagcttaattggtatgttccatctcacagacaacatgcttaaatacattatttaatattaattattacagactggtttaaaatataaaatcttcaagaaatactttaatttcccttggtgatggaaagtctatccctctgaaatataacaccttccaatttcctgtctctctacacaatgcagctgtggggatttttgagaaagtgacaagaaatgtcttcttgtccttgttgacagggttttatggtgattgaataatattttcagtttaaatatgtaaaacacatattacttcagtaaaatgcttagtacttgaaacctaccagaaaaaatgaaggtaatataaatcagtgcatagcagtttgagttgaattgtgatttaaattctcctgctctctcatagaggaaaaactgtgtagacagtagttttacatggacctcatcccagtttcaccatgtctgataacaaaactaatgcaaagatgcttctagtcataggcctgtgtcctctaaaaataagaaaaattaattgtgactgttcatctttccaagacaccccattcctatgcttctgatatgggtaaatatttgtaagagtattagcaacaaaacatgaataagccccacctccactctcaaaggtctaaagctggaaaggagtagtgaaattgaaaagagactaaaatctattaaacatttactataaacaaaacactgtgttaagtgtttggattatatataattcctgagtttatagagactgattcttgtaaagaacatcattatttaaatttaaaaataagtataataaatgtataaataagaaataaatattattataagtttttctatctggggtcagtgaactaaagctcatagacaatctcatctacaaaccattttcatgtagaccacaaactaagaacggtttattaaatttttaagaattgcattaaatggttatatgggtacctgcataatatatttgattttgcctaatggctcacaaagcctaaaatacgttctatctggccctttacaaaaatagtttatagatcctattctatagagatttgacctagtcagaatagtaaatagtatagatgaatgacaaattaagaatataaataaaacattttattaatatatttttatcagtaatttcatagaaaaatatacactcagaattaatgtgaaaatagattacttagttatttggcatatgcaactaagtggaaggccatatagtatgctggattcttgtcgtgtgtgacgtggggtcttggatattaggctttttgacatatatctattgcagaagcaatttttatggaaataaagtatattagtctgtgctcacactgttataaagaaatacctgagactgggtaattgatcaagaaaataggtttaattagttcacagttctgcaggctatacaggaagcatggcagcatcttcagggcggtgggactctgggcctggcccacaaaaccattctttcctcctaggcctctgggcctatgatggaaggggctgccaaaaggtctctgaaatgcctttgaaacttttcccccattgtcttggctactataattgggttcctctttacttatgccaatttctgcagcctgcttgaattccttcttgaaaaatcggcttttatttgctaccatatggctaggttgcaaatttttcaaacttttatgttctgcttctcttttaaatataagttccagtttcagatcatttctttacttctgcatatgatcataggctgttaaaggcagctaaggcaaatcttgattgctctgtaaattagaaatatcttctgccaggtatcctaaattattaatctcaagttgtaagtttcacagatctctagagcagggtacattacttccaagattttgctaaagaataacaaaagtgttttctccagtttccagtaagttcttcatctccatctgagaccccctcagcctggacttcattgttcatatcactatcagtatttttgtcataacaattgaacaagtcctaggaattcccaagctttctctcatcttcctgcctttttctgagcccttcacacactatcaacctctgcccaataaccagttccaaagtcactttcacatttttacatatctttataattatgacccactcctgatactaatgttctgtattaatctgtataaaaaatacctgaaatggggtaatttaaataaaagaggtttaattggtgcatggttccacaggttatacaggaagcatggcagcatctgtttctagggaggcttcagggagtttttacttatggcagaaggcaaagctaaagcaggcatttacacatggctggagcaggagaaagagagagtggggaggggccgcatacttaaaaaaaaaaagatcttgtgagaactgactcactatagagtaccaagggggaatggtgctaaaccattcaggaaaactgctcccatgatccaatcatctaccactaggccccacctccagcattgggattccaactcaacatgagatttgggcaggaagacatatccaaaccatatcatagagtttttcatagaaggcatccctgtagcatgggatgaagttcaatttaaaaaaaaggttgaaattattgtagaaagcaaggtaacttacttactgtcttactagagaatcagcaaagctcacaatgtccttggaggttggaataggagactgagtttttggataggcctgctgaaacatgacagcaggagtggtggaggaagaacagaggtctctagggttgcaatgaaagagatgttttgctttctctatatatcttctgatataaaataaaaattttgtcagtgtaaaaagaatcatattattaagactatcaatcactaaaataacaaagaacaaaatcaactattgtgatatcactgatgatatttgggaaagttcgtgtttctctttcacttttgaagaataacttcatgagtatggaattgtaggttgatgtttgcttttacctctcagtaaattcatttactttgaatattttccttctctctagtcttactcacatgatttctgagcagaagtcaaatgcagttattatatttacatcactatagttaagatgtgttttattcctctgtgtcctttcagaattgtcctaaatctctgatttttccttaatttgaaaatgatatgctgaggtgaacttttttagcattaatcctggttggtgttctttgagcttcttagatctgtagtttggtgtctgacattaatttaggaaaattctgtcatcattatttcaaattttttttctgcttttttttctctcatctctgtctggaattcccattatgcatatttacactttctgtagttgtcccactgattttggataatatattctgttttttttcaacctttgttccctttgcttttcagttttggaggtttctattgacaaatcttcaactcagagagtctttccccaactgtgtccagtctagtaataagcccatcagggacattcacagtgtttgtatctctagcatttctctttggttctttcttgggatttcaatctctctgcttatatttcccatctgttcttgcatactatctgctttatccatcatatcccttaatatattaaacatagttcttttagatttcctatctgataactctaaaatccaggccatctagttctggtgttagctctttctctttaaagtgttttgtgtctgggagtatgccttataatttttcctgagagctggacatgaagtagtgtattaagtaaaccacagtaaatagttctttagtattgtgacagtaaggttttaggagatgaaacattttctgtagttctacagttagatctcagtcttatagtgagcctgtgcttctggactgtaagccttacaactctttttccatttttttttctcccatcttaggtgaggcaagatggttagagtgggctgaagtttggtatttccattctccctcatgacaaggtagagcaggctggagttgagtattttattcccccagtttagttagcctttgctcaaactgcagtaggttagtatctggttaactaatttatcctgacaagagattaaaacaacaacaacaacaacaacagagtgttctagtatatttcaaagtggtctcttttttttcttcccctgctggaagcatgaggaaatttttctcctatatttactgtggctaagctcctggaggtaaaacttagaaaagggcggtgtctgttctgactaggtcaccctggatgtattaacagagacatgttcacacctagtctccagcgagttatcaatcatagttcagggtttcctaccttgacactggttcccattaaggcctctgttttaatatgtggtgattctctgtatttgcctgcttgtgtcttctattctgggcacagtggtttgctctgtggatctaagaagagttgttatttacttatttttttgtttgttcagtattttactttgtttttacaacagagtggtggcttccaagctttttcaatgtagaattggacagcagaagtcccatattattttcaagtgcccatgtaatagatacccaattgagccatattcttatcatagcacaaactttaatacatttaaggaattgaaatcttgcagaataatgtatatcgtaacaacagtggaatctaactagaaatgaataatagaagattacagaaaaatctgaagcacttggaagcagaacagcacatcctaaataatccatgggtttaaaaggaagcttccaaggaaatctaaaatcacactgaactgaatgaaaatgaaaatacaaattataaattgtgagatagagctaaaacagtgttgagagagaaatttatagcattgagtacatctttaatgaaagagaaaatgtattcaatcaattatccaagctcccatctcaagatcctagggaaaaataaaccacatgacacagaacaaaaataaaaaagttaagagagaaaattaagaaaacataaatactaaaacaataaagaaacatgatgaaaaaatctgatacaaatatcactaaaacttccaaacctctagaaaaacataataaaaaagagagaagacacaatatcagaaattaaagagaggatatcactactggctctataggcatcaaaagaataatactaaggatagtaatgaacacataaatacaaaaacttagtcaaaatagatacctacattacacctatatgatgtagattatttcaacagggctatgattattaagaaaattgaatttataattttcaatttttaaagaagtatccaggccaaattggatttgctggaaaattctatcaaacatttaaagaattaacaatgttacacaatttctactagaaaatagaagactaaacactccacaattttaggaatttaatattactctgataccaacatcagacaaagacagtacaaagatagaaaacacatatcaatatgccttataagaatggactcaacagtctctcacaaaatattagtaaatggaattagtaatatataaaaagacattcaccatgaacaagcagggatttttccatgaatgtaagcttagttccatatttgaaaatcaatcaatataatccatagtataaaccaaaaaagagaaattacattaccgtaagaaataacgtagaaaaaattgacaaatttaacacaaatttgtgataactctcagaaaatagaaattgaggggagctaccttaacacgatgaacagtatctacagaaagcctggagcttatgttatgcttgatgatataacactgtttttcccctaagatatggaatgtagcaaggatgtctactgtgaaattcttattcataatagtgttggacaatcaatacaaaagataaggaaataaaagtcctacagatgggaaaaaaagaaacaaaactgttctcaatttcagatggcatgcgtttctaggaagaaaatctcaaggaatatacaaatataaattatagaactaatatcttatctcctgcaaccttcagtaaagtcaccagatataagataaacatttagacatcatatttaaatatattagcaataaatacatgacatcagtatttaaaatgtgatattacttacaatcactaaacaaaatttgaaataactctaaatctaacaaaccatgtacagggcttgtatgcagataaatacaaaatactgatgaagcaagcaaggaagaactacataaatggaaagatatgtgtgtttagagattgaaggaatcaacatattgaagatgtaaattctccctcaagttaacatactgatttagcacagttctcatcaaaatcccagcaatactttttgacatataggtaatattattgtaaaatatatctgtataagacaaaatattagaacagctgaaacaattttggtgtgtaaaaataaagtgggaggaatcagtctatctggttttaagactgattagatagttgtagtatccaaggctgcatgaaatttttgaagagagagacacacagatcaagagaaaggatagaaaaccagaaatagacttatgcaaattctgctcaagtgatttttttttttttgcaaaagtgaaaaggaattcaaaggaaaaaagataacattttaaacaaatagtgtaggggtgactggacatccatgatgaaataaataaaagaattaatttttagaaattttgcctcacattttatacagaattaaaacaaaatgtatcatagacttaaatgtaaaatgtaacactataacattttagataaaaattcatcttcatgatatgagatcaggtgatgagttttttaatttgacaacaaaaacaggattcataaaggaaaactgattataatttgaccttatcaaaattaaacaaatttaatgtgaaaaatcctggcaagaggatgaaaatacaagccagagatgcgtagaaatacttaaaaaacacatatctaacaaatgggctagtttatagcatgtgtaaataactctcaaactccctagcataaaaagaaacaattcctgcagagtgcagtggttcacgcctgtaatcccaacactctgagagtctgaagcaggccgatcacttgaggtgaggagtttaagagcagcctagccaacatggcaaaaacccttctctactaaaaatacaaaaattagccaggcatggtggcacatgcctgtaatcccagctattcaggatgctgagggaggagaatcatttgaacccgggaggcgggggtcgcagtgagtcgagatcgtgtcacaacactccagcctgggcaacagaataagtagctggtggaattaaattgtcaatcttctcctagtaagaaagtgattgaaggtggtaacagaagaaataatcttgggagataaactgaaaatattaactgctttatgttcttagtcaaaaattcagaatttacgcagcatgctaatccctatagattttctgtttgaacaaaagtgacaatgatctaatctttaacaatactcaaaaatgttacaaaactccttttattcaaaaatctactttgcaattgtttctaaatgatttccaaaaatcctgtcagtcgttaacaagagtaaatcttaaatacacataactttatactatctccttgcattatgttctttcgatttgacattctgagtgtcagaatgatttaacttaacataaattacatcaggaatatttttatattgtacttggttgtttacatattaatgacattgacacaaaaaaatacttgttttaattcaatctttgtgaaaagacattactccaaaaggatattgaccttccacttgctatctagggtgacgtctgcagtaaagatttggggaatggccatttccttaaatgctggctggccttaatgcaccctcagatattctatgtcccataataatagccaaggtatgggaatgggatttctaatatgtagggtaagaaaggatgacaggtctgctttactagtaggagaatctcattttgggtagtggaggatataaaaggaaaattaatccagacattagaaacttggaagatttcattattgtaatgaagccaacataggaaatgtgctacattaatcctgctgaggttaaatatttctgagaaaatgtgtgtatttcaggaaaaaatcttcactgaaaatactttagagtcatttcttaattgtgcctcttctcatccattagatgggagtgaatatttaattcatttaatggattaaagtaccaataccagtaaaataccaataatctatattagggattttaaaaagtggatagtaaagttcatatgtaaaaacagataagaagagctcagaaaacactgtaagagaaatctgtgaagggggatttgccctaaaaggtaaaaacaaaccaatacaaaatctgtataataaagccagtgtggtatcagagcagaaataaacagaccagtggaatagaataggaagtctgtaaataggcttatgtgcatatgtcactttttttataagggataagtggcatttcaaatcactaacataaagatgagcatttaataaagggtgctggagcaactgggtagccatttagaaaatgataaggttagatgtacatctaacatcatagacaacaataagctccaaatggatgaggaataaaatgtaaattaaaatcataaaagtgtgaggaaaaaaagatgggtggatttgtctctgaacttggtatagggaaaatgttcctaaggataactcaaaatcagaagcaatcaaataaaagattaatgtattttactacataaaactatttaaaatgcatgccccaaagaccgcaagaacagtcaaaagataactgaaaaacagaaagtatatgtaacatacaccatggttgaagggctaacatcaccattatataaggaattcctaaatgttaagggacagagtagtaaaacttagaaaaatggaaaaccaaatattatcagacaaatgataaataaatattttaaaataaccttcaaaaaggtaaaaagtaaaaactaaatcatagtaaggaaaatgttatttaaaacaaactaagatactattttctatttattatataggtgaaaatttaaagtgtcctgttggtgagtctggagaaacaggtactctcacatattgctggtagaaatgatcatcagtctaaaagtgtaaaagggacatttgaatacacacacatacatgtatttctctcttctctctttctctcaatgatagatagatagagagatagatagatagacagatagatgaatgatagatctatattcttgctttctgaccaggaatcccacttctaggaatctaccttaaagacataccccagtaatacggaaatacataagcctaagatcatttgtgttttattcacaatcacaaaatattaaagacaacctaaatgaccatacttaggagagtggttgaataaattatggcacatctacacaaaagagtttttggcatgagggcaagctctacgcactgagccgggtccatgtataggatatgttattaagtgaaaaaagtaaaatgcaaaagaatgtttgcagtatgctacctctcatgtaaaaaaaaggagtttatatatttatatggttccatttatgtgaagtgttcaaattagtcacactgacagaataagtagatttgtagttacctagagctggagtggaggggatggggagtggatgttaaatggctacaaggccattttgggggaagatgaacatgttctaattagatcatagggatgcttagacaactctgctaatacaccaaaatccactgaattgtatagactttgcagaagtaaagttcatgacatgtagattatatagtactaataaatgttctaaaatttagaaaaaacagaggatttaagaaaacatatatgtatcagattttttgtgccaaaaaatatagggaggaaaaatcacactttaaagagattgattacctattgaggggatggaaatataggagaagagtgaaaacaaagggagaaataaatatagaatattaggaatgaaaagaaactatcacacttctgaatatacatgggatatgggatatagtttggatctttgtcttcatccaaatttcatgttgaattttcacccctaatgctggaggtaggacctggtgggaggtgtttggatcatggaggtggagccctcatggcgtgatgctgtcttcatgatagtgactgagttctcatgggatctagtggttcaaaagtgtgtggcactgccttccctaccacactctctctctctcttgctcttgctcctgctctttccatgtgacatgcctgttcccgctttgccttctgccatgattgtaagccccctgaggcctcccagaagcagaagccgctatgcatccagtggggcttgtagaaccatgagtcaatcaaacctcttttcttataatttactcagtctcaggcatttctttatagcaatacggtaatagactagtacaatatgtttgtatatttttgacttgtagaactatagtagttgttcacatacttgaaaaataaaagaataaataaaatcaaccacaatatgtgggaagtacaaaatcaaatacaaatattaaaaatgaaactagctgtattacaaacgaaaaacataagcacacaaaaatttgggaaaaagtgaactaacctaaataatttcaggaagcaatagtttttgactggatattctaatgctaaagatgaaaataattataaataaatattgagctctagttagtaaagttgtttctcagagggttatgtgtaggtgattctgaaaccatgtgtagactaggattaatcaaagaataaatgtattggaagtaattagagctaagtgtctcaatattgaagaaagaattaaaagaaagggaaggttagaaaaaacactattttggtggaatggcattatagttgtcagtatgaactcttggtttataatatacacatacataggtagatatagaaataaatatagctgtataacaatgtgtggattagtatttatatctctgtttctatctactgaatctatttctctatctctatatctatctttctatctatctacatataatctatctatttcctaggtctatatgctaaaagggcctaggaaaatgatgtcctggtagcaatgaggacaccaaacagagagctctttgtttctaagtatcattctccacttcaaaatgaagaaacaacaacaataaaccagagatttgtggagaagtggttgatctagacctagcactaggaaagtatgagatgagcctggaaattaattgttcataaagaataaggaaatgtcaaaacctgacagagatcccattggccaaaccaggcacaatctgagcaacaaaataagtactgacagtgttggattataactcataaaatagaggtccatgaattggtcataacttaactaaataatggaataaatgaataattcatcctacaaaagaattctaactaatacatatagaaggcacaagggagatacagaaatcatcattaagtaatcattaatgcaggcaagatccactgctgaatgctaatgtgagtaaacagaagtatgaggaaaagcaaaatatttgaatagtctcaaagtacctatctcaagatatgtattagttacacaaggggaaaaatagtaactttaggctgggcatggtggctcatgcctgtaatcccagcactttgggaggccaaggtggacagatcacctgaggccaggagtttgagaccagcctggcaaagatggtgaaaccccgtctctactaaaaaaatgaaaattagcagggcatggttgtgcaaacctgtaatcccaggtacttgagaggttgaggtaggcgaatcactcaaacccaggaggtgaaggctgcagtgagctgagatcatgccactgcaccccagcctgggtgacacagtgagactccatctcaaaaaacaaagtaactttatagtagagaaatacagcaaacaaaacttataagcaagtaatgatgcttaacatcaccagtaacaaaacatctatatttcacaaatcctaatatggtacactgaaaagggaacacctctgttgtattctcatatcatcatcccaaccacaagtaaataaataaaagcaagaagcataacctcaatataatcatgagaaaacatcagagaaacccaaactgagagacattttacaaaataactgaggagtacacataaaatgagtcaagtcataaaaagacaagaaaaaacctggagattgtgtcagaaattggataagactaaggagacactactaaacacaacatggggtattgatttatatcctgaaacatgagaagatcttagtggaaaaagtggtaaaattcaaataagacattgcagtgggataattaaggaatcagagagaccgaggggttgaggaggaattatttaattatttatgtgcaacaactcagttggattaacatccaaaggactgagccccaaacaaagagtccggttaccttttaagcattttggggtggtggtggtgggagatctgtgcagggggaagcatattacagaagtgagaaacaaagacagttattcaattaagacatgcattacatcatttcttacttttcaaggaatagcatgttttacgacttgagtttatctgcctagtgaccttgcagctgcacagctagagaaacaaggtcttcacaatgcctgggaaggggagagataaggctcactagccacagaaaagcaggcagttaattttaaaggactccagctctttctcttcttcagggggaattgggttttcttacatacaactgagtttttgcttacattctttaatttgttttaattcctgttccaacatgttacttggtcaatactgctgaaccaatttaattttcctaaatgtatctttgttatgtaagttgctaccatgaggagcagtgaggtgaggggtacacatgaattctccttattaactttgcaacttttctgtaaacataatattatttcaaaataataataataagaagaatgaggtgctttttacattttggagattcaaaagttgagcaaagaaaagggaatgcaaactgcccaagctgaaacagttgtccatccgtgatttaaaatccaaaagcctgaattcaaaagccattgtcctaaaacattcacacaatgtttagaatgatgaaggcactcaataactgaaggcatttataaattccaatacctcaaactacatagaaatttcatatgaaccggagagcagttttcactgggtgtcagtggaaatgcagtgagaggttttgtggtggtccaaaattacttgaagcattggcagtgggaaagggtcaagaatgtgaatagctcttcagagcatggaaagatgagcataacaacaataaacacatctaaagaccaattgtgaattgtgaatcaccaactggggaacactgaggaaccaagaaaggcattctaaatctgaaaaagttgagtttgtttattagatcaacacagacaaatatgtgtagtgtttccaaaggtagactagcaaggtgctgtcttcttgctgaactttaaagctaattgtcagatgctaaagtttggagtatataatttgtattcaatttagttacatgtttggagaaaagattgtcaattattatgattattccttagtatttaataaaataataggtgatacttttatttggcccatatttgtatattaaaattagacatctataattgaatcagacctcaaacctatattttgattatttaatctaaatgttttccaatcggaaaatgttactttttcttctcatcttatagcacatggaaaaagcaccacactaccctgacaaagacgagaaaaggaactcaaggtgcctcagtgatgcagaatgttatcttcatgcaatcaggttcccttcgcaggtgtgctgtttgtgggattcactgtcagctcccattaattgtatctcctatattccttgtagatggttccctcaatggtgacagcttgttttagcagtagtcctattaacagcgactctcacaagaaatatcctcttcaattgaaatggcttccattcagaacaactcttagttttggcattctgttctatccataatgaatatagctttccccaactagcactccaagcaacatgtgtcatatctccagtgtctctcacctccttacacatgcctaatttcttcacagttaactctcgctactccaaatggatactgtagagtcttttagaaatgcagaatctcaggctctatgctagatttgctaaatcagagactgcattttaacaagatccccacatgatttatttgaccatcagtttaagatgcactgacctaggtgaatcagtgtggcagttttagtaccatattcaaaggccagctcatattggggtccctgaaaagtttttcagcgacagcctgctgcaaaacttctacaaactatgcagaaagactctagactaaccagatattcaaaaaaatgttctaatcaaaattccttacatgtcatttaaaacttgatttttaggccattatgtaaatacctatgattttactttttgtaaaaaaattctgaaagatgccatcacaaaatgtgtttgcttgcactagacaataagctctttcaagaccagtgtacatgagttactgagatagctgaatataaaatactgatttggaaggaccttcaaagattttgttatatattgcttccactttctgaagatgttttaatacttagtgggcatttggaaaagaccttcaaatagtcacctcactcaattattaattatttaatgtacacaacagatttacttccagtcagccatgcttttattatctccttaaaaatattattctatattatccagaatatttgattcttctcatagacatattttaaatctttaagactgtgaattcaattgaagtctatccaattggaataataattaggatttctccttaagaaacttacgcatgagaggtggagccaagatggctgaataggaacaactctagtctataactcccagcatgagtgacacagaagacgggtgatttctgcatttccaattgaggtactaggttcatctcactggggagtgttggaaagtgggtgcaggatattgggtggagtgcactgagcatgagccaaaggcattgcctcagccaggaagtgcaaggggtcagggaattcccattcctattcaaagaaaggggtgacagatggcacctggaaaattgggtcactcccatcccaatattacacttttccagcagtcttatcaaatggcacaccaggagattatatcctgtgcctggctcagagggtcctacgcccatggagcctcattcattgagagcacagcagtctgagatcaaactacaaggtggcagcgacactgggggaggggtgcccacaattgctgaggcttgagtaggtaaacaaagggccaggaaactcgaattgggtggagcccatcacagctcaaggaggccagcctgcctctgtagcctccacctctgggggcagggcattgccaaacaaaaggcagcagaatcctctgcaacttaaatgtccctgtctgacagttttgaagagagtagtggttctctcagcatgcagctggaaatcagagaatggacagactgcctcctcaagtgggtccctgacccccaagtaacctaactgggaggcaccccccagtaggggcagactgacacttcacacagccggttactcctctgagacaaaacttccagaggaatgatcaggcagcaacatttgctgttcaccaatatccgctgttctgcagcctctgctactgatatccaggcaaacagagtctggagtggacgtccagcaaactccaagagacctgcagctgagggtcctgaatgttagaatgaaaactaacaaacagaaaagacatccacaccaaaaccccatctgtacatcaccatcatcaaagaccaaaggtagataaaagcacaaagatggggaaaaaacagaggagaaaaactggaaactctaaaaatcgagtgcctctcctcctccaaaggaacacagctcctcaccagcaatggaacaaagttggatggagaatgactttgacgaattgagagaagaaggcttcagatgatcaaactactttgagcaaaaggaggaagttcaaacccaccaggaagaagttaaaaaccttgaaaaaaaattagacaaatggctaactagaataaccaaggcagagacgtccttaaatgacctgatggagctgaaaaccaaggcaagagaactacgtgaagaatgcacaagcctcagtagccaattcgatcaactggaagaaagggtatcagtgatgaaagatcaaatgaatgaaatgaaacaagaagagaagtttagagaaaaaagaataaaaagaaatgaacaaagcctccaagaaatatgggactatgtcaaaagaccaaatctacatctgattggtgtacctgaaagtgacgggaagaatagaaccaagttggaaaacactctgcaggatattatccaggagaacttccccaatctagcaaggcaggccaacattcacattcaggaaatacagagaatgccacaaagatactcctcgagaaagacaactccaagacacataattgtcagattcaccaaagttgaaatgaaggaaaaaatgttaacggcagacagagagaaaggtcaggttacccacaaagggaagaccatcagactaacagctgatctctcagcagaaactctacaagccagaagatagtgggggccaatattcaacattcttaaagaaaagaattttcaacccagaatttcatatccagccaaactaagcttcataagtgaaggagaaataaaaccctttacagacaagcaaacgctgagagattttgtcaccaccaggcctgccctaaaagagctcgtgaaggaagcactaaacatgcaaatgaacaactggtagcagccactgcaaaaacatgccaaattgtaaagaccatcaaggccaggaagaaactgcatgaactaatgagcaaaataaccagctaacatcataatggttattttattggatcaaattcacacataacaatattaaccttaaatgtaaatgggctaaatgctccaatgaaaaggcacagactgacaaattggataaagagtcaagacccatcagtgtgctgtattcaggaaatgcaactcacatgcagagataacacataggctcaaaataaagggatggaagaagatctaccaagcaagtggaatacaaaaaatggcaggggttgcaatcctagtctctcataaaacagactttaaaccaacaaagatcaaaagagacaaagaaggccattacataatggtaaagggatcaattcaacaagaagacctaactatcctaaatatatatgcacccaatacaggagcactcagattcataaagcaagtccttagagacttagactcccacacaataataatgggagactttaacactcactgtcaacattagacagatcaatgagacagaaagttaacaatgatatccagtaattgaactcagctctccaccaagtggacctaatagacatctacagaactctgcaccccaaatcaacagaatatacattcatctcagcaccacctcacacttattccaaaattgaccacatagttggaagtaaagcacccctcagcaaatgtaaaagaacagaaattataaaaaactgtctctcagaccacagtgcaatcaaattagaactcaggattaagaaactcactcaaaaccactcaactacatggaaactgaacaacctgctcctgaatgactactgggtacataacgaaatgaaggcagaaataaagatgttctttgaaaccaacaagaacaaagacacaacataccagaatctctgggacacattcaaagcagtgtgtagagggaaatttatagcactaaatgtccaaaagagaaagcaggaaagatctaaaattgacaccctaacaacatcattaaacgaactagagaagcaagagcaaacacattcaaaagctagcagaaggcaagaaataactaagatcagagcagaactgaaagaaatagagatgcaaaaaacccttcaaaaaatcagggaatcccagagctggttttttgaaaagatcaaaaaaattgatagaccactagcaagactaataaagaaaaaaagagagaagaatcaaatagatgcattaaaaaatgataaaggggatatcaccaccaatcccacagaaatacaaactaccatcggagaataacataaacacctctatgcaaataaactagaaaatctagaagaaatggataaattcctcaacacatacaccctcccaagtctaaaccagcaagaagttgaatccctgaatagaccaataacaggctctcaaattgaggcaaaaattagtagcttaccaaccagaaaaagtccaggactagatggattcacagctgaattctaccagaggtacaacgaggagatggtagcattccttctgaaactattccaatcattagaaaaagagggtatcctccctaactcattttatgaggtcagcatcatcctgataccaaagcctgatagagacacaacaaaaaaagagaattttagaccaatatccctgatgaacatcgatgcaaaaatcctcaataaaatacaggaaaccgaatccagcagcacatcaaaaagcttatccaccatgatcaagtgggcttcatccctgcgatgcaaggctggttcaacatacagaaatcaataaacataatccagcatataaacagaaccaatgacaaaaaccatatgattatctcaatagatgcagaaaaggcatttgacaaaattcaataactcttcatgctaaaaactctcaataaattagtaggtattgatgggacatatctcaaaataataagagctatctatgacaaacccacagccaatatcatactgaatgggcaaaaactggaggcattccctttgaaaactggcacaagacagggatgccctctctcaccactcctattcaacatagtgttggaagttctggccggggcaatcaggcaggagaaggaaataaagggtattcaatttggaaagaggaagccaaattgtccctgtttgcagatgacatgattgtatatctagaaaaccccattgtctcagcccaaaatctccttaagctgataggcaacttcagcaatgtctcaggatacaaaatcaacgtgcaaaaatcacaagcattcttatacaccaacaacagacaaacagagagccaaatcatgagtgaactcccattcacaattgcttcaaagagaataaaattcttaggaatccaacttacaagggacatgaaggacctcttcaaggagaactacaaaccactgctcaatgaaatgaaagcggatacaaacaaatggaagaatattccatgctcatgggtaggaagaatcaaaatcctgaaaatggccatactgcccaaggtaatttatagattcaatgccatccccatcaagctaccaatgactttcttcacagaattggaaaaaactattttaaagttcatatggaaccaaaaaagagcgcacattgctaagtcaatccaaagccaaagaacaaagctggaggcatcacactacctgacttcaaactatactacaaggctacagtaaccaaaacagcatggtactggtaccaaaacagagatatagaacaatggaacagaacagagccctcagaaataatgctgcacatctacaactatctgatctttgacaaacctgagaaaaacaagcaatggggaaaggattccctatttaataaatggtgccgggaaaactggctagccatatgtagaaagctgaaactggatcccttccttaaaccttatacaaaaattaattcaagatggattaaagacttaagtgttagacctaaaaccataaaaaccctggaagaaaatgtagacaataccattcaggacataggcatgggcaagaactttatgtctaaaacaccaaaagcaatgacaacacaagccaaaattgatgaatgggatctaattaaactaaagagcttctgcacagcaaaagaaactaccatcagagtgaacaagcaacctacggaatgggagaaaatttttgccatctactcttctgacaaagggctaatatccaaaatctacaatgaactcaaacaaatttacaggaaaaaacaaccctatcaaaaagtgagcgaaggatattaacagccacctctcaaaagaagacatttatgcagccaacagactcatgaaaaaatgctcatcatcactggccatcagagaaatgcaaatcacaaccacaatgagataccatctcacaccagttagaatggtgatcatcaaaaagtcaggaaacaacaggtgctggagaggatgtggagaaataggaacacttttaccctgttggtgggactgtaaactagttcaaccattgtggaagtcagtgtggcaattcctcagggatctagaactagaaatgccatttgacccagccatcccattactgagcatatacccaaaggactataaatcatgctgctataacgacacatgcacacgtatgtttattgaggcactattctcaatagcaaagacttggaaccaacccaaatgtccaacaatgatagactggattaagaaactgtggcacgtatacaccatggaatactatgcagccataaaaaatggggagttcatgtccttttagggacacggatgaagctggaaaccatcatcctcagcaaactattgcaaggacgaaaaaccaaacaccgcatgttctcactcataagtgggaatcgaacaatgagaacacatgaacacaggaaggggaacatcacacaccggggcctgttgtggggtggggggagggggagggatagcattaggagatatacctaatgttaaatgacgaattactgggtgcagcacaccaacatggcacatgtatacatatgtaactaacctgcacgttatgcacatgtaccctaaaacttaaagtataataaaaaaaattatccaccaggcgtggtggctcatgcctgtaatcccagcactttgggaggctaaggcaggcggatcatgaggtcaggagtttgagaccagcctgtccaatatgatgaaaccccgtctcttctaaaaatacaaaaattagttgggcatcatggcaattgcctgtaattccagctattcaggagcctgagtcaggagaatcacttgaacccaggaggcagagattgtagtgaactgagattgtgccactgcactccagcctgggtgacagaatgacactctgtctcaaaaaaaaattgttaaattttcgtaacaacctattgaaataaggcagcaaaatcctcactttgtagaagaagacattgagcctatgagaagtaggttctccaagaacaaatagctgttcattatggagctaggccttatgcagagttgggacactttctattatgtcaagctaaggcaagttaatttactgagtcacagtgccctcgatttatgagtatttcacctttttttctctttaattagaagcttattgagaagcttgtggaatgtaggcgtaagtgtattggataattaaagttttgatattctgatattgttggaactacttgaagaatttaacatttggtaagtatttttcatatgagtattaaaatagtaattttacttattatatgtttatacatagaatttgtcaattactttctgactacaaagacaaacagatacaaaaaagccgttctctcaacagcaatccaagtaagacttctgacagtgaattactctaggtcagtggttcccactctttttggcaccagggaccggttttgtggacgacaatttttccatggactggaggaaggaggggatggtcttgggatgattccagcacattacatttattgtgctactttatattattatattgtaatatataatgaaataatgatacaactctccataatgtagagttagtgagatccctgaacttgttttcctgtcactggatgttctcatctggaggcaatgggagaaagtgacagatcatcaggcattggattctcataagaagcacacaacctagatccctagcatgtacagtttatagcagggttcatgctccaatgagtatctaattctacctctgatctgacaggaggtggagctcaagtgggaataggagaaatggggtgtggctgtatatacagataaagctttgctggcttacctgccactcacctcttgctgtgtggcctggttcctaacaggccatgggctggtaccagtttgttgcccaggagttgtggacccctgcgctaggtggtcctaccatagataagaaagtaaaagtaaggaagtttttatcacaaaaaaaaaacagtttgaaaaatcactgtgtataaattgcatgtatatattttacaattttttttgagagtaggttcgatttcagaattatttaaaaatttcattttaggtgatttataatttcaaatatctgaaaaatttaattatggtctctaaaatcttgtataatatttttatgtaaataagaaaaacacaagttagtacatggtatatcttttttacggtcacatgataacaaattggacttgttatacaattgaatcttctatttaattatttaaataaatggtttgctttgagcaaatgaatgttaattacagttgacccttgaacagtgtaggacttaggggtaccaatcctccatgcagccaaaaatctatgtataacttttgacttccctcataacttaactactaatagcctactgttgaccagaagccttattggtaacacagtcagttaagatgatatttggtgtgttataagtattgtatgttgtatttgtacaataaactggagaaaagaaactgtcgggaagaaaaaatataattaatatcaagtggaagtggatcatcataaatgtcttcatccttaatcttcaagttgaataggctgaagaggagaaagagggaggttgggcttgctgtctgaggtgacagaggtagaagaaaatctgcatatgagtagtagacccctacagttcaagcctgtgttggtcaaaggttagctatattacactgaggtttgtgtcactaaaaaagtaactatctttaaaagtggaaactcagcaatacctttctaataccataagcaaatgagaatgagaactgcaagacttagtcagtgtgcagcaacaccaatgagaaattattttttttaaagatacctacagaagtgtccctgtctgacagctttgaagagagcagtggttttcccagcatgcagctggagatctgagaatgggcagactgcctcctcaagtgggtacctgacccctgacccctgagcagcctaactgggaggcaccccccagcaggggcagactgacatctcacacatctggccaggtactccaacagacctgcagctgagggtcttgtgtgttagaaggaaaactaacgaacagaaaggacatccacaccaaaaacccatctgtacatcaccatcatcaaagaccaaaagtagataaaaccacaaagatggggaaaaaacagagcagaaaaactggaaactctaaaaagcagagtgcctctccacctccaaaggaacgcagttcctcaccagcaatggaacaaatctggacggagaatgactttgacgagctgagagaagaaagcttcagatgatcaaattactccaagctacgggaggacattcaaatcaaaggcaaagaagctgaaaactttgaaaaaaatttaggagaatgtataactagaataaccaatacagagaagtgcttaaaggagctgatggagctgaaaaccaaggctcgagaactacctgaagaatgcagaagcctcaggagccaatgcaatcaactggaagaaagggtatcagcgatggaagatgaaatgaatgaaatgaagtgagaagggaagtttagagaaaaaaacaataaaaagaaacgagcaaagcctccaagaaatatgggactatgtcaaaagaccaaatctacatctgattggtgtacctgaaagtgacggagagaatggaaccaagttggaaaacactctgaagaatattatccaggagaacttccccaatctagcaaggcaggccaacattcacattcaggaaatacggagaatgccgcaaagatactccttgagaagagcaactccaagacacataattgtcagattcaccaaagttgaaatgaaggaaaaaatgttaaaggcagccaaggagataggtcgggttacccacaaagggaagcccatcagactaacagcggatctctcagcagaaattctacaagccagaagagagtgggggccaatattcaacattcttaaagaaaagaattttcaatccagaatttcatatccagccaaactaatcttcataagtgaaggagaaataaaatactttacagacaagcaaatgctgagagatttcgtcaccaccaggcctgtcctaaaagtgctcttgaaggaagcactaaacatggaaaggaacaaccggtaccagccactgcaaaatcatgccaaaatgtaaagaccatcgatgctaggaagaaactgcatgaactaatgagcaaaataaccagctaacatcataatggcaggatcaaattcacacataacaatattaactttaaatgtaaatggactaaatgctccaattaaaagacacagactggcaaattggataaggagtcaagacccatcagtgtgctgtattcaggaaacccatctcacgtgcagagacacatataggctcaaaataaaaggatggaggaagatctatcaagcaaatggaaaacaaaaaaaggcaggggttgcaatcctagtctctgataaaacagacattaaaccaacaatgatcaaaagagacaaagaaggccattacataatggtaaagggatcaattcaacaagaagagctaactatcctaaatatatatgcacccaatactggagcaccccaattcataaagcaagttctgagtgacctacaaagagacttacactcccacacattaataatgggagactttaacaccccactgtcaacattagacagatcattgagacagaaagtcaataaggatacccaggaattgaactcagctctgcacccagtggacctaatagacatctacagaactctccaccccaaatcaacagagtatacattttttcagcaccacaccacacctattccaaaattgaccacatacttggaagtaaaactctcctcagcaaatgtaaaagaacagaaattataacaaactgtctctcagaccacagtgcaatcaaactagaactcaggattaagaatctcattcaaaaacgctcaactacatggaaactgaacaacctgctcctgaatgactactgggtacataacgaaataaaggcagaaataaagatgttctttgaaaccaacgagaacaaagacacaacataccagaatctctgggacgcactcaaagcagtgtgtagagggaaatttatagcactaaatgcccacaagggaaagcaggaaagattgaaaattgacaccctaacatcacaattaaaagaactagaaaagcaagagcaaacacattcaaaagctagcagaaggcaagaaataactaaaatcagagcagaactgaaggaaatagagacacaaaaaactcttcaaaaaattaatgaatccaggagctggttttttgaaaggatcaacaaaattgatagaccgctagcaagactaataagaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattcctcgacacagacactctcccaagactaaagcaggaagaagttgaatctctgaatagaccaataacaggatctgaaattgtggcaataatcaatagcttaccaaccaaaaagagtccaggaccagatggattcacagccaaattctaccagaggtacaaggaggaactggtaccattccttctgaaactattccaatcaatagaaaaagagggaatcctccctaactcattttatgaggccagcatcatcctgataccaaagccgggtggaggcacaaccaaaaaaagaattttagaccaatatccttgatgaacattgatgcaaaaatcctcaataaaatactggcaaaccaaatccagcagcacatcaaaaagcttatccaccatgatcaagtgggcttcatcctgggatgcaaggctggttcaatatacacaaatgaataaatgtaatccagcatataaacagaaccaaagacaaaaaccacatgattatctcaatagatgcagaaaaggccttagacaaaattcaacaaccttcatgataagaactgtcaataaattgggtattgatgggacgtatctcaaaataataagagctatctatgacaaacccacagccaatatcatactcaataaattaggtagtgatgggacgtatttcaaaataataagagctgtctatgacaaacccacagccgatatcatactgaatgggcaaaaactggaagcattccctttgaaaactggcacaagacagggatgccctctctcaccactcctattcaacatagtgttggaagttctggccagggcaattaggcaggagaaggaaataacgggtattcaattaggaaaagaggaagtcaaattgtccctgtttacagttgacatgattgtatatctagaaaaccccattgtctcagctcaaaatctccttaagctgataagcaacttcagcaaagtctcaggatacaaaatcaatgtacaaaaatcacaagcattcttatacaccaacaacagacagacagagagccaaatcatgagtgaactcccattcataattgcttcaaagaaaataaaatacctaggaatccaacttacaagggatgtgaaggacctcttcaaggagaactacaaaccactgctcaatgaaataaaagaggacacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccacatcaccaagtcaatccaaagccaaaagaacaaagctggaggcatcacactacctgacttcaaactatactacaaggctacagtaaccaaaacagagatatagaccaatggaacagaacagagccctcagaaagaatgccgcatatctacaactatctgatctttgacaaacctgagaaaaacaagcaatggggaaatgattccctatttaataaatggtgctgggaaaactggctagccatatggagaaagctgaaactggatcccttccttacaccttatacaaaaatcaattcaagatggattaaagacttaaacgttagacctaaaaccataaataccctagaagaaagcctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtggacaggaaacctacaaaatgggagaaaattttcacaatctactcctctgacaaagggctaatatccagaatctacaatgaactccaacaaatttacaagaaagaaacaaagaaccccatcaaaaagtgggtaaaggatatgaacagacacttctcaaaagaagacatttatgcagccaacagacacatgaaaaaatgctcatcgttactgtccatcagagaaatacaaatcaaaaccacaatgtgatatcatctcacaccagttagaatggcaatcattaaaaagtcaggaaacaacaggtgctggagaggatgtggagaaataggaacacttttaccctgttggtgggactgtaaactagttcaacctttgtggaagacaatgtggcaattcctcagggatctagaactagaaataccatttgacccagccatcccattactgggtatatacccaaaggaatatgaatcatgctgctataaagacacatacactcatatgtttattgcagcactattcacaatagcaaagacctggaaccaacccaaatgtccaatgatagactggattaagaaaatgtggcacatatataccatggaatactatgcagccataaaaaatgatgagttcatgtcctttgtagggacatggatgaaattcgaaatcatcattctcagcaaactttctcaagaacaaaaaaccaaacaccgcatattctcactcataggtgggaattgaacaatgagaacacatggacacaggaaggggaacatcacactctggggactgttgtggggtgggggaaggggggagggatagcattgggagatatacctaatgctagatgatgagttaatgggtgcagcacaccagtatggcacatgtatacatatgtaactaacctgcacattgtgcacatgtaccctaaaacttaaagtataataataataaaaaaaaccagctaaaggaaaagaaatattttgagaacactgaaaatatgaaaaaaagaatgataatcttctaaaagctataaaattgaatgaggaaactttaacaaaagaggtatttcactacaatgaacagcttagcattttgacaactgagaataaaatgcttggttttaaactgggggatataaagcaccacaaggaaagactggaaacagaaattcaatcatataattgtagactggccactgctgtatatttttgtgaccaaagtgagaaagcaaaaagagacctctttccagagaataagacacaaataggttcatttacaggagaaaatgaagtttgatatgcctaccctaaaaggtaacagtgaggttctttctgaacaactctctaatgctgacagtaaaattaacagcctaaaaattaagctccatcacacaagataaacactcggagaaaagacttcagttttagaacatttccaaagagatctatgccaaacacagacagtgtcaaaagaaagaaattgaacaaatgtgtcaaaatgaacaaagcagagtaaataaatatactggagtgcagaaacctatgaagacagattttctcaactacaaagtgaaaataatttgctttggcagcaactggatgatgctgacaagaaagctgagagtcaagaaaagacaatcagtactatccaagagcaattccatgctgttgtcagaaatcttctagctgagagtataaagtcttctgctggaagaggaaaacgaggagataatcaatgtacgtaatcccttgaaagaaagaatatatcaatgtgaaaaagagacagtgggaaaaaagtaagtattaacaaagatatttttcaaacttcctgaaagaaaatttaaagtaatatttggttatggtaaatgttatatgtatttgaatataaaaatatgtagaccataaaatatatttgctgtacggcctagaaacataccagcaaaaaaaggtagacctgaaatttgccttattttgaacaacgaaattgtatcacctttgaaattttaagactttattttacaaatttactatatatagactaatagttctaatgtggacttctgctgaaataattttaatatctctctgtggactaattttaagaccatgatgagacagataaacagaaatgccttttacctgaaatgaattttttgaaattaagattcaatcatgtgggttactttgacagttatttccagatttcccaggtgaactgaaatatactgctgtatctcatagtacttttttaaggtagctttttatgtatttatgttggtgtagttttatttttatttttactgatttgacttaaatctgagactttaagtctcacattattgttatgacctctcaattatttgaaggcatttactttttataaaatcattatttggaacagatgtgaatttccagcaaaaccatatttgatttagtcgtacctctggtgtttataattttaatgttcttaaaagtaatttgctcatgatttttatcttatggctcaatgactgtcatttggctataaccttgtccagtacaaagataattgtgtttgtctgcagttgctttgtttagcattgggttttcattttaaagctaatgagggatggcagaattcacatacagttggaatggaatgagtaggggagagagttataggaactgaggtaagggagggaggtggaggccaggttacctagggcctccaaatgtcattggaattttacttttattctgaggtagaaatctattagaaggatctgagcaggcaattgaatatgtgaggagtggggaggtttatttgaggttctgataaaaaagaggaaagacattttacactccagcattttccaccactagtgccacccacataccgaatttttgggacttcagtaggttgttaagcattgtaaatgtatcaggggttaatgaatagtgggctgattctgtcatctagcagaatactcatttggaaggaatataacacctgtgtccttaactgaattcagtaataagaatgtatacacatgaggaaaagaaggtgaatccatgtatgtggtgctatttttcaaagtatatgttgaatgttatgatcatgttttaataataaggtgatatatgaaatcagtaacaaaaatatcttaacaggtaattatgagacaacttctacaagaaccggctgataccctgaaaaaaaacctgtcagagccttccctagaggctacaccacattgtcacattaatttagaagagacacaagattcaaagaaggaattaggtaaaatcagagtcaagtatgtatgaaatgtaacatgtcaacagttaatctgtaggtggtggaggaatatatagttttaggatgctaattgcagtggatagatttcttttgtattttcattacaattaattttattatctttatcatgcacttatttcttctgacttttcagtctgtcatgtttttctcataagtatgtacattttaaagataatatttacccttaagaaagctgggaattatacatcattcctcacagaagttgagagacttttttttgtgtgtgaaacagtatttttcagggatttctctgttgccatgttgaggcaagccagattacatcagaggataatgttcaatagaatgttccagaaaagcatcttattgcttatcttactttcttggatgggtgcagaatctttgtatatttattgcatgaattttaggataacttgtacagaaaggccattatacttttctccaaaatgcagatgttttaggttaatttacaaagtacttgaaatgttaagcattcccttcttttttctttcattttaagtatattgtaaaagcatggaaatgctcagtttgtgtagagtatatacatccaaattagaggattaagaaacgtatctagatcctaccattgggattttaaaagacaattgtagtgatgtataatttgaacaccatacagttcacatggtctcttagtatattcacagagttgtatagccatcaccatcaccaattttagaatattttcatgatcctaaaaagaaacagtgcatcattttgctattatccaccagtttgcccttcctcagctctagggaaccaccagcctactttgtctttatagagttgcctattctggacatttcatatcagttgaaccacacaatatgtggtggtcttttgtgattgggttctttcacataggataaggttttaaggctcatctgtgttgtaacatatatcagtactcaattccctcttattgctgagtaatattccactgtgtggatatatcagtcattttatttactcattcctcagttgtggacctttgaattgtttccattctttggctattaatcatgtctgcttttatgtacaagtttttgtgttttcatttctcttgggtgtatgcatacaagtggaattgctgggtcatattgtaactctatatgtaacattttgaggagctgccagtctgttttccagagtggctgtatcattttacattcctatcagaattgtgtaagggttccaacttctctatttctttgccaacatttttcacatttttgattaagaaaagatttcctcttagtggtgtgaaatgatacctcattctggttcgatttgcatttccataattccctatgatacctcattttggttcgatttgcatttccctaatgactaattactttaatcatctttttacgtgcttcggagtgacttgtgtatcttctttggagaaatgtctattaaaatgcagcctatttttaaaagtggttgcctttttgtttgtgaatccataagatccttaacagatatgattctcaagtattttctttcactcaataggcttttttaaaactttcttgatgatgtctgttcacgtgcagacatttcaaattttgatagtcattaatctttttttgcagtcacaaagatttatgtctatgctttcttctaaaaattttatagttttagctcttatatttagtgattctattttgagttaattttagatacagcatatgccaggagtctatttttattcttttgcatgtagatacctagttttcccagcaccatttgtggaaaagactattcttttaaataaattaatattcttttttaagtgttgttctttttggcacccttgttgaaaatcaattgaccataaatgtgagtttatttttggattctcaattctaatatgttgatttatgtctactgttatgccattaccaaagcaaattttagaattgttttccaatcgtgttacttattattaccaattgcctaaagtaagaatagaaattcaagtactaggtagcctttaacttcactgtttgcttcttgaaggaacatgtggtcagcttatattatggtaacttcatgcttaaccttttgaggagctgccagtttgttttccaaagtggctgcaccactttacatttccagcagcattgtataagggctttaatttctttacatttttgctaatatttatattttcctaatgactaattacattaagcatcgattaatgtgcttatatccatcttttcttctttgcaaaatttctattcaaaatctttgcccatttttaattgggtcatctttttatttatgaattgaaagggttctttatatatcctagatataagtcccttatcagatatatgctttccaaatattttcttctactcgttgacttgacttttcactttcttgactgttttctcacacacagaatttttcagttttgaagtccattgaatccatttttcctttggagtcagagctaagaaaacactgccaaatgtagttacaaagacttatgccaatgttttcttctgaaagttttagagttttagctgttacagttagctgttttattttgagttaattattaaatatggtatttagtgagagtccaactttattatgtttttgcatatggatacccagttgtcccagcaccatttgtctaaaagactattcttttcccatttcattgttttgttaaccctgtaaaaaatcaattgactgaatacgcaggtttattttttaatgatcagttctttgtttatgtctattcttatgccagggccaaattgaatttaataagtttttttcaatcatgttgcatattaccagttgtcttatgtcataataaatattaaatatagtggaacatctttaacttcaccttctgcatctccagagagtctgtggtcagcttatactttacttatcctaagacatgatgagaagtcaggcttacaagacacaattcatttctttttttttcctccattcaagcctttagtgtcttatccagtgcctccctctatagtttcattttcagtaaattttggtcgcaggatccgctgacatagcctactatttagtgcattatgtcttattaactcattataattcatagaatcatccatagatgcttaccatctagaaaggagaagtttaagtctgagctgccagctttcctcagtggaagtcaagtgaagttatcatctttcaattcgcagatcctttttccacctggtagctggttctcttgtgtagcactgtggctgatccttttcttggtgcagatcctgcattctcagaaaccacagttccctgtattgacctcgttttactgaaacagagatgcacagctgtgctttgtagcttagtagaagattcttggagtaaaaagtttaactcattgcaagaaaaatatttaggagtgcagcgcttaaaaatctggtaatgttcaggaaatttatcagtagtagattagtaatttgaattttaaaatttcagagtcaacttgtgtgctatagagaagcgttgtggtataacatagagatgggatggtcttaacttctccatacaaacaagcttgaagtaaggatgaaggagaaatcgcatttgatttcttaacactcaaggcacactacatttattttacttctgtgaagattaaaaataattccatcgtgttctccttgtttccccactgagtaaaggaaaatgaaaatggaatactagattgattaataaatactcaaagctgcttacttttagaatttttagttaattgaaatcaggtaaactgtctgattttggttatttaaccaagtagttctagttgtttttaaaaatcacgtcttcttgctttccagtcttatttcctaacttgaggggaaattctaaggagacacccttgccttgtcatcagagttcataattgaagggagttttaggaaaagttcatcctcaggaacttatgtctctctcccagttatctgctgcttctcaataatgcttgtcatcaataaattaatctcaacatttatttgattctactttaaaagagactcttttctgctgtgtaagttatgtttcctgttgtctcttttttaaaatcatttttttctaacaattacccagagtttagtggcgtaaaagagaaacatttaaggctgggcacggtggctcatgcttgtaatcccagcactttgtgaggcagaggtgggtggatcatgaggtcaggagttcaagaccagcctggccaagatggtgaaaccccgtctctaataaaaatactaaaaaaagaacaacatttattttgctcatgaatctgtggcttggaaaaagcttggccaggacagcttgtctctgcttccctcagcttccctaggaacagctgaatgactggggaaatggaatcatcagatgctttgttcaaccatgtgtttgatggttaatgctggccattggctggaaccttggtttgggcaggcagcatgaacactgacactggcactcccaggctctctttgtggcctgagctctctcttagtctgggggctgggtttgaagggaaagcagttggagatagagaagccacatggaatcccttattactgcattcttttcattagaaggaagtcagtaaggttggcccgtattctatttttttagtgggatgaatttatcttctcttttgtttttaattgacatgtatatacaaaattatgagttataaagttatattttgatacatgtatatagtgtgtattgatcaaggtattactagcatatttattacctcaatcatttttcaaaaagtcttccagctttttgaaaatatacaataaatcatagttaagcatattcaccctacaatgctacaggacgccagaactcattccttttttataactgtaattctgtatctattaaccagcctcccctcccttacttccttgagttttttgttgttgttaagagacagggtcttgctagtctagtctgggccctgggcaactgcagtcactcagactagagacaatgatttgatcatagctcactgcagcctcaaactcttgggctcatatgatcaccccaccttagcctcctgagcagccaggattacgggtgtgcaccactgcacctgtctgattttttactttgtagacatgaggtctcatgatgttgcccaggctggtctggaacttttggcctcaagcagttctcctgccttggtcttttaaagtgctaggaaattgcaggcatgagccatgttgtccagccttcaatttttctttagctcccacacatgagtgagaatgtgcagtatttttctttctgtgcctgcacttaacattctccagactcatccacgtggcaacaaataacaagatttcattcctctatatgtggaatactattccattttgtatgtatactacattttttgtccatttgttgatggacatataggttgattccatacattagctgttgtaaatagtgctacaataaatgtacgagtacagttatccttttgatcttttgttttcgattggctgaatactcagtagtgggtttgctggatccctcagcagttccaatactagttttttgagaaatcctcatgttgttttctgtagtggctgcactaatttaccttcctatcaccagcatataagagtttactgttctctgaaaccttacctgcatttgttattttttgtcttttcaatgatagtcatttatttgaactggagtgagattatacctcgttgtaggtttgatttgtgtttccctgatgattagtgatactgagcatttttaaatgtatttatttgccatgtgtatttctttttttgaaaaagaaatgtgtattcagatcttttgccttattttgaattcagattttttttaatgtcaagtgtttgcgttcttgtatattttggatattagtcctttattagatgaatagtttgaaagtattttctcccattctacaggttttctgtttactcagttgttttctgggcaaaagctctttagcttaatgtggtaccatttgtctatcatttgttttttgcctatgcttctgatgtcttatccataaaaatctttgtgcagactaatgtcctgaagcatttttcctatatttactgctagtagtttgataattttgggcctgacatttaagtcttcaattcattctgagtttattttggtattggtgttagataggaatctattatcattgttctccatatgtatattcagttttcccagtggcattcatttgaagagggtgtcctttccccaatgtatgttcttggcatcttagtccaaaatcagctggctgtaaatatgtggatttatttctgggtggcatgtgccatagactttaccccaagaatcattacttcttaaaatgcaattcaaattagcataaaacatttgcattttagggaaaggcttatgacattagaatccttatttacaggattcattattttgtctcttttttttgagatatggtctttgtctgttatccaggcagaagtgcagtggtgtggtcataattcactgcagccctgaactctgtgtccaagccacccttttgcctcattctcccaatgagctggatgtacaaggcatgaataattaaaaataatttttttttgtagagatgtggagtctcactgtgtttctgtggctgctctcaaattcctggcctcaagtgatctttctgccacagactcctaaactgctaggattacaggcatgagccaccatgcctagcatagagtgttatattattttcagtgtcttattctgagagccattttttgactttggcctaaatatcttaatatgatatctctgaaactttttttgacaaattatggggaatgatgatgagggaagaggtttataaactttctcctaagagataacttagagccatttaaggaggaacaaaaagaaacaatcagaataataaaagatcaagtgcaaaatttctgcatcaaagatgatgatagtaaagaatatatttttgtgactcatggtggtctaattttgttcttgaatttctgagtaatttaagggttaacatttgaggaatctgctacattacaggtaatattttattccaagtaaatgtatttcaaaaattttattggtttattattaaaccaaaatttttattggttttattattctcagctactgcattatcaagctgtattatttcattcatgcagtttgatgatctcacagcagaattggaagctgtatctttacaatgtgtctatttggctgaaaacaatcaagttactcaacaggagttatctatgaaaaaagtacaacaggaatgtgaaaaacttgaggaaaataaaaagatgttggaagaaggaatagtaaatcttatgacacatatggaaaaatatggtagaacttggtaaagtacaagaatataaattggagctagaagaaaaagcaatgccagcaatagaaaaaaaatagaagaaatccattaacacgttagtttttaaagtcaggtaagtttatctgtaatgtgctttcatttatttcactgcaaattacattttagatattatatgtattgtgtttactctgcctctcatagcaatttgtagagttctagaaacaggtggcatctgtgtttttcttttaaatatttaaatttccatcattattataacaaaattgatctttcagagtaatgattctcactatagactcacttgattgttaagacctgtaggcataagactattaggaaaagagaagattgtgatttagaaattaaatgatacttttgaattggtcttaagctacattgttcattgttcagtttttaaaattataaatggattctattactttttaaatgaccagattgcattaatactaacactactaaacatacactcatagaaaatggaataagcttattaatttgttttgaaagcataatctagtgagatgccttcaggagattagtagaaagtgaatgctaacttgacaatataattttggaaaataatgtcagtaaataatcttacctttaaaacgttagtcagggagaggttcggtgtctccttcctctctctctctctctctcttttgtatggcttttttttcctgaaaaaatctcatgtagttaacttgatctattagtttttttcactaagtatttttgaatcgttataattaataaagtgatcttgttataaaattacttgtcagaattaccctaagtagaaatattaatgagtttaatttactttttggtacatcacaacctaaacccaaagtgtcaagtactactgctgctctgggtatatcctggccctcaggcatggaactgtccttgattgtgatctttagtattatcactatagggcaccttaagaaagactattctgtgtaacattttcaaactacagaaaggcgttcttgtgaaatagggaataattattacaggaatgaaaggaagtgtgattcactaagtggtttcaaaataacaccttgttcagcctgaaggggtgtgtggaagacagaaagaaaaaaccccatctccagtgccttggtcacaatgttaggggctaattgtcttcagagatgctttagttctttttgatcaccaaccaagccatctacttctctactatgagttgttgctcagaattattcatcattgccaaatgcttaattgttcctagataatgggtgaaatgtacaagggtgaaacctgaaactggtttactaagcacaagtatttctagcggtttttttttttggttcattttagatttcttaaatgtatattatttaaggagtacaacaagccgttttgatataactatttatagtgaattggttcttatagtcaaacaacttaacatattcattttgtcacatagttaccctttaaatacaagtatttctaatagaatcttccaaatcttacaagtagagtcattttagaaagcagcaagtgttacctgttcagccccacattactgatagccatttctcttccctctctactttgtttgaattgcttattcagtagaaatcaccctagaaacacatgtacttcttttgaacgactttaaaattataattggttacaacagatatgctctcacacatcttcggtgagaaaacactttagtgggtaatttggtttactctctcagcaacttttaaaaaagtggaagtcattaagactcacttaaggaaaaatgaaatactaagcatttgtctttgctatcttcacagatcaaataagaaaacaagtgatcagcaccaagctccatatggagaaagagtggatgaaagcttttctcagtgctctttctatgaggccaggctcagagccaccttgtgttgaaaatcttaatagtataggactcaacagaaaatgtattcccaaaacacctgtaagaattcctacttcaagcccacagacttcaaattaccttttctattttgggttttatttcactaataatattcttgtttttaatttggtgaaatactgagttgttcagttgacctatgcatgttaagtaaagattatagttagccatattaacacagaaaggaaatgggaactttacttttttttaaattccccagagctctaattttcaagagacacccatttgctaactttattcagtaaatgtaaataaactgacacatttcaactttctttaaaggctgcacttaagttagattttagaaattgcatgttattgcctaataactgaaggtatattttgagatgctttggcttacgctctaattgattgtagtttggctgtggttcatgccacttttaaggtttctttgtaccatctcaactcttcccacccatactcacaaaggaatgattggcatccaaacacttaatcacacatgggtatttactatttaatagaatccaaaataagtgcattttatgaattaaataaacataaaatactaaaagattcatttccatttttattttaaaagccttgtgctcttcttacataagagtacatcctctgactataaaaatcctggaagtaaacctaggaaatattcttctggccatagtggttggcaatgaatatatggctaagtcctgaaaagcaattgcaaggataacaaaaattgacaagtgtgatcaaattaaactaaagagcttctacacagcaaaagaaactatcaagggattgaacagacagcctacagaatggaagaaaatattcacaaactatgcatacagcaaaggcctattatccagaatccataagggacctaaacaaatatacaaacaaaaaataactccattaaaaaatgagcaaaggacatgaacagacacttttcaaaagaacacatataagtagccaacaaacatattaacaattgcttatcactaatcatcagagaaatgcaaaacaaaacaacaagataccatctcacaccaatcagaatgaatattgttaaaaagtaaaaaaaaactggtgttgggaggattggagaaaagggaacaattacacactgttggtggcaataaaaaattagttcagctgctatggagagcagtttggaaattaagaactaagaatgatcattggatgcagcaaccccatttctatgctgggggtatacctaaaggaaaagaaatcatcgtaacaaaaagatgcatgcacatgtatgttccttgcagtactattcacaatagcaaagacatggagtcaaccaaggtgcatccaaggtagactgaaaatccaaagtagattggaaaatttcacatacaccatggattactatgcagccatagaaacaacaaaatcatgtccaacatggatacaactggaatccattatcctaagcaaactatcatagaaacagaaaaccaaatatctcatgttcttactcataatgtgggagataggcattgggttcacactgtcataaacatgggaatagtagacactgggaaataagaacggggagggacagagtaggccagggttgaaaaactacttattggatcctatgctcactacatgggtgacgggttcagttggaccccaaacctcagcattcctcaatatacctttggaagaaacctacacaggtaccaccttgatttagaatacaatctagaaaaaatttactataaaaaaggttactgtaagtggagaatagaaatttctttttaaggaaaagtttactgaagtaaaaaatggattgaacttttataaagggcagaattttgctaagagttttgaagcaatgtattcattgcaaaacatgactttaattgtttaacctttgtactaataaaacaccacctttttaaaattatttatatacaatagaccaatattaattttattgttatcagataaatctaaacagcattacacagatatatcctctattatctaaacttaaaataagtagaaattttattttatttatgtgattatttttctatttaaacaagtgttcaagttatgtgtagtcactaaatatactaaaggccacattttgtaagtgatatattattctcacgataatgtctcttgtttaacttaaacattattattatttttacttgagatggagttggactgtgtagaacaaataattagagaaacaaagaaaagtatgttgccaaaatttattaattaaatttagacttattttagaaataaactgtatatagcaaatggcattccttttcattgttgggttagtagatactatgttattcttttcttacatacatctaatgacagatgtgaaaacaaaaactttcacaatgaagagtatacttatgcaccattaattcatcatgttccatagcttaaaaaattcccaagaagtctatgcatcccttttttactggctctacactttattcacttttgtcattctcatggaactgtcagccagcacactcaaacaattctcagcaaacaaaggcatcatcaggttctcagggttccggtagagacttaagaccaacagacctcatgctcatttagaaatactcagctgagccataaccattcataagcagtcacttgacaggtgacattttaaattttctgtcatttactttgtcattggcttacttttgttctcaggaaaagttctaaatttttcaccatggaataaaaacacctacatcaatgtgattcttgtcaagttactcagccttgtctctagccacttaccacactctgccctttgctctagcaccaaactggatggagtggaactccacagggttcttcctcacctcaggctctttgccttcatctcttccctctatctggcaatcttttcctcgtccttcaggcatcaacctacctatcttctccaccagaaagcctatgatattgacacaaaactgggatagatgactcttctgtgtgttccagtagtaccctgctatatacctgtcatggcatctatgactctatgtggacattgcctgcctgtctgttttttcagattacagcatatgattgttgagaggtggaccatactatcttcatcttgtaattccagtgctggttctagtaccttagcacatggctgttgagtatgtgaatgaagaataaaaagctctcatatttaaccacaattgtaattaattccatgtgtaaatacgagcaaattctatttaatagtaattttgtattataattgtacatacatatttctcattcttattaaccctgataaagttctgaactctttatttatttatttatttattttgagatggagttttgctctttttgtctaggctagagtgcaatggtatgatctcagttcaccgcaacctcctcctcccaggttcaaatgattctcctgcctaagccctacgagtagctgggattacaggaatgtgccaccatgcctggctaattttgtatttttagtagagatggggtttctgcatgttggtcagactggtttcgaactcctaacctcaggtgatctgcccacctcagcctccccaagtgtggggattacaggtgtgagtgactgcacctggccaactctttagtttttaaacttacacatagttaactgaaatgttttaggtaaagaacataattctttatttttctttccagcttttgctgtgttggacattttctcccatctggtttcttctttagaatccactgatgagcaacaactaatgaagagaatatctaaaccataaaatcttaaggaaaaagtttatgatttaaaagacctaaaacatcttaaaactttattactgatctgtgtacatgacattttaattgtttctcataaaatatgtaacatcatgatcttcactaaagtagaatatgtttgtatcatatgtgtgatgaaaatgtatatggtattttaaatgattttttagcctctttaagttttaagttgatcttgtaaatgaaaaccagtattgttgagtttgacatactcaaattgcccagatttcagctgtttaaacagccaaacaatcaagtcatcattgatacttcagtagaggtcattgatggcttattggcattttatagcttttactactatatataataggagacttgaggagtaccagcctggtatgttcgtgctaatgttactatttcctttttttctttttttgagatgaagttttgctcttgtcacccaggctggagtgtaatggcgtgatctcggtcactgcaacctctgcctcctgagttcaagtgactctcctgccttagcctcccgagtagctgaggttacaagcacctgccaccacacccagctaattttttttttttatttttagtagagacggggtttcatcatattggccaggctggtgtcgaactgacttcatgtgatccacccacctcagcctcccagagtgttactatttcctttttgtagttcaacagtattttgtgtggagatattttgaggctctgtaaatatctggttgctcctcaaaacccactagatttagcatttcatggatgacttgtgtttgagcaattattaccgtaatgattgccaaatgattactttcttattctctcctttgttctacatggagaaataaaaccaatacataaccgagaagggaaagctcgtgattctggtcctcaaatgccccaagattaggccagtggtagacatttcaagctcccttcatctcttttttatttgtccccattagtctgtcagcacttttttactttctggcacaagatgctccaagcttatcttgtattttctctgccccagccctggaatgagtgattgttcttagaagcagaggtggagccaccgaggaagcacaggatgagcattccgcagcttgcacttactggtccccagtaggaagaaccactgctgcatccactgaggtaccaagaaagtagcaaagaaccttctgactgtctggggacagtcctcatgtggtccttggctcagcctgaaaggttctggattagtctccttgaagcccctgtgatttgtctctagacctgtgctctgcaggaagggccctgagagaccaagcagcacagggtgtctcatctgccaaatgtccctcccttcctcccactctgagactcaggaataggctagatgatgtgttcaggcagtgccaggccacctcactgtctcctttgagatgggcccagaggaccttggggggtgagtgagaagctgggcacatggagcctgaggctgactgtccctccctgtgtcttggaggaaaggccttgtcccaagaagacccacagggcctgatctgtgggcacacatgcagggagggatggtctgtgggctgactgggacattggaatgagactttgagcactgctgctcaggggcctggtcagtggcccatggtcagtgatgacctggtcatcaggacctggccagttggggcaggatcagggacctcgttagtggtggcctcctcagtgaaggcctcatcaatggggacctgaagacctagtcattggaagactggttagtggtgacctggtcagtggtggccttattagtggggcctggtcagttggaacataaacaaggaaaaagtagttggtgggatctgtatacttggggtctggtcagttggggccttaatgggctgggacctggtcagtgggagcctagtcaggggggcctagccagctagggactaattcatggagaattgtttagtgggattcgggtgagcagcaaccaggtaaattgtggtcttctcagtgggggcctggtcagaggaaaattggtcagtggagtctggtccatggggcctattaatgggggcctagttcgggagagatggccagtgggtacttggtcaatggggacctggtaaatggaagagtggacattaggaacctggctagtgggaacctggccagctggccgctgtgtgacctcaggcagggggtttgtctgaggaacctccttgcctccacctgtagggtaggtgagtcaggtcaccctggagggctactgggaagaggatctgagaagttgtattgaatccagcattgctgggcagacctagcactttacacacgacctagattccacctagggagggtgccagccctctgctgtacccagtgcccctcctctgcatccccatgaccaccctgggtggggaggacagagattggggagctcctgtggagacactaatgctggccccaggccctggtggtgacagtgatgaggacctgggtgcacctgtgagtggagcacctaggcctagccatagaagcaacacaaacacacacatgcacacaaaaacacacacacacatgcacaaacacgttgcacacacacatctcagttcaggggataagggatactgactctgtgccctgtttatccaagcaggctcccattgtgatgggttatgttgccccacgatgtcatcattgctgagcccccagtgcctctgtgttgtggagcagttagagacacatggcagtgtccttgagtggctctgagtgtgggaccattttctaggtgatcactcagcatagcttaccgatcagactcaagtgaatggaacctgccctcttcccttcctcctggctttggaacagttgctaccaggtgagtggtttttccctccagacagttactgagagtaatccctgagcactcactgggtgcctgttctgtgctgacagtcatctcattcatcctaacagcaattccattctgcatcttctctggacacccccaggaccatccaggacaaccctgcctgacaccaggcctagtgtggctccatgataacaaagacgcaggtccagagacaatccccctacatggtgcctgcatctgattccccttggtgggtagtgacgatcacaacatggaagaagccagggcagcttgcagccagctgctgtgcagccccagatggctcctggaccttgggaagtaattctcaaaggggaagctggtcactttgaggtccctggagggatgggtgaatgtggcatactggcaacgctgacagccagcagcatgccatacatctcacctaacatgtgggacagaggccccctccaagagcacgagtctcatacatgaagcatcctgtctcaggcctcatcctgagccctaggaggggaggggtaccgtgggccaccagcagcagccaggattaccacacacgggactcagtattctgtagccctggccagacttagaatttggcccaagacaggacaatatcactcggagcagcatgtcggtacttggggtctgtgcatgccaggcaagaccaacctggctcaaagagcaatcagccacctctataagggtgtcccaggagcaggtggaccagccaccaacctcacccactcaaggaagcagggatagccaggttcccacagcctgagtggccactacataacagctgatggagtagaggcctgaggaaagcagatggcactgggccctacctccagggtagaggaactgatatatctagattggcagcgtgtgaggttggtgactggtccacctgctcctggcacacctttgtggaggtggccgcttgctctttgagccagtttggccttgctggcatgcacaggcctcagtgcaacaactgtgctgcaaatggagccacatggaggaaatgagcagcaggctcaggagcaggctgtgtgctgcctttggggctccagtccatgtatcagttctcacacagcactgagggcttcttgggtgccaagaggcagaccacaggtcattttgaggaggactttatgtccagatgcagaaagggcccaatctggtggatgaaccacatgccagcttctgggtgcaggcacagtgccacatcttccatcacttcctgatatgtgccccaccagcactgaagagacagcctggaaacaggacaatataaaggctgagaagggtgagatggtgagtgccagcttccaaatgaccctgagtccacccccatggtagccttcaacctttaggaatcgaatgctacaccaagaagatggacaacagggcactcaactcaacttcacagccaatgagttgacatgcaagcagatgatggtggcaggctttaagaaggagcatcagaaggcaggcagtttttcttcagcctcagccaggccttggagctggaccaggccatccacttcaccagaggtgccagcaacaccatcagtgagctctctgccaatctgtcccaacaaggcctggaccccatgatgcacctgttattgttgtctcagggacaccagtccaacgtcctggacatcatccatgtacccaaggaagctcttgccaaagtcatggaaagcaggcaacatgtggcagaaaggaagcagaagtgcagaggctgatgacatcaggatcacggtaacaggatttatttggccactttggctgaaattcaccacttccatccaactaaattgagaaacttgaaatcacaaatgcagtatttcttgcaacaagagatactatttttccaaaaagtcacccaggaattgagagtgttgaatgactagatattcaactgcggactttttccagttcaaggataccttctacagcagaataataacactatcaaagagccagtgccagctattgtggtagtacaagtattgttttgtgttagactaaaacccagctgaatattgacttgtgcaggaagcagttaatatggtgatagaatagaaacagcaccaaactaaatcatactacaaatgcttacactacctttgtaacttttggaagaatgataataccatttacttcattgctttttgaagtatgaatattttagtgtatatgctgtagaccttatatttatgaaaagtctcaaagaagctggctggataaagcctgctgtagatggttttatactgaaagattgatgatatgattcaaatatgtgtccccaccaaatttcatgttgaattatgtttcctaatgttgaaggtggaagctggtatgaggtgattgaattatgaaaacaaatttctcatgaatggtttagcaccatcactttgctactctccttgtaatcatgagtgacttcttgtgagatctggtcattgaaaactctatgccacctccttactttccatgttttcctcttgccatgtgagaaaattcagtctttgtcttccacaatgattgaaagatttctgaggcctcccagaagcaaaagccactgtgcttcctgtacactgctgaatcaagggtcagttaaacctctgtttcaaaataaagcacacagaaaatggcaaatgaggattgaacgattgctatgaagatacctgaaagtgtggaagtagctttggaagtaagtaatgggcagaggttggaagatttgagatggctcaagtgaagacagatagatgggaaaatttctggaccatcttagagactgtttaaatggttgtgaccaaaatgctgacagaaacatggacagtgaaggccaggctgagaaaggtctcagattgaaataagaagacttcaagaaaatgtcttccttttggatacggaaatcttacacaatgcctgtaccactattgtaccttagaagcagtgaacttgctttctatttcagcacctcataggcaaaagagactgtagccttggctcagatggtactttgcactttctaactttgagttaatggtggaatgagttaagaatttgggagactgttggcaagggatgattgtttttgcaatatgagaaggacattaaattcgtgggagggacagaataatatggtttatctctacttccctaccagaactcatactccctaatgttagaggtggggcctaggtagaaaaagatttaatcataaaagggtgagggtggatccttcatgaatggtaaagcaacatgcccttaatgctgtcctcctgatagtgagttctcatgagatctggttgtttaaaagggggtggaacctcttttcttgctctgccttgctcccactcttgttgtaggagacatctcattgtccctaagctgtctggtgtgattgggaagctctctgactcttcccagaaacagaagacacaatgcttcctttacagcctgcagaacactcattaaattaaacctctattatttatgataatacagaaatttggtactgcagaggggagctgtgaaatgtcttcaaggccttttcccctttgacttggctatcagcactgggcttctttatgtgcaaatttctgaagacttcttgaatttttccccttaaatggggttttgtgttattgctacatagtcaagctgttacagagatacctgaaaatgtagaagcacgttcagaagtgggtaacaaagaatgggagagtttggagggcttagaggatgacagaaaaatgagggcctggtgagaatgatttgatcatgaacaggaggtgggtgagagtggaagaaaaaaggggtgggtaggatggggagaagtaggttggcagtagggtggtgggagtgtggagggtagtaggaagggggagtagcctgctgtagaggcagagcctcatggaaaacctctattagggcgttgcacctgtggttttgcagggtttagcctccatggctgctctcatggacggggttgctgttgagtgcctgtagcttttccagactgagggtgcaagctgttggtgggtatatgaatctggaatctagaggatgctgatcccctttgtggaagctcaaagcccactattttccttccgcactgccctagcagaggttttccaagaggctctgcttctgcaacaggcttctgcctagaaaccatggtgggtgagggtggaggatggatcctttactaatgggtaagcatcatcttcttgatgctgtcctcatgatatagagttctcatgagatctggttggattacagggtgtggcaccactttcctctctctgtcttgctccttttcctgccatgtgacacatctccttgccccttgaccttttggtatgattgggaggtttcctgattccctccagaagtagaagccactatgcatcctttacagcttgcagaaccatgagccaattaaacctcttttctttatgatcatacagaaaatatagtaccttgaagtggacctaggaaatgacttcaaggacttttctccattttcttggcaatcagcagtcagcttgttttcatgcaaatatctgaagcctggttgaattttccccctgaaaatggatgtttcttcttttacgacattcccaggctgtgacaaagctggaatgtagaagcaggctcagaagtgggtaatgaacagaggttgggagaatttggagagtttagaagacaggaagatgaggaaaagtttggaccactgtagagcattttactagtcatgttcagaaggctgacagaagcgtggatagtgaaggccagactttgaaagtctcagatgaatatgaaaagcttactgggaacaggagccaaggtcacttttgttttgccttagcaaagaaggtgtctgctaggtgaacctgccctggagattggtgaaagtttgaacttgctggtgatcatttggggtgtaactagcagaatgaccttctaagcagcaaagctcaagaggtatcctgtctgcattgaacagcctgtgctcttaggtgtgatcaaagaaatgacttcaagttggaaattatacttaaataagaagcagagcttcaaagttagaaaaatctgcagcctccttaagtggtcaaaaacgaaagctgattttcagagggaaaatccaagaaggctgtagaaatttacgtaaaatggagtccagtgctaatagccaaggcaatggggaaatggccttgaaggcatttcagagacctttgtagcagcccttgctgtcactggccctgaggactgtgaaagaataatggtttcctgaaacagccacatggcctcactgctgtgtgcagcctcaggacactgctgcctgcatccctgcagtgccagctccagctctagcaatggctgaaagatgcacatgtacagcttgggtcacagctttggggcctgcaagctataagctttggtggcttccacatagtgttcagccagcgggtgtgtagagcatgagacaagaggctttggagcctttgtatagattttggaagatgtatggaaatgcctgggtgtccaggcagaagactgccaaaggaggagagcctcatggaaaacctctactagggcagtgcagaaggaaaatatggggttggagcctccacactggaggccaccactctcaaaacctcagattcatacacccccaacagcttgtacccttagaggggaaaagctacaggcactcaacaccagcctagcccatgagagcagccatggtcactaaacagtgcaaagacacaggtgcaggtctgcccaaggccttgggagcccagccctcacacccctgtgctctggatttgggacagtgaagcaaaaaggatgattttggagctgtaggattgaaagacttgactgctgtgttctggaatttcatgaggcctgtaagtctcatctgcttttgttctttctggcaaaattcttccttttggctgggaatgcttacccattgcctgtgcaaccattgtaccttggaagtagataacttgctttatatttcagaggctcatgggcagaagggagtgtagcctgtgtcagatgagattttaagctataaacaattatgtaaatgctggaaagggttaagatttggaggactgtagggaaggcaacattgtattgtgcaatgtgaggaggacacgagatattgggggccagggcaaaataatatgattttgctctgtgtccctaccaaaactcatatggaattgtcatcgggaatgttaaaagtggggcctggtggaaggtgatgtaatcatggatgagagtgggggttggaagttgggaggtggttgggagaatggcagggattatggtggtgggggagggaaaggtcggggtggtgtgaatccttcacaaatggttaaacaccatctccttcatgctgtcctcatgatagtgattctcatgatgattttggagctgtaagattgaatgaatagtggctggctggattttgggcttgcattgggcctgtggtcccatttgtgttattttcctgggaaatttcttccctttggattgagaaagcttacccaatacctgtaccatcattgtaccttggaagaaaagaactcctttttaaattcagggactcatttgcagccttatcttatatgagacaatgaactttttacatttgaattaatgctgaaatcagttaagatttttggaaacttttgaaaagaaatgattgtattttgctctgtgagaaggacatgagattcagaagggtcgaggtcagaataatacggttagggtatttgtccctaccacaactcatgtggaattgaaatctcaaatgcttgaggtagggcctggtgggaggtgatataataatggaagggaggggggtgggggtgcaaggaaaaaggggtgggtagggtggggaaaagtaggttttcagtagggtggtgggagggtgaagggtagtaggaagcagagtagcctgctgtagagacagagcctcatagaaaaactctactagggcagtgtgccgtggattcacagggtttagcccccgtggctgctctcatgggctgggctggtgttgaatgcctgtagctttttcacattgagggtgcaagctgttggtgggtctatgaatctggggtctggaggatggtggccccctgtgtgggggctccacgcccatattttccttctgcagtgcccgagtagcagttttccaagaggctcggcctctgcagcaggttctgcctgaaaacagtggtgggtgggtgtgggagaagatccctcacccatggttaaccaccgtcttcttgatgtgggcctcatgatagttctcatgagatctggttgtataaaagcatgtggcacctctttcctctttctgtctttctcctactcctgccatttgaaacatctcattgctcctcagccttctggtatgattgggaggcttcctgggtcctcccagaaacagaagccactctgcttcctttacatcctacagaaaccagagccaatttaacctcttttctttatgatcacacagaaaattagtactgcaaagtggagctatgaaatgccttcaaggccttttcttcattatcttgcctgttagcattggcctaccttttttatgcaaagatctgaagctttcttgaattttctccctgaaaatggggttttcttcttttaccacattgccaggtgtgactaaattagctgaaaatgtagaagcaggttcagaagtgggtaacagccaaaggtcagagagtttggagggctttgaagaagatagggacatgacagaaagttggacctattgtagaaatgttttaaataattatgattaaaaggttgacagatgtatagtgaaggccaggcttagaaggtctcagttgaaaatgaggaagttatactgggaataaaagcccaggtcacttttgtcttaccatagcaaagaacttagccgactggtgaccctgccctcaagatatgtgaatctttgatcctgagggtaaagatttagggtgtatctgggtggaatgaacttctatgcagcaaagctcaagaggtgtcctgtctgtgtcaaacagcctgtgctcttacgtgtgactgaggaaatgacctcaagttggaactcatatttaagtgagaagctgagcttaaaagtttggaaaatttgctgctggccaagtggtcaaaaagaaaagctgattttcaggagggaaaatttaagaagtcttcagaaatttgcataaaaaggagcccagcgctaatagccaagacaatgagaaaaaggccttgaaggcatttcagagacctttgcagcagcccttagtgtcacaggccctggggcctaagagagaagaatggtttcctgggccagacccatggccctgctgctgtgtgcagcctcaggacactgcaccttgcatccctacagctccagctccagcttcagccctggctcaaagatgcacaggtacaacttgagtcactgcttcagagggtgcaagctataagccttggtggcttctgcatagtattaacccattgggcacacagagcccacgactagagtcttgggatcctcctcaaagacttcagaagatgtatgggaatgcctgtgtgtccaggcagaagcctgcccaaaaggaggaacctcatgggaaacctctactatggaagtgcaggaggaaaatatgggttggatcccccacactggtttgtcattgggaatgttaaaggtggggactggtggaaaatgatttaatcatggatgagagtggggactggaaggtcgggggtgaggagaatgggacggatgatggtgggagtgggaggtgaaatttggaagtgtgggggggatccttcaaaaatggttaaacaccatctccttaatggtgtcctcatgatagtgatttctcataattattttggagccgttagatcgaatgattactgtcttgccgggttctggacttgcattgcgcctgtggttgctttcgtgttatttttgtgggaaatttcttccttttgattgagaaagcttacccaaagactgtaccatcattgcaccttgaaagaaaataactccttttgaattcagggactcatcaacagaagggactgtagccttgtctcagatgagactttgagcttttaacatttgagttcacgctggaatgaattaagacctaggaaacttttgaaaaggcatgactgcattttgctctgtgagaacaacatgggatttccaggggtcaaggtcagcataacacggtttgtctgtgtgtccctaccaaaccttatgtggaattgtaatctcaaaccccagaggtggggtctggtggacggtgatttgatcatggatgggagtggcgtgggggtggaatgaaaaagtggtaggtggggtgaggaagagtaggtttttcagtagggtggtgggagggtgggggtagtaggaagtgggagtagcctgctgcagaggcagagcctcatggaaaacctctactggggcaatgcacctgaggctttgcagaatttagctcctgcagctgccctcaagggctgaactggtgttgagtgcctgtagcttcctcacactgagggtgcaagccattggtgggtctgtgaatctggtgtctggaggattgtgtcctgtgcgggggctccaaacccatattttccttctgtattgcccaaatagaggttctccaagaggctctgtctcttccataggcttctgcctggaaacagtgttggttgagggtggggggtatatctttcacctatggttaagcaccaccttctagatgctaacttcatgatagtgagttctcatgatatctggttgtataacagcatgtgacacatttttcctctctctgtcttgctcctacttctaccacatgaaacttctcattgcctcttggccttctggtatgattggcaagcttcctgagtcctctcagaagcagaaaccactctgctgtttttacagcctgtagaaccctgagcaaattaaacctcttttcttggcctggcatggtggttcatgcctgtaatcacagcgcttttggaggctgaggtgggcagatcatgaggtcaagagatcaagaccatcctggcaaacagggtgaaaccttgtctctactaaaaaaaaaaaaaaaaaaaaaaaaccaaaaaacaaaaacctgggcctggtggtgcacacctgtattcccagatactcagcagactgaggcagcagaatcacttgaacctgggaggtggaggttgcagtgagccaagatcggaccactgcactccagcctggtgacagagggagattccatctcaaaaaataaataaataaaaataaaatactcttttctttatgatcataccaaaaattagtattgggaagtggagctataaaatgccttcatgaccttttccccattgtcttggctattagcactgggctgcttttatatgcaaatatatgaacccttgaattttccccctgaaagtgaacttttcttcttttaccacattgccaggttgtgacaaagatcactgaaaatgtagaagctggttcagaatattggtaataaagctcaaaatcctgaggaaattgaacactcaaataaaggattcttagcaaagcaattttacttctgcacagaggggtgcttctccttggccagtcaccatgagagcacatctgaacaaaggggcatgagagcctttattcctgatgcaattcctgcccctgtacccttttcccattggccagggtcaggtcacacaatctgaactaatcctggttggctaaacatttgaactttctttagataaagtgggcacataagggagagaggggaaaaggggaaggggtgtctgcaatgacctagagaggtagtcttttttccaaataaggaaaggaatgtgaacttgtactgataagcctggtactgtggtgtgtctgggcatgtaacaaaggcagaaaggaaaaaagacaaaaaggaaaagggggtgagcatgggtaatatgaatgaataaaggattgatcaggctatttgaagagaaacctcatcatatcacacaagaagtgagtaatggccagaggtcagagagtttggagggcttggaagaagacaggaacatgagggaaagtttgactcattgtagagacttgttaaataattttaattaaaaggctgacagaaggacatacagtgaagccaggcttagaaggtctcagatgaaaatgaggaacttactgggaacagagccaaggtcacttttgttttgccgcagcaaagaatgtggctccacagtgaccctgcccttgagatctgtcactctttgaacttgagagtgatgatatagggtgtatctggtgaaatgaacttctaggcagcaaagttcaagaggtgtcctgtctgtgtcaaacagcctgtactcttatacgtgactgaagaaatgacctcaagttgggactcatatttaaatgagaagctgaacttaaaactttggaaaatttgtagcctggccaagtagtcaaaaacaaaagctgattttcaggagggaaaattcaagaaggcttcagaaatttgcataaaaaggagcccagtgctaacagccagggcaatgaggaaaaggccttgaaagcaattcagagctctttgcagccacccttactgtcacaggccctggggtctatgagagaagaatggtttcccgggccagacctatggctccactgctgtgtgcagcctcagttccagctccagccatgggtcaaagaggcgcaggtacaacttgtgttactgcttcagaggatgtattctataagccttattgtcttttacatagtgttaagccagcgggcacacaatgcatgagtctacaggcttgggagcctctgtctagatttcagaaaatgtacagaaaagcctggatatccaggcagaagactttccaagaggcagagcctcatgggaaacctctgctagagcagtgcagatggaaaatatggggttggagccacccctagaaccttgggtctggaagcaggccaccatcttccagaccccagattcatagacccaccaacagcttgcaccctaagtgtgggaaagctacaggcactcaacaccagccccagtctgagagcagccacagaagctaaaccctacaaagccacaggtacaaagctacccaaggccctaggagtcccactctcagtcctgtgtgccctgggtgtgggatataggttcaaagaagatgattttggagctgtagtgtagcaggagaagcctcagacaaaacccctcagataccaagttaaagaaggaagggatttatttggccgggagcttcagcaagattcatgtctccaacaaccgagctccctgagtgagcaattcctgtcccttttaagggctcacaactctaagggggtccacatgagaaggtcgtgattgattgagcaagcagagggtacgtgactgggggctgcttacaccagtgattagaatggaacagaacaagactgggatcttcacagaacttttttaacgcaagtaactgattaggtcggggtcgatctttaactaccagacccaggatgtggcgccaggctgtctgcttgtggatttcattcctgccttttagtttttacttcttttttctttggaggcagaaattgggcataagaaaatactaggggtggtctcctcccttagtaggattgaatgactggcctgctgggttttggacttggaaggggcctgtaaatctcagctgtattttgttctactttctccaaaattcttccttttgaatttgaaacgctttcccaatccctgcagtcattgtgtcttggcagtagttaactcgctttatatttcagagactcatgggcagaaagaactgtaacactgtctcagatgagactttgggctttggacatttgagtaaatgctggaatgagttaagatttgggggactgcatagaaggcatcattatatttgacaacataactagaacacgagatttgggggccagtggcagaataatatggttttgctgtgggtcccttccaaatctcgtgtggaattgtcatcctggatgttggaggtgggacctagtggaaggtgatttaatgatgttctggagtgtggggtggaaagtggggaaggagtgaggagcattgtgaggagtatggtgggtggtggggagtgaaatgtggggatgggatccagatctttcatgggtgctaaacaccatttccttaatgctgtcctcacatgagtgagttcttgtgatgattttggagctgtaagattgaatgaatactgtcctgctgagttttggacttgcattggttctgtggtctcatttgtgttatttttctggcaaatgttttctttttggattgggaatgcttatgcaatgcctatatcatcattgtatcttgaaggaagagaactttgtttttaattcagaggttccttggcagaagggattgtagccttgtctgagatgagagtttgtactctatacatttgagttaatgctgaaatgagttaagaatttggaaaacatttgaaaatgcatgattttgttttccattgtgaggaggacatgagattttgggggccaaggacagaataatgtggtttggctgtgtgatcctaccaaaactcatgtggaattgtaatctcaaatgttggcagtggggcctggttgggggtgatttaatcatggacaggaggatggtggacctggaaggaaacaagagtggataaagcagagaggagtaggttggtagtagggtggtgagaaggtaggggttagtagaaagagggactagcctgctgcagaggcagaggctcatggaaaacctctactagggcaatgcatctgtggcttttcagagtttaacccccatggctgctctcatgggctgggctgatgttgagtgcctgtaagtttttcacactgagggtgcaagctggtggtgggtctatgaatctggggtctagaggatggtggtctcccacgtgggggctccaagtccatatttttttctgcattgccttagtagaggtttttcaagaggctctgtgtctgcagccagcctccgcctggaaagagcagggggtgggatgggggttgcattcttcaccaatggttgagcaccatcttcttgatgctgacctcgtgagagtgagttctcatgagatttgcttatataataggatgtgacaccactttcatctctctgtcctgctcctccttttgccatatgaaatatctctttgcccttggccttctgttatgattgggaggcttcctgagccctcccagaagcagaagtcactgtgctttctttacagcctgcagaaccccgagccagttaaacctctttttaaaataacatggcagaaaactagtactgtagagtgaagctatgaaattccctcacggccttttcctccttcttttgcatcagcacttgcctcctttcttattcaaatatctgaaaccttgttgaattttccccctgaaaatggatgtttcttcttttaccacattgccaggctgcagcaaagataccttgcaggttcagaagtgggtaaaggacagacaatggagagtttgaagggcttaagagaatacagcgaaatgggggaaactttgaaccactgtagacttgttaaatagttgtgatcaaaaggctgaccgaagaatagacagtaaagaccaggattagaaggtcttagatgaaaatgagagagttactgggaacagaggccaaggttagtttgttttgtcatagcaaagaatgttgctgcatggtgcccctgtccaggagacgtgtgaaattttgaacttgagggtgatgacttaggtagtatgtggtgaaatgaacttctaaggagcaaagctcaagaggtgtcctgcctgcattgaactacctatgctcttatgtgtgaccaaacaaatgacctcaagttgaaatttgtgtttaaatgaaaagctgagcttaaaagtttggaaaatttgcagcctggccaagtggcaaaaaaaaaaaaaaaaaaaaaaaaaaaaaaaaagctgattttcaggggggaaattaaagaaggcttcagaaatttgcataaaaaggagcccagtgctaacagccaagacaatgggggaaaaggcttgaaggcatttcagagacctttgcagcagcccttggtatcactgaccctgggacctatgagagaagaatggtttcctctaccagacccctggccttgcttctgtgtgtagcctgaggacaccactgcctgcatcctgcagctccagctccagctgcaactccagctccagtcatggttcaaagatgtacaggtacagcttgggttactgcttcacagggtataatttgagggggaccaggggcagaatcatataatttggctgcattttcctactaaaactgacatcatatcataatatttcatgttggtggttgggtctggatgccaaggtgaggagaggtgaaaagtggggatggtgttcagagtttgcaggactagagtggtgggctcggagcttatttggagagaggggtattgtacattttcagggcatgggggtggggcgcagattctttaccaatggttaagcaccatctccttgatgctgtcctcatgatattgagttctcatgagatttgcggggttttttgtttgtttttttttatagtgtgtggcaccactttcctctctctcttgctcttactttggccatatgggacatctctttgctccttggccttctgggataattgggaagcttcctgagtcctgccagatgtagaacccactttgccttctttacagtctgcagaaccatgaggcaattaaacctcttttctttatgatcatagagaaaattggtactgtggagtggagctatgaaatgccttcaaggccctttttccattgtcttggctattagcactcaggttttgttttatgcatatatctaagccttcttgaattttacttctgaaaatggacttttcttcttttacctcattacctggctttgacaaatatacctgaaaatgtagaagacagcttagaagtgggtaacagacagaggcagagagtttggaggtcttagaagaacagaataagataaaagaaagtttggaccattgtagagacttgttaaatagttgtgattaaaaggtcaacagaagaatggacaatgaaggccagagtgaggaggtctgaggtggaaatcaggaacttactgggaacagaagcaaaagttacttttgtttggcattaacaaagaaagtgactgcatggtggccccgccctggagatctgtgaaactctgaacttgagggtgatgatttagggtatattcggtggaatgaacttctaactagcacagctgtagatatgtcccacctgtgtcaaacagcctgttctcttatgtgtggaccaaaaaatgacttcaagtcagaacttacctttaaatgagaagtggagcttaaaagtttggtaaatttgcaggcttttttctcaagttatgcatttttagaatgacatgaggtttggagggacggggcagggtaatatggtttggcttcatgtccctgccaaaactgatgtcaaattttagtttttaatgatgaagtttggacagtaggtgttgatggactcatgtgggtgggttattaatgaatggtatagcaccatccccttgatgctgttttcatgatagtgagtgagtttttatgagatctggttgtttataagtgggttgtacctctttttctgttttgcttctgtgcttattatatgagatgtctcagtcttttttttgccctcctttctgacttgaagtttcatgaggcctctcagaagtggaaactactatgctttttatacaagctgcataactatgaggcagttaaaacttattttcacatgataacactgaaaataggtgctgaggagtgaaacacttgactaaagatacctgacaatatgggaagaggtttgggtctgggtagtgggcagaggttagagtttggcatgctcagtaggagatggggatttaaggggaattttggaacatctttgagattgtttaaatgattatgatcaaaatgttgacagaaatgctgacagtgaaggccaggttaggtggtctcatagggaaatgaggaatttagtgggaattggaacaaaggtcacttttgtcttgccttagccaaaaatgtggctgctttgtgcccattttatagggatgtttaaaactttgaacttaagtgtgataatttagaatatctagcataataaatttataagcagtgaagcattcaagaggttgtgtgtctgcttctaattgcctgtcttcatatgagtgagcatagaaatgacctaaagtgtgaatttatatttaaagagaaagcagagattaaaagtttggaatatatgtagtctggacatgtggtagaacagaaagcccatttttaggggagtaattttggatgacttcagaaattggcatatgtaaaaaggagccaagtggtaatagccaagacaatgggggaaaggcttccaaggcatttgagagagctttgcagcatctgctttcatcacaggttctgaggcctaggaggaaagaatggtttcatgggccaggcccagggccttacatccccgcacagcctcaagagaccgcttcttgcatttcatctgctttctctccagctcaagacatatgtcaaaggggcccaggtatgactcattttacttcatcagatgtttaaagccagaagccttggtgacgtctatggtttttttttttttttttttttgagacggagtcttgctctgttgcccaggctggagtgtggtggcatgatcttggctcactgcaagctctgcctcctgagtttatgccattctcctgcctcagcctcctgagtagctgggactacaggtgcccatgaccacacccagctaaatttttgtattttttagtagagatggggtttcaccatgttagctgggatggtctcgatctcctgacctcgtgatccactcaccttggcctcccaaagtgcagggattacaggcatgggccactgcacctggccctctatgtggttttaagtctgcaggtgcacagagtctgcaggtgcacagaggcttggagcctccactcggaacccccacctagattttagaggatgtatgcaaaagactgagtgtccaggtaagagctgactctagggatgtggctgttatcaagaatctcttctagggcagtgcagagggaacatgttgggttgagcccccaacacagagtttccaccggggcactgcctaatgatgctgtgagaaaggagctaccatcctccacatcccagaatggtagttgcaccagcaacctgcaccctgagtgtggaaaagccactggcacttaatgcctgctcagcttgttactgcagacatgggggtggaaccctgcaaagcaacaggagtagagtggcccaagcccttgggagtccaccccttacaccagtgtgtcctcaaagtgggacatggagtcaagattattttggaacttcaacattttatgacagccctgctaggatttagacttgcatggggcctgtagtcctgtggggtttttttaagcaaattttttccttttggattaggaatgttttgccactgcctgtacccttattatatcatggaagtaactaactcatttttttattttacagtctcataagagaatggaagtctagccttgtctcagatgagactttgaactttggacctctgagttaatgttggaatgagttaagaatttgggagagtattgggaaggcatgattgtatttttcaacgtgagaaggacatgagattgacaggtcaggggcaggataatatgatttggctctgtgcctctcccaaaacttgtgtcaaactcatgtaatccctaatgttggaggtggggcctggtggcaggtgactgaatcataggggtggatgctttattaatggtctaccatctttgtttctgtcttgatcctgctcccaccatatgaaacatcttagttctcctttgccttctgccatgtttggaaggttcctgaggtttccccagaagtagaagctgctgtaattcctctacagcatgagccaattaaacctcttttctttatatgttacctagtctcaggtatttctttatagcaatgtgagaacatactatacaattgaaattacctaaattcagtctgttctctatttaggtcctagagcagcattgctactctgtgcttttaaatttatctgcacaccttttttttcttagtgaaaggctgaaaggtgagtacacataaaacagagtgatgatcatacattggcagtggaggttgtgggatcgaggatcagctgccaacaaattggacagctagtattatgatctgataaaatgctgggacatgcagaggtgtgagattcagtgcacatcttttacatgaagtctgttagaaaagaaataatgcactgtgttcccttagaggcagctgtagcatcatctcgtcatgcaagtgtcctgaaacttagtttgataatttcagcaaatgtgtcttctggcatgagaaggaggattctcttctgtcagagaattaaagtgtagaagcagtgatgacacgcacttggtttcagttcttaggagagtttcgtttttgatgttttagcttgaagattttccttcagtagtgtttttaaaatgaatctatactggtaactgataaagactctactatgcaattcactcattgaattaaaaaatttccaaggttgtctgtaaatctcagggttctatgtcatgaaaactggtatcggttgatgtaaggaggaaccagaaataatttatttccagtactgaagaaaaaataattgatttatagtttgatttttaaaaagtattgataagtccccagaacatttaatcttgaaaatattttaaattttaaaaggattataatgcaaataaaaatagctgataaatatgaagattcaaaaggagcttaatttaaaaagcacaaagagattgtcttgcattgctgaaatctcaatatttttatagttcctgggctaaataatttgatgttgagtttacagatttaaaaactgtggctgaaaggttaaagtctctactatttatatgaagtccaacttatgctgccccaaatccctgggtactgaaattgtaacaagtcaaattgaaacactgatgaataacaatgatgaaataaaatgatccgtttgcagatagtcataaaaagaagagattactaaaatcatcatgcagcagcacattgactctcagaagtaatttcttatgggttgaattttaagatcagattctcataattttgatatttgctcaaaacttcgtcccttaggttacttagagccagatttaacatcaggtggtgttgtctgtactacacacatgtagactgtaaccagaaatattgttctctaaaaacaagatcgaacaactaccaaaaactaattcagctcctaggactgaagaaaactgggcaagtgaggttcaggaggccaggtgcctacctctgccatccttggcagttgcattttatggtaagaaaacatcaagatggcaccactcactgaaaggaggctccaagttgggaaccagaggtaccagcttagattccttaatccctaagaaggcctccctctcaaagacaaagaccccttccttggcctcaagtcctcattcttgttggttaaacacaattaattcttcatcattatcacctgcctgttttttgacttgcccagagctctgaaggaaaccctggacactctgcggcaagcgcgaagagagggctgtgcagcccaggcccctgatcagcttctcccagcctttccctcccaaaggctatagcagggctgagtgccaacatggacctgcagaggcctgggaggggagcaaatggctggggttcttgtggcatttgggatgttcatgacagttagtgcaaagcatccatggcaggatctgttgtcacctctctccaccatccctggattgccaggctccagtggcctttctttcctctcttcttctctgccctccctccctccatttcctccctccctctctcttcctctctctccttctgtcttttcttccctcctgttttccctttttcttccttcacatctatgcctcctcccagtatctggcagccccatgtcctcagcctgtgctgggtgagtctgatgaactcagacaggatgtataggaggggctttcatcagttcatcctgggcagctgttctagaagtgactacgatggggcaaatgcatgggtacgtgtgtgtgagtatgcacaagtgcgtgtgtgtgcctgtgcatgcctgttgaccacatgtcttctctaagtttgtgtccataactccagaggaccccaggtgtgctctcgatgtcatgttcagggatcaagcacagctcctgctggtgggaattgcactgtgtgacactttcctcagggacctgggggtgtcagatcccagtagtctcccagtaggctttcagataggtcagaaagatgttctattgttgttttattttctttttttcatccatggttttactaccttcttcttcttagtgatttttcatgaagggacatctgggttggggaaaggtagctaataagaaatgatgtcaccataaaatagcaaagagtctcctggctctgtggggacagtcttcatatggtccctggcccagcctcgagggccctggtccagtcaccttatggcctctgtgctgtgtccctagatctgggctctgtgggaaagaccctgggagacccagcagaatggagtaccttgtgtgccaaatgtcccccctttactctggctctatgactctttctccctgtgtcctggaggagaggacctgtctggagaagaccctcagggcctggccctgtcgattaagataggagggaagggtctgtggcctgaggcagggcattggaagggaattttgagcactgctgctcaggtgcctggtcactgggacccagtgtttcccttgtcagcaggggcctggtcagtgggactgtggtcaggggactattgatcagtgtggcctattctgtgaggacatggttagggggaacctggtcagtgggaacatttttagggggatcagtcagtggggaccaggtcagtgaggacctggtgagcggaggcctggtcagtgggacctgggcatcggggcctgttcagtggggacctgctcagtggagatgttttcactgtggtccccctcagtgggacctagacagtgggggcctgatcagcgagacctggtcagtggcaacctgatctgtgggaacgtggtcactggggacctggttaatagaaacctggtcagtgatggcctaatgagtgaggtcttgatgagtggggaaccttgtcagtgaaggcctactcagtggggttagtcacttttgacctgacagtgagcacctggccactttggccttgccagtgggggcttggtaagaggggcctgatcagtgtgggcctgcttagtggacctagtcagttgggacattgtcagtgaggtctatttagtggggtcctggtcaccatgggctgggtccctgatgaccaggtcatggggctctattcagtggaggcctggtcacatgggacctagtcagcagggcctggtgggcatgtcctcatcagtgaagcccttgtcagtgggtccatggttagggcatcctggtcaatggatcataatcagcaagggcctggtcagaagagaattggtcagaggggacttggtcagtggtggcttttgtagcactggtctaatcagtggtgacctggtcagcggggatctgagcagtgagtgcctgttcagtggggcctactcactagggttctagtcatggacatctggccacctcaggcctggccagtaggggcctcatctgtgggaccaggcaatggggtcatgattggtggaacctggtgactgaggccttgtcagtaaggacctggtcagtggagtcctggtcagttaggccttgtcagtaaggtcctgggcagtgggtcctggtcagtgggttctggtcattgtgggcctggcagtgggggcctggtaagtgtggcctggtgagtggggtataatcagtgagggtgtggctagggaggaccagctgtgcagggtctggtcagcagggacctggtcagtgggggctgctgagcattgctgggagatgtcaggtgtaacatgtgttattgatggtcctgtagacacctgggatggcccagtggtgcccaacagcccagttaaaagtggacaaggcaggtgtttggatggacttgggaggtcttgctcagagattccgacagaataaaggtaaagaagggccagagtggctggagagatggtcacagtctgtgggctacacaggatggaggaagtcagggtgttcccaggcaaggtgggtagctgggatgcagggagaggcaggtggatgctgagaggtcagatcctgcgagggctctgggggcatcaggtaggatgggctcttgtagggtccatccccacagggtctgtgggtctctccccgtgtgcagagatgagagagtgtagaaataaagatacaagacaaagagataaaagaaaaggcagctgagcccgggggaccactgccaccaagtcactgagaccggtagtggccccaaatgccaggctgcactgatatttattggatacaatacaaaggggcaggataaggagagtgagccatctccaatcataggtaaggccacgtgggtcatgtgtccactggacagggggcccttcccttcctggcagctgaggcagagagagagaggagacaaagagaaagacagcttatgccattatttctgcatatcagagacttttagtactttcactaatttactactgctacctagcaggcagagccaggtgtacaggatggaacatgaaggtggactaggagcgtgaccactgaagcacagcatcacagggagatggttaggcctctggataactgctggtgagcctgactaatgtcaggccctccacaagaggtggaggagtagtcttctctaaactcccccggggaaagggagactccctttcccggtctgctaagtagtgggtgttttcccttgacacttacgctaccgctagaccacggtccacctggcaatgggcatcttcccagaagctggcattaccgctagaccaaggagtgctctggtggccctgtctgggcataacagaaggctcgcactcttgtcttctggtcactcctcactatgtcccctcagctcctatctctgtatggcctggtttttcctaggttatgattatagagagagaattattttaatattggaataaataattgctacaaactaatgattaatgatattaatatataatcatatctaagatctatatctagtataactattcttgttttatattttattatactggaacagctcgtgtcctcggtctcttgcctcggcacctgggtggcttgccgcccacaggctctgtgcaccatcagtgcactgggcaggtctcagcccaggctccctggaccctggccaggtgatgtggtcactccatgggggactgctgtcatgccctggccacccaccctgggcagcacagtcttatctcatgattggcctttctctgatcctgcagagggcacagctcgcagcccaggaggggcagtcccagggtgcagcttgagttctccacgggcctgaagcatcccctgccagccctgtactttctcttctcccaggtctcgcttttccagtgtcacccagcaggaaggccccatcctcccttccttgtgtgtctcctaggctgagacctgtggtggatggggacagggagagtacttcctcaggtccacttggggaggagacttgctcccagcctggtgaaggtagtcagctttaccttggttgccttagaatgagatggatctgcccccttttagtgccctcaaggtgaaggtgagagacggtccctgctgtgcaggaggttggtttagggatggaggacttggcaggtcctcccagactgtcaggcttgggcagcactatccaatttcaggactcagaaagtccagccctgagacgggactgtgctgcccagggtgggtggccagggcctgacagcagtaccccagggagtgaccacatcacccggctggggtccagggagcctgggctgagacctgcccagtgtgctgagggtgcacctggagcccaccccacctgacactcccacatcctcacaggttcttctctcctagcatgcacttgcctttccctgctcctcagcagcccactctgcctcttccctgacttcctccatggtgtccagcaggatgggctggacaggggggcagcctgtgtgcacattttgtggaagtgggactaacacacactccctgggaggcaccatggttcctgccaaatccaaccccagaactctgtccctgaggtggttttactaaaccctaaactcagaactgtggctgtggctcaggggtcagcacctgctagtgccaagacactactgggagtgtgggaccttagcaaaccccatggtgtctggcctgaggacagggtgtcttggggctgagacaaacactggggctgagaccgtctgacccaactggccaccaatggccattgggtcagatgatctcagccccagtgtttgtccttccctggctccttctggttcagtcccatcaaggccctggagcccaaatcccatcatcaaacatcccctccaggaatcctggccactcaattcactttatcgtgtttcatcgtagagcaaaaatgacagaacagatgcatagaaaaatggcttcagttgcttaatgactagaagaaatctgggagaagcaagaaggtaatgtggagagggagagacctccatgatcactctctgcagagccaggggcacaggcacccagtgcagaggcctgatgccacctgcctctcagagggtgtgtggcacactgtcattacccggaagacatcaggtctggtcaccagcttttctgcctgtcctgtaagcatcaagttttggaagagaatctcatgccagggcctggaacacacctggctcaggggttaggggttgccccttggtaatctaaatgaaaaaaataggtccagatcagagttcctaatgcggagcactcatccactctttgaattgtaaaaggggaggcctggtcctaggtatacctaagatctttgaggaactgaagatcccaagattctggaaaattccagagtcctcaggccctaatcctccctgtcctcctgtggcctgtcccatcagcacactcttctatctgtagatgttttggctgctctgtaagggagtccccctgcaggtttggggctgggcatggtcacccctgctgcatgtcgagaaggtgaaagccaagaacacagggtacagtgtttccacgctcatccagagcaggacaaacaggccaggttgtgtcaggagcccaagtatccagttggtgcaaatgtcaaacctgctgtggaaggaggggtccattgcccatcctaggtacagatggtaatgtagcgcaggtaagctgggcttggtagccctccctagctttggaaataagccaaacaaggagctttctggagaatgaaatctcttttccttccagaagcactcctgaatttttggtgattgccatttgtggcagtgagtttttgtctgttctggggctgggctggtttctctgattggccctgccctacagagcataaaggaaaagtgcaagaggtccccagcaaaaatgtgcagatagccctggacataagccacattctgagaaacatgtcatgttctgagaaggctaaggcatcaagtaaatcatatgggactggaggatcccagggtaggtggggcagttcagagcagtgcgggcttccctgggaattgggagaggcaggggttccagaggagggaatcacagggccaccaagggctctcttggccctgggagaagtcaacataatggattgaacacctgctgggcttcaagccctgggccaggctggggcatgtggagctaggaggcagctcaaattgggaggcagagagagaagtgtgctgagacggcgccgtttctgggtgtaatatggtcctgagattctgtatgggaagtgcttccagggtttcatatgttatggggttgcttcctctccccagcctcaccctgcaggaatcccagtgactatatcgccaccatcttggagctcagtgccctcataatgtaacggcaacagcagatcttcctgcacagggactttctgtactacgtcactgctgaggggtggtgcttctgcagggcctgtgttgtggtgcacaacttcagacaccatcatcctggagcagcactgcaccctcactagccagggagttaataacttcctgaaggtcacagccacattcaagactttggacttcattgatgtgcttgtgctggacaaggtgggcttctctgggatcttaattcaggaggtaggatagagcttgacataaaattcagataaaagaacttgaccttcatctggagggctctggggagccatggaagttgctggaagaaaggtgggaaaactcagataagcttcagtgatgcctgtagaaggctgtctggaaggaataaacaagaggcaggaaaccagggagggagcttgtggggcagatcttgagatagcaagggagggttcctgcttggatgatagttcttcaggggctgtctctgtcttcaggtgtcttcagagctagtgtgttcattggtcttgtctccaggtgaaattgggaagttgtcagataagcacataaaagtggaagctgacatcttcatgagtgctggtgggggtcctggtgtgggactactgtgggaacagggatctctcaatcccagggatgtggtggatgggccctggattactccatcctctatgcttcctttcccctcctcccattctcccgacggcctcagtgcaaaggcactgttcatcctctggtgctgaagcagcctagagtctcaagcctgctggcggcctcgcaggatatgacagcacagccagtggcctcttctgggtcctgtacatcttcacaagacaagtagacatcaggagtgctgccagcacttggtgcaggagttctgagggaccacagtcctgaagacattgaatggtgggtgcagggccttatgtcctgtttcccaccccttctcattggttctgctccaggtggggaagggggaaaaagtttttgccaattctaccattattgccttgcagaaaaaggagcagaggccagaagcagggactggtacccacccgggctaataagggagaatttgtaggctttgtggaaagatctgggagtccatatctgttgtcccactaacttgctacgagacattagtaaaatcagttttttttatgaactacatttctgccatctgtaaattggggcgagatttttctaccccatggggttgcttggataattggtgatggtgtgtgtagagcaggtgccacctggcaggcattcggtgtccagccactgctcttcccccttgctcttctgcctaagtttgcattttcttctcaagaccttcactctccctaatttttctcttacctctgattcccaccttatagtctattccatggattcaccaggatctaagtaggtgacagtaatgtatgcatgtatgcgtatatagggatgtacaccctcacacaccacacctcaacatagtaggtgctcagtgaacatcacactgcagaagcagtgctggtagatctagagtttcacctcaacttgcagttgaaaaatctgagtatctgaaagggcaaatggaagggtgaagtcatggtggcccagtgcccttcctatttgacctggaacaggtgtctcaggatgtttggacaccacattttcaattttgggctggctgcttggtcgggaggaggtggacaagaattagaggctcttcccacaccctccaagccttccccagggtacaagaacagaccagggcaaagaagtcctggagcaggggagagacctttccatagcagaagccatttctgactcagtctctcccagccttttccattctgcctcttccccttgttgtccctgggtcttctatctgctctcagtccatttgcccatccctgagttcttcctgccctgccccagcaccttctcctctgcccctctccaccagccctgcagatccctgggtcctttcttgagcctcaggaactcaccttccatctcatcttccctgaagaatgtcactgctgagcctgtcctggctgggtctcaggtgagtggcagcatccccttgactgctcctgctggctcctggtctggacctacactttctatgacaactgctggtatctctagtgttttctgtagcctctgatttggaactggtttggaggtcacctgggcctggtgactgtagcagcaggctggctctaaggtctcagagtagatcgacttcctgaggggccaggagtggagctctgggagttggggtgagggcatgggctggcatctgggatggcagagaagtgaggaaggtggcttattcattcctctgctgtgccactcaacacctttgtcacctccttgttctctcatcctggcccatatcactcccttcctgcccatgttcctcacattcttgtacccctgaggggctccatggttctgcatagagcatggaacccctggcgtttctacattgatcactactggacttgaagcctcctgaggggcatggtccagtgccttggcccattttctgttatgggacacatgggctggaagagcagtgtgtgtgttctccaccctccctcccagagcatcaagctcttatcttgcctctgctcactaagatgtccccgtgtgtcctgttgcagaggctgaacgaaagctggccactctcttcccctttcagagccttctttggtcttccttccctcctcagacctctgagtcacatctgctctcccattttgggggtgtggcctcagcccatttgtaaatggtaggattgatgggcatgccagttgcagtgggagggtgcacagcacgcactagtgcagagcctggcatgcagaaactgctcccaggtgggagctgccatcctgagggacagttacaatcaacttgtctccactggaggctgctgagaagggaaggtccctggtgtatagaccctgctccctgaggaatcagagctcatggacacccacaaaaacatgaaaggatgtgggttcacatcctgaggccacactgcttaccacagtctcatatggctgtccctgggttgaaaccaaccccaggataagaaaatcttttcctgtagccaaggtgtgtctccctgttggaagagtcttctctccctgctcttggctgtacccttaggtattggaggtgtccctgagagaaaagaagtaggaggaagcagagattccctggatttctacacaatccagacctgctgttcattcggagtctggtccttccacagaggctgcagagggaacctgtgcattactcatggttttccttaatccagaatcaataggatatatttatatctactacctatctatcatttgtcaactatccatccatctctatacctatctacctatctatctgtatccatctatggagagacaaaaaaaaagaagagagaaaaaagaattgactgtggaaatgggctcatgtgatcatggaagtagagaagtcccacgatataccatctgtgggctgcaggaccggggatgttgggggtgtaattcagtctgaatccaggggcctgagaacctggacttttgatgtccaaaggcagaagatggatgcccgaaggcagaagatggatgccccagctccagaagagagtgagttctcccttccttcaactttttgttatattcagcttctcagtggattggatgatatgcgcccacattggggagggcaaatcttccttagtttactaatttaaatgtgaagcttttctgaaacaccatcctagacacacccaaagattgtgtttgaccagtgatgtgggtatccctcagcccaggcaagttgacacctgaaattaaccctcacagaatgtgactgtccctgctttgcatgcaggtcacccccacagagcaaggcttgaggattctgactcagctggtggccaccttcacatgaggctttatgaggtggacaggtctcatctttcctatcatcagtttgtgccccgacattggccatcaatgctacaggtgcccatgcagagcttgtggtggtgggcaccatggcacataagagggcttctagttctttcaatcccaagcttttatgaggcccctgcagtgccccacccctcctttcctctcctctctcagctttcttcctctttcctgtgtattcggcaacctccaactccatggctcccccatccactgctatcatcccctgccctcgtgttctgggtactgctgggtcctaagtggcctgaatccaaggccccatcctggaggaactcctaagtctgagaaggtgaagctggacaaagacatctccaatttcacgggggtcagaaatggagctaagggagatgggctctgagaaccagaggagaataaggtctctgtgggggcaggctggaaggctttttggaggaacggttgctggagcagggcctggaatgatgactaggaattgttaaatcagaaggcagggtgattccacgggcatcattagtgtcccaggccccctgccaggactaacattggcatttccagtccccacacccagaacagtagaaggacttgtggctgctggaggatctgggttgctgtttacatagcatccaggtctggtgggtcagtttcttctacccctacctgtgaaccttggtctcctgccacaggcaccaggaatctttaataggagaccccttcccagcctgctacacttccctgggagctagggactgtacagccacaccgggcccagcgcagggcctgttgggaaggcactggcctccagggtatgaccccggcctcctatttagcaacactgcttttttcctccggcctgcctcaatgtcccagtgaaagcctgcaagcctggcgtcctgtccctgtcacccggggaggcttcttgccactttggggtgctccccatgggcgagacacgcaccctggggtggcagccagggactccatggcccccccgggtctggcccaaggcctgctgggaaggcactggcccccgggggaggacagcagcctctgcttcgctttgctgcctttttaccttggcctccctcaatgtccccctgaaagcctgcaagactggcatcctgtttccgtcacatgggggaacttcttgtcgctttgggatgcccccacatcggagtgacatgcaccctggggtgaaagcaaaagactccacggcgccccgccctcaggtctggcgcatggcgtgcaaggaaggcagtggtgtccggggtaggaccccagcctcctatttggtctcgccgctctttttttccatgtcctgcctcaacgtcctcctgaaagcctgcaagcctgatgtcctgtccctgtcacccagggggaatccttgctctttgggatacccccatggcagagacacgcaccctggggtgggaaccaaggactccatggccaccccgggtccagcgcagggcctgccgggaaggcactggcctccgggggaagaccccagcctcttcgaactcgctgcttttttcccctggcctgcctttatgtccccctgcaagcctggcgtactgaccccatcacccggggggacttattgcctctttggggtgctctccacgcacccttgggtgggaactagagactccatggccttctctgatcccgcgcagggcgtgccaggaaggcactggcctctggaggatgaccccagcctcctcttcagcctcacccctttttttccctggcctgcctcaacgttcccctgaaagcctgcaagcctggcatcctgtccccatcacctgcggggaagcattggggtgttccccacctaccgtggggtgggagccagggacttcacagctcccccacccccctgtctggcgcagcacctgctgggaaggcaatggcctgcgggggaggaatccagcctcctattccgcctcgccgcttttttttcccagccggcctcaatgtccctctgaaagtctgcaaacttggcgtcctgtccccatcacccggggggactccttgctgctttggggtgcaccccacccaccctgatgtgggagacagggactccacggcccccctgggcccggcgcagggcctgccgggaaggcactggcctccgggagaggaccccagcctccttttcggccttgcaggttttttgccctggcctgcctcagtgtccaactgaaagactggcgtcctctccccgtcacacgaggggcttcttaccactttggggtgccccccacgcaccctggcatggaagccagggactccacgaccccccgggtccgacgcagggcttgcggggaaggccctggcctccggggatggactccagcctcctcctcagattcgcttctttttttccccgccctgcctcaacgtttccctgaaagcctgcaagcctggcgtcgtgcaatgtcacccgggaggacttcttgccactttcgggtaccacctgtgggaaaaacaggtaccctggggtggaagccagggcctctacacaccactctgccaagatctggcgcagggcctgacgggaaggcactggcctccgagggaccaccccagcctcctcttcggcctctccgccttttttccccagcctgcctcaatgtccttctgaaagcatgtaagcctggcatcctgtctccgtcacccggggcgacttcatgccgttttggggtgccccccacgcaccctggggtgggagccagggactccattgcttccagggtctgccaggaaggctctggcctttgggggaggaccccagcttcctcttcagcctcgtcgattttttcctcggcctgcctcaacgttcccctgaaagcctgcaagactggcgtcctgcccccatcactcggagaaatttcttgctgctttgggtgcccccccgtaggagagacacccaccctggtgtgggtgccagggagtccacggccccccacgggtccagcgcagaatctgatgggaaggcactggccttcaggagacgacctcagcctcctcttcggcctcgctactttttatccatggcttgcctcaacgtccccctgaaagcctgcaagcctggcgtcctgtccccgtcacccagggggatttcttgccgctttggggtgctcccgtgggagagatgtgcaccctaggatgggagccaggaacaccacaacccccgccccggtgaacagggcaggactagccgggacggcactggcctctgggggggacgatcccagcctcctcttcagcctcgccactttttttttctggcctgcctcaacgtccctctgcaagcctgcaagactgacctcctgttgctgtcacctggggggacttcttgtcattttggggtgcccctcacacaccctgagatgggagccagggattccacgtcccccttcccccacccggtccggcgcagggcctgttgaaaaggcactagcttccaggggaggaccccagcctcctctatggcctcgctgcttttttttctcggtcggcctcaatgtccccctgaaaacctgcaagcctggcatcctgtccccgtcacaccgggagactttttgccgctttggggtgcccacaacccaccctggcgtcggagccagggactccacattccccccacgagtctggcgcagggcctaccaggaaggcactggcatccaggggaggaccgcagcctcctctttggtggcgccactatttttccgcggcctgtgtcaacgttttcttgaaagcctgcgagcctggagtccagtccccctcacttgggggtaattcttgccgccaaggggtgccccgcttgggagagacacgcaccctggggtgggagccggaaactccaccgattcccgggtccgacgcagggcctgccaggaaggcactggcctccaagggatgatcccagcctcctcttcggcctgccttaacgtccccctgaaagcctgcaagcctggtgttctgtccctgtcacacgaggggacttcttgccgctctgcggtgccccccaggcaccctggggtggaagctaaggactccaatgtaccccaggatccggcgtagggcctaccaggaaggaagtggcctccgtggaaagaccctagcctcctcttcagattcgctgcttttttcccccggcctgcctcaacgtttccctgaaagcctgcaaggctgacatcctgccccatcactctgggggacttcttgctgctttggggtgcaacgtgtggcaaagacaggtaccctggtatgggagccaaggactccgcagcaaccccagatctagtgcagttcctgctgggaaggcactggcctccgggggcaccccagccacctcttcagcctcactgcttttctttcccggcctgcctcaacgtccccctgcaagcctgaaagcctggcgtcctgtccccattacctggggggatcttctttccactttggttgccccacacacaccctgggtgggagccagggactccacggctcccccgggtatggcacagcgcctgctgggaaggaagttacatccacgaccctagtctcgtcatccgtctcactgcttttttccccaggtctgcctcaacttccctctgaaagcctgcaagcttgatgtcctgtacccgtcacccggggagacttcttgcccattttgggtgccccccatgcagcctgaggtgggagtgagggactccacggctcctcagggtccacgcagggcctgctgggaaggcactggcctctaggggacggccccagcctcctctttggcctcaccactttctttctccggtctgcctcagtgtccctctgaaagcctgcaagtctggcctcttatccccgtcacccggtgacactttgtgccgcttttgggtgcccaccacggaccgcggggtcagagcgaggaactccaaggctccccagagaccggcgcagggccagctgggaaggcactggcttccggtgagcgacctcagcttccattttggcatcgccgcttttttccccaggcctgcctcaacgtccccctgaaagccggcaagcctggggtcccgtccccgtcattcgggaagacttcttgccactttggggtgcactttacgcaccctggggtgaaagccagaaactccacggccttcccaagtctggggcagggcctgctgggaaggcactggcctctagggaaagactccagcctcctcttcggcttctccactttttttctcctgcctgcctcaacgtttccttgaaatcatacaagcctagtgtcctgccccgtcaccgggggggacttcttgccgccttggggtaccacccgtgggaaagacacgtatgctggagtgggagccagggcccccatggcccccatgaatctgccgcagggcctgccacgaaggcactggcccctggaggacaaccccagcctcctctttggcctcgcagtttttcttccccggcctgcctcaacatccttctgaaagcctgtaagcttggtgtcctgtccccatcatccaggaagatttcttgccgcttttgggtgccccccacccacactggggtgggagcgagggactccacgactccccagggaatggcacggggcctgccaggaaagcactggcctccgggggacaatcccagcttcctcttctgcctcgtcgcttttttccctcggcttgcctcagcgtccccctggaagcctggcgtcctgtatttgtcaccctatgggacttctagctgctttggggtaccctcgtgggagagactagcactcaggagtgggagccaaggaatccacagccccccaccccccgttaaggtgcagggcgtgccgaaaaggcactggcctccgggggaggactccagcctcctctttggccttgccgctttaattccctagcctgcctcaacgtccccctgaaaggttgcaaggctggcgtcctgtcccggtcaggcggggggagttcttcccgcttttgggtgggccccacacaccctgaggtaaaagccagaaactctacagccccccagggtcccgcacagggcctggcaataaggcactggcctccgagggaggaccccaacctcctctttggccttgccccttgttttccctggcccgtctcaatgcttccctgaaagcttgcaagcctggagtcctgtccccatcacccagggggacttcttgccactttgggttgccttccacgcaccctggggtgggagccagggactccacgcacccccccgcccccagtccagcacaggtcctaccaggaaggcactggcatccaggggaggaccccagcctcctcttcagtctcgccactatttttccgaggcctgcctcaatgttttcctgcaagcctgcaagcctggcgtcctgtccccatcactcagggggaattcttgccgccgaggggtgccccacgcagcacagacacgcatcctggggtggaagccggaaacgccaccaattcccgggtgcggcgcagggcctgctgggaaggcactggcctacgggagatgaacccagcctcctctttggcctcgctactttgtttcccggcctgccttaacgtccccttgaaagcctgcaagcctggcatcctgtccccttcacccgggggtatttcttgcctctctggggtgccccccacgcactctgaggtggaagccagggactccacggtaccacagggactggcgcagggcctgccaggaaggaactggcctccagggaaagatcccagcctcctcttcggagtcactgcttttcccccccagcctgcctcaacctttccctgaaagcctgcaagtttgacgtcctgccccatcacccagagggacttcttgccgctttggggtgcaacctgtcggaaagacacgtaaccccggtgtaggagccaaggactccaagctccccgctcccttcggatccagtgcagttcctgccaggaaggcattggcctctggggaaggaccccagcctcctcttctgcctgcctgctttttttttcttggtctgcctcagcgatcccctgaaagcctgcaagcctggcgtcctgtccctgtctctcgaagggacttcttgccgccttgtggtgcccacgaggcgccctgggttgaaagccagcaactccacagcaccccgggttcaggcgcagggcctgctgggaaggcactggcttccgcgggacgaccccagccttctctttggcctcaccgctttttttccccaccctgccttgttgtgaccaagtgagttatagagaaacgccacattttgagacaaattaaagagtcctttaatagccggcgaccgagaggcagctaactttcaaaattctcttggccccgaggaaggtgctagttttgtttttataccgtggtctaaataggggatggggaattttagctgaagcaatttttacaggagaactggcaaaaagttaaaaaattaattggttacaaatgcagttacaaaaaataaacagttccaggtgcagaggcttaaactaccacaaagagataaatgcaggggttttgggtgccatccaccgagcgcatccccaggagctgctggtgcagcttgcctcaatatcttatcagtagatgcattcctggatgtgctttgagtcagttttacactagttatgccttaagggagggcggtgaaagggggttgcaaatgaagaaactgaaacggaatctgttcggctctctctctgctaggagagagtcactcagttaaaaaaaaggtagggtatcacattccccactcatgttttggggaatcaaatcattgattcttcagttataccaagggggttatactcggttctgagatacataagtttgacagaagctatgcactgttttacaaagttaaggaaccaatttaacatacaagtcctgaagattaaacttaacaagaggaggagaaggggtcctgccagtacagtaatcagaatagttagccatggattccagttgaacatgctttgataccagggggtgttactttctcgttcttgttggagtctatctatattttctcgaactctttggagggtatcttttatgactccagactgattggcatagaaaaagcaacactctcctagggctgcacataattctccttgggaaggaaatagtagatctaagccttggtggtttttgaagaactacttcagctagagactctacctgggtatgtaacatatttatggctgactagagattgcttaaatcagcatctacttgctgagacagggacattaatccagtttctccctgaactagggcagccatgccaatgcctgctgacccagctatgctaaggctagctaggaggggtactaagagtggggcagcttggcgaaacttggaaggcaattcagggggagcaataagaagttctccttctggcccactgtacacatagacctggcggagtacatgaactaacacacacagaagaggtccatgttcagtcccattgatgcagtgagtgaggcctgaagtacaagccaaccaggtgttgttaggtgcctggtaggaaactgaggtgtttaaggaagtaagtagcgattgattacaggtggcctgaaagggagaagcagataagttatacccattgctaattagacaggaggcattcccctacatgtctcctaatgtaagggcatggggtcgtgtatgacaaaagagagagttaaccttgaacatggcctctactcctaaaccaacattatatggggattttgctgtcaggcacaaccaacaatcttgggctagttttggctgggtgaggttaaggaggtgatgcactccatccagaatggacatcaggccgggttggagatgctgtcgttgtaattgggatttaggaaccaagagtggtgggacagttaaatcgaccctgtctgggtgtttttggaacatagggtcacctaaatcagttagaggtccgattggcttaggagggctccacgggaccaggacatttttctgaatggtgaacatagttccaacatcaaatcctgagatataaagtcttaatccccattacatgccataataccattgagctgaattagggttacggacagttataggaagagggttgcagttccttagagtgcacggtctaggacaggaagagcgagttatggagagggttgaggactgggttgatcctccagagtaagtggccagggttacacacaagcagttagggcagaaaaactgataggaatctcaacaactgggtcagggtgatttccagtacaggggtaaaaatcaacgctctggagtcctttttctgcacctttagagctccctcatccagtccggcttcctgtgtgtccgaatcctgcagccaggtcaatgtttcctgctcctatgaccagcagattgcattgcttttcatgggtatgggcaggctctgggaataagcacataaatcaactgcaaaagagacttttttggagcttcctgccttccaagtagtgtttgcaaatacacgtcctgtcatgaaagaagtaaggagaaaagagtaggatggagcagaaggcatgacaggcgggaacacacaaaagaggtaaataaaaggaattaatttgatggcttcaagtgacttaggtgcagttttaaggggcctggcccaggcttggggatccatgtttcttgctgggctttgctagcctttttgatgagagagtgatgaatccaggcaggaatgccatccacctttagagctgtcagcgtggtgaggatgacagtatgagtcctttccaggcaggaatgaatccttctttctggaactttttatcgtacaccaggtcacccggctggaaagagtggcagggtcccatctggtcaggaactggatttgggcgtgctccctggacaagtgcctggatgatgtctcgtacctgttggagagactgcatgtactgtaataagttagcttgagagatttctgctaaatgagtgtctctcaacctaggcaggataggtggagcccttccatacataatttcaaaaggtataaacccagctcagtaaggggtgcatgttactctaagaagggctaaacgaaggattctcacccaattctcacccatttctagaatcaattttgtaagagtattttttagggtgtggttcatgcgttctatctatccagagctctggggtcggtaggcacaatggagtttccatttgatgtttaatgccttgctgaccaactgatgtatggactaggtgaaggctggcccattatcagaccctatggcaacaggcaacccatgtcttgggatgatttcatttagtaaaaacttaactaccctagtggcagttttgtttctggtggcaaatgcctcagtccacccacaaaagatgtctactagcaccaggaggttcttataccctgcccagtgtggtttaatttctgtaaagtcaatttcccacctttctcctggtgagtctctgcagagatggtggcctgggctgggtttgggaccttgcttggcatttacctgagcacaagccatacactggagagctgcttggttagctaagtcctgagggtgggggatcttgaaacagctccttagaagctgggccaattttactcctcccaaatgggtggtagaatgtagacgattgactagagttttcccaagggcttggggtctgaagattctggaatcaggaataatccaccaaccttcctgatttttattagcctaaagatctgaagcctgtttgtcttcttctgtggagtattttgggtgatttggcaagtcaggctgcagaaaagacatggcgggcagtaggaccaagggcacgactgagagctgaacagcttctcggggctgcagagtctgctttggttaccacgggcaatggctgtgttttctctttgatgtcctttgcagtgaattacagccacctgctgaggaagccaaacagcttcaagaaaggctaaaatttcttctttgtttttaatagactttcctgctgaggtgagtagcccatgctcttgacagatggctccatgtacatgtacagtagcaaaagcatatctgctgtcagtgttaatgttaatacatttgtccttaccccatgggagagcctgagtgagggccatcagttcagccttctgggctgaagtatttgctggcaatgcctgggcccatagcacatccaactccatggtaatggccgcaccagccttctgtactccttgttcaaggacgctgctatcgtctgtaaataaggtgacctccactttctttaggggcacatcttggagatcaggtcggccagttttggtagtttctaacagttcctggcagtcatggacaggtgtagtgaactctggatcaggaagtaaagtagctggatttaaacaccttgtgggagagaagtcaaatgaggctgatctaacagtaaactctgatactgtaggatacgagcatttgacatccatttgctagaagcactttgtagcaaagtctctacagcatgtggagctgtaagggttaaattttggcctagagtcaatttgtcagcctcttggactaggcttgctgttgctgccatgactcacagacagcttggccatccagaggccatagggtccagtctctcagacaaataggctactgggcgtctccagggtcctaaagtctgagtgagcgcccccttagcaactccctggctttcatgaataaaaaggtgaaatggttttgagatatcagggagggctagagcgggggcctcagttagtgcctttttcaggtttttgaaagcctgttcttcagtgtcagtccaaactagtgggccattccttccagtagtggtgtacaggactttggcaatttctgcaaaccctaatatctacaggcgacagtatcccacagcccccaggaattcacgtacctgtcttttggtggtgggagtggggattcgcagaatggcttccttataagcactggtgagtgcccattttcctttatctcataccctaggtaggagactctgtgaagacaaagctgggcctttttggctgagactcgaaacccgagttcctgaaggaggtaaagtaagtctctagtatgttgcaggcagctgtcagaggtttcagtagctaataaaaggtcatctatgtactgaagaagggtacaattagggtgtctggctcaaaatggtacaagatcctgttggatggcttccccaaaaagggtgggggaatttttaaaaccttgaggtaaccgagtccatgtcaattgggtggtgtctccttagccaggatctgtccattcaaaggaaaatataggttggcttttgagggccagaggaatagcaaagaaatcatcttttaagtcaaggacagtgtacactgtgtgttctggtgggagcaggctgagtaaagtataagggttagggactgtagggtggacagtgactgtccatctgttaacttcctttaaatcctgtacaggctggtagtcatttgttccgggtttttggaccagcaacaatggagtgttccaggtggactgacatggtgtaagtatgccagcctgtaacagttgctgaatatgggggttgattccttccctagcccattgactcataggatatgctttacctggactggcaaggcagtggccaggagttctactaccactggcggatggtgcttagccagtcccaggaggtttgactcagcccagacctgaggaaagagagtctgtaagcccagtaagagaggattagttttattctccagtggttgtgaaggtgaaactaagagatattcttctgacagaggggtggttagcaggagctgagcagtgggaggtgttgtgtctcttagcatgaggtgagcttgttgggctgagatggaaatagatgcctgcagcttgtggagcatgtctcttcctaggaggggaaagggacactctgtgaccatgaggaatgagtgggttactcttttctgtcctaaactcacctcttgtgagtgggtgacaggatattcttgaatcactccagtagccccttgtacagcaactttcttattagagacactgcctagcggaatctgcaataccaagtgttccaccccagtgtcaattaggaagtgtacaggctggccccctactgtggcggtcaccatgggctcccaggggccaagtggaaaggagccctggccccgtcactcatgagattcctccacaaaagggagggtgaggacttttttctcttctggtttttcctctggtcttaacgggcattcctttttccagtgtcccatctgcttgcaataagcgcattggtttttctccaggggagcccggtcccctttctggcttttttggtggggacctggggttccctgaccatttttctgtgacaggggcttttctttcttgacttcatgaatggcagccactatgatttttgcctgtctttttgatgctttgtcagcaggcttttcagctgcctgagctgcctgtttctgcttttcaaactctcagttgtcaaaaaccttttgggctatctctaaaagctgactgatgttcattccagcaaatccctctagcttttgcaattttcttttaatgtcaggggctgcctgagccacaaatgccaaattaagagcacagctattttcgggagccattgggtcaaaaggggtgtaagtctgataggcctcctggaggctttcctaaaatgctcctggtgacttgtcaggcccctggacaacttcagttgtcttagacaaatttatgggtttttgagtggctcctttgacacccacaaggagataccggtgaaaatcgtctaaggctctccttccacctgaggaatttgggtcctaattaggctgggtagagggaaaagcctcttcaatttggtctcaggcttcctcttctggcccaccagctgatgtaaggtaatactttctggcctcccttcccatacactccctctcttcagaggtgaaaagggttaaaagtagttgctgacagtcctcccaggtgcggcagtgagtctggagcacggactccattagtgaggtcaaaacctgtggcttttcagaaaaagggggattatgaggcttccagttgtacaggtcagaggtagaaaaagggacaaactaagaagggagctgagtgctctctcccaaatattttgggtctctctcagtgggaggaggggggctacctcctcctgccttggccacaatcgggaagctatgggtggagagcccacaggagatgtagtcgaggaaacaagggaagaatccgggggagaaggagggttatagggtggcagaactgggagaggaaaactttcctcttcctcagaagaaggcagtacaggaggagccgaggggactcagggtcagggtaaaaatgtggaccggctcaaaaggaccctggaaatgggatcatgaatggcacatgagtggagccagggaggagggccccgtaccaaatccagccactgatcaatgtagggaaactgattggggtgaccgggacttccagtaatgacctgccacacatcctgaacacatgtggggttaaatgacccttctgtgggccatctggttccaaactgtggccattctacttcacagagtgtccagagtttgcctttcttcaggcagactccataatcttctgagaagtctacagagaaattctgcagtatacattggagaggactctactctttacagggccaggaagaggagtttcctattttggaggcagtttaacaaggttgaacagagatattaaacccagcatggacagagaaattcacaacctgggggactggcatattggaagaagggaaataacacaaccagaaagagcaggaaaaccactacagctaagacttcctgccatatgaagtaggttttcttaagcttcaagatttaggggggaagattagcaaccaacccgaggcctccttggctggcaggacctagatgacctccttccttcccttgacatatagcccaggtatttttggtgtctccatgattcaaagacaaaaagttcaaactcggccctttctttcaagggttttaggagggagagcagggctaaatcttggaggctctggacttgctgtgacacaggaaaatgagatgtgtggggaagggataaggatgagggggaaagggcccacttggatctctcctaaggtaggagagtagccaccggggaacagaataggagtccagatggagtaaagcagtatgagcgtaggcttctctgcacagtcttctattcaaaggcacgggaaacgttacaggatgacagaaaaggtgggcaaggaggcctgcagggtgactattttggatccaccactgatctaatcgggaggctgtccagtcactagagtgtgggatgtggcaatctaaattccagcagactttatggtgccagaaattccaaatgggcgagtgtttcccacacttcttcccgtaacaacacttgatttctttctgacagaaaaggcaggactgggacggccagcccaaatgactgatgaggtatttgacctcctgtggtagaaaatcagcactgaggaccttgaagaatttctttcctagttgccttggacagcactggcgacctgactatgaaacttagactgacactaaacaagacaatagacaccgagcaggacaataaacataaaacaaacaacagaccctagggtataagaacaattatggcagtttttattaaatagacaaggggagggggtccggtgatgggatcagtcagatgcccgcctggccactctccctgaggggacttgggctcctcttagcattggcaggctggtataaacccccggctcggatcgagctatgctcagtgctgccttaagccttatgaggtcaccatggaactacaggtgcgggcccactcgaactccatagcttttgccgtggagctacaaactggaagttcaagtgcaagcccttgacttccccatccactcaccattcacacaaagtttataatagtttttttttttttgccataaaacagaagtcttatggaaacctgaacgtgaaagggaggagagatagagaaagagagagcagagagagagacagagagagagagagagagactagtctttaatggagaggccagcctgccagaaaccaggactcagtcctccagcatcctggaatatggattgagtcaagggagggcccccgtcagggccgcttccctcccagagagacacagaggcacctaacagaaaatcaggactctgtcctccagtgtgctggaatgcgggcagagtcaaagagggagggccctgtcagagccatttccctcccagagaaacagagtcagatatgacttaccttcccgggaccagaggactcaggagttgaatttttctgggcacacaccagtggtcgatccattcccctccagaagacagggtcttatggggccctggaacgtcttcagggggcgcctcccctataagtccactgtctgtctgggggaacctggaatgagtccggctcttgcccagtggcgaatatctcactggggcctccaaatgttgtgaccaagcgagttatagagaaacgccacactttgagacaaattagagtcctttattagccagtgaccaagaggcagctaacgctcaaaattctcttggccctgaggaaggggctagttttgtttttatactgtggtctaaataggggaggggggattttagctgaagcaattttttacagaagcagaactggcaaaaagttaaaaaattaattggttacaaatgcaattacaaaaaataaacagttccaggtgcaggggcttaaactatcacaaagagataaatgcaggggtcttgggtgccatccacccgagcgcatccccaggagctgctggtgcagcttgcctcaatatcttatcagtagacacattcctggacacactttgagtcagttttacactagttatgccttaagggagggaggtgaaagggggttgcaagtgaagaaactaaaatggagtctgttcggctctctctctgctaggagagtgccactcagtttaaaacaaggtagggtatcacagcctcaacgtccccctgaaagcctgaaagcctggcatcctgccccatcactcggaggggggaacttcttgctgcatggagtgccccccaagcaccctggtgtgcgagccaggtactccacggccctccagggtctggtgcagggcttactgggaaggcactggcatcctgggaaggaccccaacctcctcttctgtctagctgctttttatccttggcctgcctcaatgttcccctgaaagcctgcaggcctatcgtcctgtaactatcaccttgtgggacttcgtgccgtggagtcccccccgtcacctccgggagagagacatgcaccctggggtgaaagccagggactccacagcctgcccatgtttagcgcagggcctgccgggaaggcactggcctcgggggggatgaacccagcctcctcttctgcctcgctgctttttttcccccagcctgccacaacgtccccttgagagcctgcaaggcttgcgtcttgtccccgtcaccaggggtgacttcttgtcactttggggtgcccgccacgcaccttggggtgggagctattcactacacggcacccctgggtccactgcagggcctgccagaaaggcactggtttccgacggaggacccaaccctcctcttcagattcgctgcgtttttttcccgacctgcctcaacatccccttgaaagcctgcaagcctggtgtcctgacccatcaatccggggaaatttcttgccgcttttgggtaccacccataggaaagacacataccctggcatggaagccagggactccatggccccccggatctggcccaggacctgccgggaaggcactggcctccaggagatgactccagcctcctttttgccctcgacgcttttttttctctggcctccctaacgttcccctgaaagcctacgagcctggcatcctgcccctgtcacccagggggacttcttgacgctttggggtgctcctcatgcacgccggtttgggagccagaaactccacggccaacccctgttccagtgcagggcctgctggagtcactggcctcatcgggacggcaccagcctcctttcctgccttgctgctttttttccctggcttgcctcaatgtccttatgaaagcctgcaagcctggcgtcctgtccttgtcacatgcagggaattattgccactttggggtgccccccacccaccctggggtaggatccagggactccacggccctcccgggtttggcgcagggtccaccgggaaggtgctggcctccagtggacaaccccaggctcctattcggccttgccactttttttcccctgcctgcctcaacgtccccctgaaagcctgcaagactcgcgtcctctccctgtcacccgggggaatttttgtctctttgggggtgcccataatgcaccctggggtcagagccaggaactccacggccccctcaggtccagcacagggcctgttgggaaggcactggcctcccttggtcgaccccagcctcctcttccgcctcgctgcttttattcccccgcctgcctcaccgtccccctgaaagtctgcaatctggcctcctgtccctgtaacagggggtgacttcttgcctctttgggttgcctcccacgcaccctggggtggaagccagggactccacggccttcctgagtctggtgcagggcctgctggaaaggcactggcctctgaggggggaccccagcctcctctttggcctcgcctcttttcttctctggcctgcctcaacgtccccctgaaagcgtgcaagcctggcttcctgtccgcatcactcgggtggacttcttgctgctttttgttgcccccactacgtatcttggggtgggagccagggaccccacgaatcccccaagtctggcacagcatgcccagaaggcaatgtcctccgggggaagagcccagcctcctcttcggcctcactgcttttttatccaggcctgtctcaacgtccctctgaaagcctgcaagcttggcgtcctgtccttgtcatccgttgaggcattttgccggttttgggtgcccctcacacaccctcaggaggaagccagggacttcccggcttcccagggaccaatgcagggcctccctggacggcactggcctcagggggaaaactccaacctcctcttcggggcctcgccgctttttatccctggactgcctcaatgtccgcctgaaagcctgcaagcctggcgtcttgtctgtcacccggggagacttcttgccgctttggggtgcccccggtgagggagacgcacactggggtgaaagccagggactccacggcccgccatgttctgtcgcacagactgccaagaaggcacacacctccgggggaaaaccccagcctccttttcagcctccgctttttctccccagcccgcctcaacgtcccccgaaagtctgcaagcttggggtcctgtccccatcacccagggggacttcttgctgctttgggttgcctcccacgcaccctgggttgggagccaaataatcaacagcactcgcgtgtctggtgcaaggcctgccaggaaggcactggcctcaggggagaaccccagcttcctcttcagccttgccgcttttttcctggcctgcctcaacgtccccctgaaagcctgtaaacctggcatcctgtcactgtcacctggggaaactttgccgctttggggtgcccaacgtgcacccgtggagccagggactccacggcccctccgcctctggcgcagggcctgttgggagggcactggcttccggggaccacatcctcctcttcggtctcaccacttttttcccctggcctgcctcaacgtcccccctgaaagcctgcaagcctggcgtcctgtctccttcatacagggggacttcttgctgctttgtaatgccccccacgcaccctggggtgggagccagggactccttgccaactttattctccggcctgaatcaacggcccacagaaagcctgcaagcccggcgtcctgtccctgttacccgggtggacttcttgctgctttgaggtgcaccctgtggaacagacacacaccttggggtaggaaccagggaattcacacaccccccaccccctccctgggtccggcacaggttgagttgaacagcctgcggaaaaggtactggcctctgggagaggacccccaacctcctctttggcatcaccactttttttccatggcctgcctcaatgtccctttgaaaggctgcaagcttggcgttctgtcatcacgcagggggacttcttgctgttttggggtgcccccatgcaccatggcgtgagaatcagggactccacggccaccccgggtctggggcaggacctgttgaaaaggcactggcctccagggaaggaccccagcctcctcttcagccttgccacttttttttccctggcctgcctcagcgtccccctgaaaccctgcaaggctagcatcctgtaccagtcacatagcgaaaattcttgccgctttgggatgttcccccaaaccctgaggtgggaggcagggactccacggtcctccctggtctggtgcagttcctaatgggaaggcactggcttccggaggatgactcctgcctcctcttgggccttgctgctttttctccccagcctgcctcaatattcccctgaaagttcgcaagcctggcttcctgtccctgtcacccacagggacttcttgccactttggggtgcccccaggggagagacatgcaccctggggtgggagccaggaactccatggccccctgggtccaaagcagggcctaccatacaggcactggcctccaggggaggaccccagcctcctctttgttctcaccacttttttccccatcctgcctcaatgtccctgtgttggggaaaggctgagtgttgggaaaaaaactgaggcagggcttgcatgtgtgacataatgtaaaagggtcttggaacatgtccggggtccagggtctaaaaccccttatggcctttggaacaccaagctctgtgccaaagggtggaaggctgccctgccacaccataatctaagccctgggcatgaaaccactcgtggcttgcatagaatccaggacttagggcataaaacccctcctggcttctagaatgtgtctagacttgctggctccttgcttctagcactgctattatctcaagcagcagaacttgttccatatgcttcaaagaaaatactaaatcatcacagctgtagatcatgtgcaacccccctacatcctcgccacctgtttctttgtttgatcaccaatgaatagggtgggatcccagagctaggggccttcacatcctccatgctagcattggccccctgatcccactttatgcctttacttgtcttttctcattcctttgatttggccggacctcattgcccccacagctgggtgttgggtttgatcacctcaacagccctgaaagcctgcaagcattgcaacctgttcttgtcatccagggagacatcctgccacttaggggtactgcccatgcaccctatgatgagagcaagaaactccacggcatccctgggtccagcacagtgcctgccaggaagacactggccactggagaggatcccagcctcttccgccttgtcactttttctccccagcctgcctcaacatccccctgaaaccctgcaagcctggcgtcctgtccccgtcacctggcaggacatcttgctgctttgtggtgcccccaatgcatgctggtgtgggagccggagactccaaatctcccctgaggcactggcctctggggcaggaccccatcctcctcttctgcctcaccactttttttcctctgcttgcctcaacatccccctgaaagcctgcaagcctggcgtcttgtccccgtcacctgggggcacttcttgctgctttgttgtgccccctgtgggaaagacatcaaccctggtgtgaaagccatgggctccatggccccccagttctggtgcagggcctgataggaaggcactaaccttagggggatgactccagcctcctcttcagcctcgccactttctttccctggcctgcttcaaccctggtgtgaaagcctaccggaaaagcactggcttcagggtggggggaccccagcctcctctttggcctcacctctttttttccccagactgcctcaatgacctcctgaaaacctaaaagcctggcgtcctgtccccatcacccggggggcacttcttgccgctttggggtgccccccactcaccctggggtgggagccagggactcctctgcccgccccccctgttcagatgcaaggcatgctgaaaaggcacttgcctttgggggaggaccctagtctcctctttggccttgccgcttttttcccttggcctgcctcaaagtccccctgaaagcctgcaagcctagcgtcctgtcccgtcacctgggggaaattattgcccctttggggtgccacacgcaccctggggtggaagccagggaccccgtgccccccccccgggtcggggcaggccctgccaaaagaaccccggactcagagggaggatcccagcctcctcttcagccttgctgcatttttttttccggcctgcctcaaggttcccctgaaagcctggccgcctgtccctatctcctggggtacttcttgcctccttgtgctgcccccgtggggagaggaacatgcccttgttgggagccagggtctccacaactcccacgggtagggcataggaactgccgggaaggcactgacctcctgcgagggacccctccctcctcgtcagcctcgccgatttcttcccatgcctgccgcaacctccccctgaaggcctggcctcctctccttccacgggggacttcttaccactttggggtactccaggaggaaagacacgcaccctgtgtgggagccaacaactccacgaagcccctgggttaggcacgaaggctgtcgggaaggctttgacctctgatgggggatcctgacatcctccttggcctcgctgcttttttcctgggccttcctcaacctccccataaatgcctggctgcctgtccctgtatcccgggggacttcttgctgctttggtgtgcccccgggggaagagacacgcaccctggttggcagccagggacttcacgacccccctcccccaggtccggtgcgggggctgccgggaaggcactgacctctggcgggggaccccggcctcctattcaacgtcgatgttttcttcccgggtctgcctcaacctccccctgaaggcctggacgcctgtccccatcccccggggtacttcttgccactttggggtgccacaggaggggagactcgcaccctgggtggtagcctgtggcttcacgaacctccctcatgttggtcgcgggggctgccgggaaggcaatgacctccagtgggaaaccacgacctcctttttggcctccctgctttcttcccaggtctgcctcaacctcccccgaaggcctggccacctgttccattgccctgggggacttcttgccgctttggggtccccatggggggacctctgcactgacccctggcaggggaccctggcctcctcttcggccttgccgctttctttccaggcctgcctctacatcctcctgaaggcctggctgactgtccccctccccctggggtcttcttgctgctttgggttgcccccagagagaaaacatgcaccttgggtgggagccagagactccatgaaccccttggttgggcacggagactgtcgggatgggactgaccccaggcaggggacacaggcctcctcttcgacctggctgcttttctcccaggcctgcgtcaacctaaccctgaacgtctggccgcctgtcctcgacactgggggacttcttggcgctttggggtgcccccggggaaagaaacatgcaccctggttgggatccagggactccacaaccacccctcatcaggctcagggactgccgggaaggcactgacccctggtgggggacccaggcctcctctttggccttgccactttcttcccaggcctgcctcaacctcctcctaaaggcctggctgcctgtccccatccactgggggacttcttgatgctttggggtgccccaggaggggagacacccaccctgggtgggagccagggactccatgaaccccctggttcgggctggagggctgccagcaaggcatggacccccagcgtgggaccccagcctcttcttcagccttgccacttttttccctttcctgcctcaacttccccctgattccatataaccccgggttcaggcacggggtctgttgggaaggcacttacctctggccggggttcccggcctcttctttggcctcaccacttctttcaggactcccatgggttgggcactggggctactggaaaggccctgacccctggcgggggatcccggcctcctctttggcctctccgctttcttcctgggcctgcctcaatctccccctgaaggccgggcctcctgtccctgtccctctgggaacttcttgctgccttggggtgtccccgtatgggagagacgcaccctgggtggaagctagggactccatgaatgccccccggtcaggtgcggggactactgggaaggtactgacccctggcggggggcttcggcctcctctttggcctcgtgacttccttccccggcctgcctcaagcttcccctgaacacgtggccgcctgtccccgtctaccaggggagtttttgccagtttggggtgcccccgaaggggagagacatgcaccctggtggggaggaagcaactccatgactcccccgggttgggcgtggggactgccgggaagtcactgactgccggcaggggacctcggcctcctttttggccacattgctttcttcctgggcctgcctcaacctcccccggaaggcctggccacctgtacccatccccccagggacttcttgctgctttggcgtgcccccatggagagagacacacatacttgttggaagccatggactctacgacccccccagtttgggctgggggatgctgagaaggcactcacctctggtgggggaccctagcctcctctttggcctcgctgctttttttctaggcctgcctcaaactttcactgaaaccttggccgcctgtccccgtgccctgggggacttcttgcctctttggggtgccccaggaggagagacacacaccctgggtgggagccagggactccactacccacctgagtcaggtgtgggtgctgccaggaaggcactgacctccaatgggggacaccagcctcctcttcggcctagccacttttttctcatgcctgcctcaacctccccctggaggcctggccacctgtccttatcccccggggtacttcttgccacattacggtgcccacggaggggagacacacaccctagatgggagccagggactccacgaccccacggatcaggcatgggggctgcctagaaggcactgacttctgacgggggaccccggcctcctcttcagcatcgctgcttttttcctgggacacactcaactttcccctgaacgcctgtctgcctgtccccgtcttctgaaaatctttttgtcactttggggttcccccaggtggagagatacctaccctggttgggagccaggaactccacaacccactcgagtcaggcgcaaagtctgctggaaaggcactgaccttcgatgggggaccccggcctcctcttcggcctcactgcttttatccccggcctgcctcaacctccccctgaatgcctggccacctttccccatccccagggggagttcttgccactttggggtgcccctgggtggagagacatgcaccctggttgacagccagaaactccacgatcccccaggttttggcttggggactgctgggaaggcactgactttaggtgagaaatcctggcctcctctttggccttgctgctttcttcccaggcctgcctcaacctcccctgaaggtctggcagcctgtgcccgtccccctggggacttttgccactttgggttgtccccggggggagagacacaaatcctggttggaagccagggactccacgacccctccaggttgggcgcgggggctgctgggaaggcattgacctgtggtgggggacctcggcctcctttttggcctgctgctttcttcccaggcctgcctcaacctccctgcgaaggcctcgccacctgtcctcatccccagggggacttattgccaatttgtggtgacccaggaggggagacacacaccctgggtgggagccagggtctctacaaaccccctgggttgggtgcagtgtttctgggaaggcattgacctgccatgtgggaccccggcctcctcttcggcttccctgcatttttcccgagccttcctcaacctccccctgaaagcctggctccttgtctccttcttccagggaacttcttgccactttggtgggcccatggtgggagagatatgcaccctggttgggagccagggactccacgatcctcccacgttgagcatggggactaccgggaaggtccagacctccggcgggggaaccaggcttcctctttggcctcgacgctttcttcctgggtctgccccaacctctccctgaaggcctggctgcctgtccccatcccctgggagacttcctgccacttttgggtaccccaggaggagagacacataccctggatgggagagaaggactccaagaaccccccatgttggccgcaggggctgccaggaaggcactgactcttagcaggggacctttgcctcctcttcggccttgctgctttcatcccaagcctgcctcaacctccccgtgaaggcctggttgcctgtccccttcccctggaagacttcttgcctctttgttatgcccccggagaggagacacgcacccagggtgggagccaggaactccacgacaccaccggtttgggcacaagggctgccgggcaggcactgaactctggcaggtgaccctggccttttctttggcttcactgcttttctcccaggactgcctcaacctcccccagaaagcctggccacctgtcaacgtctgttggggtacttcttgcactttgggatgacctcgtggggagagacatgcaccctggttgggagccaggaactcaacgaatcccatggattgggcacaggggctgccaagaagacccggacctctgggggtggaacccagccccttctttggcctctccactttcttcacagacctgcctcaatctaccctgaaggcctggcctcctgtccctgtcccccgggggacttcttgctaccttggggaaggcactgaccttcagcaggggatcccagccaccattttggctttgctgctttcttcatgcacctgcttcaccctctccctgaaggtctggccacctgtcccattcccccaggggacttcttgctgctttggggtgcccctgcagggcagacaagcaccctgggtgggaaccagggactccacgactcccctggtttgggaacaggtgctgcctggaagacactgatctctggcaggggaccccggcctcctctttggccttgccacctttttcccaggcctccctcaacctccccttgaactccagacaggctgtccccatcacactagggaattcttgcctcattggagtgcccccagtgggggagacatactccctggttggaagccagagactccacgacccccttgattctggcctgggggacacagggaaagcactgatctcagtggggggaccccggcctcattttcagcctcaccactattttcccaggtgttcttcaacctcccccttaaggcctggccacctgtccccgttccctgggggacttcttgcctctttgtgatgtgtgaattcatctcacacagttaaaactttctcttgattcagcaggttggaaaaactctttgtagaatctgagaaaagacatttgaaaaatcatcgatgcctatagtgaaaaaccaaatatccccagataaatactagaaagaagctatctgtgaaacagctttctgatgtgtttactcatttcacagagttaaacctttgttttgattcaggaggttgaaaacacttcttgtagaatttgtgaagggagagttgggagctcattgcggcctacagtgaaaaacagaatgtccccagatacaaactagatagaagctatctgtgaaactgctttgtgataggtggattcattgcacagagttaaaactgtcttttgattcagcaagttggaaactctctttttgtagaaactgcaaggaaacatttgggagcctattggggcctattgggaaataccaaatatccaccaataaaaactagaaagaagctatttgtgaaaccaccttgtgtgtgtggatttatctcacagagttcaacacttctgttgacagaaaagattggaaacactctttttgtagaatctgcgaagggacatttggaagctcattgaggcctatagttaaaaaaaaaaaaaaaggaatatccccagataaatattggaaagaagctatttgagaaacgtctttgtgatgtgtagaatcatctcacaaagttaaacctttctctttattcagcaggttggaaacactatttctgtatgcactatgaagggactcttgggagcccattgaggcctataatgaaaaactgaatatccccaatgtaaactagaaataagctatctgtgaaactgctttgtgatgtgtggattcatctcagagaactaaacctttcttttgattcagcaattgaaagtactcttttttagaaactgcagagggacatttggaagcctattgaggcctatagggaaaaactgaatttccctcaataaaaactagaaagaagctatttgtggaactgctttttgatgtctggattcatctcagagagttaaacctttcttttgattcagcatattggaaacaccttctctgtagaatctgctgtgggacatttgggagcccattgaggcctacagtgaaaaaagaatatacgcagatgaaaactagaaagaagctatctgtgaaactgcattgcgacgtgtggattcatctcacagaattaaacttttcttttgattcagaaggttggaaacattctttttgtagaaactgcaaaaagacatttgggagcccactcaggccttatagtgaataactgaatattcctcaataaaagctagaaagaagctatctgtgaaactgctttgtgatgtgtggattcatctcagagagttaaacatttcttttgattctgcaggttgggaacactctttttgaagaatctgtgaaggcacatttgggagtccattgaggcctatagtgaaaaactgaatatccacagataaaaacaagaaagaacctatctgtgaaatggttttgacatgtgtggatttatctcacagtgttaaacctttccattgattaaacagattggaaacactgtttttgtaagatctgtgaagttacatttgggagctcattgatgtttatagtaagaaaatttaacatctccaaataaaaattggaaacaaactacctgtgaaacgtctttgaaaggtgtggattcatctcacatagttaaactattcttttgattcagcaggttggaaacaatcttttttagaaactgcgaagggatatttgggggcccattaaggcctatagtgaatatcccctgataaaaattagaaagaagctatctgtgaaactgctttgtgatgtgtggattcatctaagacagtaaacctttcttttgattcagcagtttggaaacactctttttgtagaatcagcaaagggacattttggagctcattgaggcctatagtgaaaaactgaatatgcccagatagaaaccagatagtagctatctctggaactgctttgcaaaggatggatttatctcccagagttaaatttttcttttgattcagaagttggaaacactgtttttgtagaaactgcaaaggaacatttgggagcccattgaggtctagagtgaaaaactgaatatgtgcagataaaaactagaaagaagctacctttgaaaccaatttgtgatgcatggattcatctcacagagttaaaccttcttttgattcaacaggttggaaacactctttttgtagaatctgcaaagtgacatttgggagctctttgaggcctacagtgaaaaaccgaataatcccagatagaaagcagatagtagctatctctgaaactgctttgcaaagggtagatacatctaccagagttaaatctttctttttattcaggagttagaatcactctttttgtagaaactgtaaagggacatttgggagcccattgaggcctagattgaaaaactgaatatcctcgaataaaaactagaaagaagctacctttgaaagcaatttttgatgtacggattcatatcacagagataacctttctttcttttgtttcaggagtttgggaacattctttttgcagaaattacgaagggacatttgggagcccaatgaggcctagagtgaaaaactgaatatctacaaataaaaactacaaagaatgtatttgtgtaaccactttgcaatgtgtggattaatctcacagacctaaaattttcttttgattcaacaggtgaaaaactctctttttgtagaaaccgcgaagggacatttaagagcctattgaagcctatagtgaaaaactgaatatctgtggataaaaactggaaaaatgctatctgtgaatgcactttgtgatgtgtggattcatctgacagatttaaacttgtcttttgatttagcaggttggaaacactcttttagcagaatctgtgaatcgacacttggaatctgatagaggcctgtagtgaataactgaatatcccatgacaaaaattagaaagaagctatttgtgaaactgctttgtgatgtgtggattcatctcagagagttaaacctttcttttgattaaacaggttggaaagaaacactctttttgtagaatctgcaaagtgacatttgggagctcattgaggccaatagtgaaaaattgaataatctcagatacaaacctgaaaccaccttagaaaaagtggattcatctcctagatttaaatctttctttcgattcagaagttggaagcactctttttgtagaaaagtgcaaagggacttttgggagtccatggaggactatagtgaataactgattatccccagtaaaaaacaagtaagaagctatctgtgaagccaatttgcaatgtgtggattcacctcacagggtgaaaactttgttttgattcagcaggttggaaacactgtttttgtagaatccatgaaggaatatttgggagcccattgtggtctagagtgaaaaaccaaatatctgcaaataaaaaatagaaaaatcctgtctgtgaaactgctttgtgatgtgtggtttcatctcacagagttaaacctttctttgattcagtgggttttaaacagtttttttgtagaatctgcaaaggtatatttggaagcccattgaggcttatactgacaagctgaaaaaacccatgtaaaaactagaaagaaagtatctgtgaaactgctttgtgatgtgtggattcatctcacagagttaaacatttcttttgattcagcaggatgtaaacactatttgtagaaactatgaagggacatttgggagcccactgaggcttatagtgaaaaaccaaatatttgccaataaaaactagaaagaagctgtgtgacactgctttggtatgtgtgtagtcatctcacagacctaaaactttcttttgattccactggttaaaaccactctttttgtagaaactgcaaagagacatttaggagccctttgatttctataataaaaaacagaatattctctgataaaaacagaaagaagctattgtgaaactgctttgtgatctgtgtattaatctcagagtgtaaaaactttcttttgatttctcagtttggaaacacttttttttgtggaaactgcaaaaagacatttgggagatcattgaggcctgtagtgaaaaactgaatatccccagaaaatactagaaagaaactgtctttgaaactgctttgtgatatgtgtatttatctcagaaagttaaacctttcttttgattcctcaggttggaaacatcatttttgtagaatctgcaaagggatgtttgggagtccaatgagacctatagtgaaaaactaaatatccacagataaaaactagaaagaagctatcagtgaaagggctttgctatgtgtggattcatcttacagatttaagcctttcttttgattcaataggttggaaacactgtttttgtagaaactgtaaagggacatttgggaccccattgtggcttattgtgaaaacccatataccttccaataaaacctcaaaagaagctatctgtgaaactgctctgtgatatgtgtattcatctcatagagttaaatcttattttgattcagcaggttggaataactctttttttgtggaatctgcaaagggatatttgggggctcattgaggcctacagtgaaaaacaaaatatccaaggataaaaagtagaaagaaggtatctgtgaaaccgctttgtgatgtgtccatgcatcacacagacttaaaacttctctttgatttcacaagttggagacaccctctttgtagaatctgtgaaaggacagttggaagcccactgaggcctgtagtgaaaagctgaatgttcctagataaaaactataaagaagctatctgtgaaacatttttgtgatatgtggattcacctcccagacttaaatctttcttttgattcagcaggttggaaactctctatttgtagaaactgcgactagacatttggaaccccattgattcctatagtgaaaaacagaataatcatgaataaaaactagaaagaagcattctgttaaaccagtttatgatgtgtgtattcacctcacagagttacacttttctactcattcagcaggttgaaacactctttttgtagaatatgtgaagggacattggaagcccaatcatgcctatactaaaatactgaatattcctacataaaaactagaaataatctatctgtgaaaccgctttatgatgtgtggtgtcatctcacagagataaacctttttttttgactaagcaggttggaaacactctttttgtaaaacctgtgaggggttttacaaaccctttgggagaccactgaggcctaaagtaaaaaactgaatatccacaggtaaaaactagaatgaaactttcagtgaaaccactttgtgatgtgtggaatcatctcacaaaagtatattttttttaatgctccagattaaagactgtctttttgtagaatttgtaaagggacagttcagagcccattgaggcctatgggaaaaaagcagaatattcccagatcaaaactagaaagaagctatctgtgaaacttctttgtgatgcttggattcatctcacagagtttaacctttcttttgattcaacaccttagaaacgcttttttttgtagaatctatgaagggacatttgtagaatctatgaagggacatttgaaagttcccatagagaaaaatgggatatttccagataaaagctagaatgaagctatctgtgaaaccactttgtgatgtgtggatacatttcccagaggtaaatcattcttttgatacagcaagttggaaacatactttttttagaaactgcaaaagaaaatcctggcacccattgaggtccaccgtgaaaagactgagtatccccctcaaaaaaaaatagaaagaaggagtctgtgaaattgctttgtgatgtgtggatttatctcactgagttaaacctttcttttgatttcacaagttgaaaatacgttcgtgtagaatctacgaaaggacatttggaagtccactgaggcctgtactgaaaaactgaatattcccacacaaaaaaataaaaactggaaggaagctatctatgaaaccactttgcactgcatggaatcatctcacagacttaaagatttcttttgattcagcaggttggaaacactctttttgtagactctgtgaagtggcatttgagagcccattgaggcctatagtgaaaactgaatatccccagattaaacctagaaagaatctatctgtgaaatggcttttggatatgtgaattcatctcacagagttacatctttcttctgatttagaaggtaggaaacactctttttcaggaatctgtgaagggacatttgggagaccattgatgcttatagtgaaaaaccaaatatccccaaattaatactagaaagaatttatctgtgaaatggctttttgatgtgtagaatcttttgatttagaaggttggaaacactctttttaaggaatctgtgaagggatatttaggagcccttttaggcctatggttgagaaactaaatatcaacagataaaaaatagaaagactctatctgtgaaactgctttgtgaaatgtcaatttatctcacagagttaaatgtttcttttgattcagcacgttaaaaacactctttttgtaaaatctgtgaaggcaaatttggaagcccattgtggcctatgatgaaaaatcaaatatcctcagataaaaactagaaagaaactattggtgaaactgctttgtgatgggtggattcatctcacaaagttaaacctttctttcgattcagcaggttggaaccccttcttttgtagagactgtgaagggacactttgtagcccattgaggcctacagtgaaaaaccaaatatcccttgataaaaactagaaagaagctacctgtgaaatggatttatgatgtgtacaataatctcagagagttaaacctttattttgattcagcaggttggaatcactctttttttagatcctgagaagggacatttggcagctcattgaggcctgtagtgaaaaacagaatatccccagatgaaaagtagaaagaaactatctgtcaaccactttgtgatgtgtggattcatcttacagagacaagcctttgttatgtctcagcagattggaaacactctttttgtagaatctgtgaagagaccgtttgggagaccattgaggctaatagtgaaaaactgaatatccccagataaaaactggaaagatgctatttgtggagccacttcacaatgtgtggattcatctcacagagttcaacctttcttttgatttagcagcttagaaacactctctttgtagaatgcttgggacatttgggagctcattgatgcctatagtgaaaaactgaacaacctaagataaaaagtagaaagaagccatttgtcaaaccacttttcaatttgtggattcttttcacagggataaaactttcttttgatttagcaggttgtaaacactgtttttgcagaatctgtgaatggacattttggagcccattaaggcctgtagtgaaaaaccaaattttttacttaaaacctagataatagatatctgtgaatccactttgtgatgtgtggattcatctcacagagttaaaccattctttttattcagaaaattggacacactctttttgtagaatattcacagggacatttggaagcctattgaggtttaattgaaaaccaaaatatcccaatataaaaactagaaagaatctatgtatgaaacctctttgtgatgtgtcgattcatcttacagagttaaacctctcttttgattcaacagattggagacactctttttgtagaatctgcgaagggacatttgggagcccatttgggtctatagtgaaaaactgaacatccccagataaaaactagaaagaacctctctgtgaaaccttttgcaatgggtgcattcatctcacagaaataaagctttcccttgatgcagcaggttggaagcacactatttaaagaaattttgaagggacatttcaaagcccagtgtggcctataatgaaaactctagtgtccatgaataaaaaatggaaagaaacaatctgtgaaacaactttgtgataggtggattaatctcacagagttaaacctttcttgtgattcagcaggttggaaacattctttttgtagactctgtgaagggacattaaaagtccattgatgcctatactaaaaaactgaatattcctacataaaaacgagaaaaacctatctatctgtgaaagcactttgtgatgtgtcaattcatctcagagagttaaacctttcttttgattcaacagttttccatacttttttttgtggaaactgggaagagatattgaggagaccattgagttatatagtgataaaccaaatatccactgataaaaactagaaagaagctgtatgtgaaattgttcagtgatatgtggattcatatcagagagttaaactttcttttgattcagcagactggaaactctgtatttgtaaaaattgcaaagggacatgtgggagccaattggggcctagagagaaaaacagaatattcatggataaaaactagaagaaagctagctgtaaaatggctttctgatgtgtggattcatctcacagaaattaaactttttttttgattcagcaggttggaaacactctttttgaagaaactgcaaatggacattttggagccccttgagctctataataaaaaagtgaatatccccagataaaaactagaaagaagctatttgtgaaactgcttcatgatgtgtttattcatctcagagatttaaactttcttttgattcagcaggttgcaaacactcttttttgtggaatctgtgaagggacattttggagtccattgatgtcaagagtgaaaaactgaatatccatggatgaaaacaagagagacgctgtctgtgaagccattttgcaatgtgtggattcatctcacagagtgaaacctttcttttgattcagcacgtggaatcactctttttgtagaaacttgaaggagtatttgagagtccattgaggcctatggtgaaaaaccgtatatccctcaataaaaacgggaaagaagtgatctgtgaaactgctttgcaatgtgtggattcatctcacagggttaaacctttcttttgattcagcaaattggaaacactcctcttttagaatttgtgaagggacatttgagagcccattgaggcctatagtgaaaaaccaaatattccccaataaaaactaggaagaagctacctgtgaaaccactttgcaatgtgtggattcatctcacagagtaaaaactttcttttgattcaacaagtttgaaaccctctttttgaagaagctattaagggatatttggaaccctggaggcctatactgaggaactgaatatcaccatatagaagctaaaaagaagctatctgtggaaacgctttcctaagtgtggattcatctcacagagttaaatttctcttttggttcagcaggtgggaaacactgtttttgtagaaactgcgaagggacatttgggagcccattaagcctgtagtgaaaaactgaatagcccttgataaaaactagaaagaagctatctgtgaaactgctttttgatgtgtggattcatctcacagagttaaactttttttttgattcagcaggttgaaaagactctttttatagaaactgcaaaggcacaattgggatctcattgaggtctacagtgaagaacaaaatatctgcagataaaaactagaaaaaaactgtctgtataactgctttgtgatgtgtggattcatctcacagaattctttcttttgattcagaaggttggaaacaggctttagtagaatctatgaagggacatttggcagctcattgaggtgtatagtgaaaaattgaatatcccaaaatgaaaactcaaaagaagctatttttgaaacgtctttttgatgtaagaattcatctcacagagtaaaacctttgttttgatttagcaggatgggaacactattttgtagaatctgtgaagggacatttgggagaccattgaggcctatactgaaaaactgaatatccacatgtaaaaactacaaagaagctatctgtgaagccgctttgtgatgtgtggatttaactcacagagttaaaccttgcttttgactcagcaggttggaaactttctttttgtagaaactatgaagggacatttcaggcccattgaggcctatagagaaaaatcaaatatttcctgatacaaactggaagcaatctatctatgaaattgctttgtcatgtgtggatttgtctcacagcattaaaccttttattttgattcagcaggttggaagcactctttttgtacaatctgcaaagggaattttggagctcactgagggttttagtgaaaaacagcatatcagtgaataaaaaccagaaagaatctatctctgaaactgttttgcaaagtgtggattcatctcacatagttaaatcattcttttgatacagcaggttggaaacactctttttggagaatctgcgaaggaacatttgggagcccctttaggtccataataaaatacctaatatcccccaataaaaactggaaaaaagccatctgtgaatctgctctgtgacttgtgcaatcatctctgagagttaaacctttcctttgattcagcatgttgaaaacactattttgtaaatcctgtgaaggggcatttgggagcaaattgagtcctatagtgaaaaaagacatatccttggataaaaactagaagaacctatctgagaaaccgccttgtgaagtgtggattcattgcacagggttaaacctttcttttgattcagaaggaagaaactgtgaaggggcattttggagaacattcagacttatactgaaaaactaattattcacagataaaaaccagaaacaagctgtctgtgaaactactttctgatgtatggatgcttctcagagacttaaacctttcttttaattcagcaagatggaaacattctttttatagaatctgataagagacatttgggagcccattgaggcctagaatgaataactgaatatctgcagaaaaaaatagaaggaagctaacagtgaaaccactttgtgatgtgtggattcatctcatggagttaaaactttcttttgattcagcaggttggaaacactccttttgtagaaactgcaaagggacttttgggagcccactgaggcctatagtgacaaactgattatcccccagtaaatactggaaagaagctatctgtgaaactactttgtgatgtgttgatttatttcagagaggtaaacctttcttttgaatcctcaggttggaaatgcccttttttgtagaatctgggaatggacattttttacccattaagcctgtaatgaaaaatcaaatatccacagataaaagctaggataaatctatcagtgaaattgctttgcaatgtgtggattcttcccacagagttaaaactttcttttgattcaataaggtaggaaacactctttttgttgaagctgctaaggaacaaatagaagcccattgagggctttacaggaaaacagaatattaccatataaaaactagaaagaagctatctgtgaaaccactttgtgacatgtggattaatctcacagagttaaacctttctattgattcagcaggatgaaaatactctttttgtagaatttgcaaagggaaatctgggagcccattgaggcctatagtgaaaaagaaaatatccacaaaaaaaaaactagaaagaagctatctgtaaaaccactttgcaatatgtggactcatctcccagagttaagtctttcttttgactcagcagttcagaaacactttttttgtagaaaccatgaaaggacatttggaagcccattgaggcatagagagaaaaactgaatatctgtgaatgaaaactagaaagaagctacctgtgaaaccactttgtgatacgtggactcatctccgagaattaagtctttattttgattcagcagttcagaaacttttttttttttgtagaaaccatgaaggaacatttgggagcccattgaagcatagagagaaaaatcaaatatctgcacataaaatctaaaaagaagccatctgtgaaaccatattatgatgtgtggatatttctacagagttaaacctttcttttgattcagcaagttgggaacactttcctatagaatttgtgaagggacatttgtgagccccttgaggcctaaagtgaaaaactgaatatccgcagataaaaactagaaagaagacacctgtaaaattgctttgtgatgtgtgggtttatctctcagagttcaacctttcttttgattcaggaggttggaaacactctttttgtagaatctgtggagggatatttgggagctttttgatgcttatggttgaaaaacccaatatcaacagacaaagtctcgaatgaagctatatgtgaaactgctttgtgatgcctatattcatctaacagagttaagccttgtttcagcagattcagaacattctttttgtagaatcagtgaagagacatttgggagcatattgaggtctattgtgaaaaactgaatatccccagataaacactggaaagaactatctgtgaaactcctttgtgatccatctcacagagttaaacctttcttttaattcatcaggttggaaacacttctcttttgtagaatatgtgaggggacatttggaagcccactgaggcctacggtgaaaaactgaatatttccagggaaaaactagacagaatctacgtgtgaaactgctttgtgatgtgtggattcatcttacagagttaatttttacttgtgattcagaaggttggaaacactcttcttgtagaatctgcaaagggacatttcagagcctattggggccaatggtgaaaaatcaaatattccagataaaaatgagaaggtagctatctgtgaaactgttttgggttgtgtggattgatgtcatagagttaaacctttctttttattcagcaaatgggaaagactctttttgtagaatttgcaaagggacatttgggagcccattgaggcctacattgaaaaatggatatcactagataaaaactggaaagaagctatcaaagagtctgctttgtgatgtgtggattcatgtcacagagttaaatgtttctttagattctgcgggttggaatcattctttttgtagaatttgcgaagggtcatttggtagtccattggggcctatggtgaaaaactgagtatctccagataaaaactggaaaaaagccatctgtgaaactgctttgtgatgtgtcaattcatctcacagagtaaaattttcttgtaattcgtcatgttggtaacgctgtttttgtagaatctgtgatgggacgtttgggagacaatttaaacctacagtgaaaaacagaatatccccagattaaaaataaaaagaagctatctgtgaaactgctttgtgatgtgtgcattcagcaggttggaaactctccttttgcagaatctgcaaagggacatttgggagcccattgaggcctttggtgaaaaactgaatatccatacataaaaactaggaagaagttttgcgtgaaactgctttgtgttgtttggattcatctcgcagaattaaacgtgtcttttgattcagcaggttggaaaccctattttgtagaatctgcaaagggacattagatgggagcccattgaagcctagggtgaaaaactgaatctccccagataaaaactagaaagaagctatctgtgaaagtgctttgtgatgtgtggattcatctcacagaggtaaacctttcttttggttcagccagttggagactcttgttttgtggaagctgcaaagaaacattttggagcccattgaggactatggtgaaaaaaacgaatatccacagataaaaagtagaaagaagctatctgtgaaacttgtttataatgtgtggattcctctcacagaattaactttttttttttattcaataggttggagacactcatttggtagaatctgtgaagggacaatagggagcccattgaggcctacagtgaaaaaccaaatatcactagatgaaaatgagaaagaagctatctgtgaaacagctttgtgatgtttggattcatatcacagagttaaacgtttcttttgatttagcatgataggaaacattctttttgcagaatctgtgaagtgatatttggaaacatgttcaggcctatggtgaaataccaaatattccctgataaaaactagaaagaagttatctgttaaactgctttgtgatgtgtggattcaccaaacaacaaaaaaaactttcttttgagtcagcaggttgaaaacactctttctgtagaatctgtgaagggacgtttgggaccccattgaggcctataatgaaaacaaaaatatccccaaataaaaactagaaagaggctacctgaaaaactgctttggtttaaatggattcatctcacaaaattaaatctttctttagatttagcagttggaaacactctttttgtagactcagcaaaaagacatttgggggccctttgagggctatacttaaaaaaccaaatatcaaaagataaaaactagaatgaagccatctgtgaagttgtttgtgatgtgtggattcatctcacagagttaaacctttcttttatttcaggagattggaaatggtctttttgtagaatctgcaaagagacatgtgggagcctattggggcctatcatgaaaaatggaatatctttagataaaaactagaaacaagctatctgtgaaactgctttgtgaagtgtgtatttatctcacagagttaaatttttttttattcagcacgttgcaaaccctctttttgcagaatctgtgcaggtacatttgtaagcccattgaggcctatggtgaaaaacaaaatatttcctgaaaaaaaaaaaaactaggaaaaggctatctgtgaaactgccttgtgatgtgtggattcaccacacagagataaacctttcctgaaacattctatttgtagtatctgctaagggacatttgggagactacagtaaaaagctgaatatccccagagaaaaactaggaagaagctgtctgtgaaactactttgtgatgtgtggattcatcatacaagttaaaactttctttgattcatcatgttggtaacactcatcttgtagaatcagtgaagggacatttgggagctcgttaagggctaaggtgaaaaacagaatatccccagataaaaacaagaaagaagctatttgtgaaacagctttgtgttgtgtagattcaagtcacagaattaaatctttcttttgattcaaaaggttggaaacactctttttccagaatctgcaaaggggtatttgggatcccattgatgcctatggtgaaaaaccgagtacctttagataaaaactcgaacaaaacctatctgtaaaactgctttatgatgtgtggattcagctcactgagttaaaccatttttttgattcagcaaattggaacctatctttctgtagaacctacaaagggacatttttgagcctattgaggcctaaggtgaaaaactgaatatccccagattaaaactagaaataagctatctgtgaaactgctttgtgatgtgtggattcaccttacagagttaaacctttcttttgattcatcaggttggtaacactctccttgtagaatttgcaaagggacattttggagctcatttaggcctaaggtgaaaaatcgaatatttccaaataaaaactagaaaaaagctatctgtgaaactgctttgtgctgtgtgcattcatctgacagagttaaagctttcttttgattcggcaggttggaaaaagtctttttgtagattctgtgaagggactttggggtcccattgaagcctacattgagaaacagataatccccagatacaaagtaaaaagaagctatctgtgaaatttctttgtgatgtatggatttatctcacagagttaaaacaatcttttgattcagcaggttggaaacactttttttgtagagcctgcaaaaaaacatttgagagcccattgaggcctttggtgaaaaactgaatatccccagataaaaactagaaaaaagttatttgtgaaactgctttttgatgtgtggattcatctcacagatttaaaccattttttatttagtaagttgaaaacactctttttgtagaatctgtgaaaagacatttgagagtccattgaggcctacagtgaaaaaccgaatatccttagagaaaaactagaaagaacctattttgaaactgctttatgttgtgtggattcatctcccagagttaaatttttcttttcattcagcaggttggacatactctttttgtataatctatgaagagacatttgggagctcattgaggcctatggtgaagaaccgaatttccccaattaaaaactagaaagattctatttgtgaaaatgctttgtgatgtgttgattcatctcacagagttaaatctttctttttactcagcaggttgtaaacactctttttgcagtatctgtgaagggacacttgaaagcccattgaggcctctggtgcaaaaccaatttctttggataaaaactagatagaatttatcagtgaatgtgctttgttatgtgtggattcctctcacagagttaaaccttttttttttttttagttcagaacattgaaaacattctttttgtagaacttgtgaagggacatttgggagcccattttggcctatggggaaaaatggaatatccccagataaaaactagaaagaagttatttgtgaaactgctttgtgatgtgtggatttatatcacagagttaaaccttttttttcattcagcaggttgaaaacacttttttttttttttttagaatctgcaaaaggatatttgggagccctatgtggtttatggttaaaaaaactaatataaacagatgaaaactagaatggaactacctatgaaactgctttgtgatatgtggattcatctcacaaagttaaaacttttttttcagaaggttggaaacactgtttttgtagcatctgtgagggacatttgggagcccattgagggctattgtgaaaaacctaatttccctagataaagactagaaacaagctatgtgtgaaactggtgtgtgatgtgtggattcatctcacacagttaaaactttcttttgaatcagcactttggaaacactctgcaagtagaatttgtgaagagacatttgggagcccattgaggcctatggtgaaaaaccgaatatttccagataaaaactagaaagacactacttgtgaaactgctctgtgaggtgtgagattcatctcacaaagttgaaactttttttggattaaacacatcggaaacactctttttgtagaatctgtgaaggaacatttgggagccaattggggcctgcggtgaaaagccgaatattcccagaaaaaaactggaaagacgctatctgtgaaactgctttgtgatgtgtggattcatctcacacagttaaacttttcttttgattcagcctgttgggaaaactctttttgtacaagtggcaatgggacatttgggaatgttttgaggcctgtggtaaaaaactgaatatccccaggtaaaaactagaaagaaactctctgtgaacttgctttctgatgtgtggattcattacagagttaaacatttcttttgattcagaaggttggaaacactgtttttgtatactctgcgatgggacattttggagctcattaaggcctatgatgaaaaaccaaatatctcaagataaaaactagaaaaaagttatctgtgaaactgctttgtaatgtgtggattcatctaacagagttaaacctttcttttcattcagcagcttgaacgcactctttttgtagaatctgcaaagggacatttgggagcccattgaggcttatggtgaaaaactgaatatccccaggtaataactagaaaaaacttatctgtgaaactgctttgtgtggtgtggattcatctcccatagataaatctttcttttgattcagcacattggaaacactttttttgtacactctctgatgggacatttgggagctcattgaggcctatggtgaaaaactgaatctccccaggtaaaaacgagaaagaagctatttgtgaaactgctttgtgaagtgcggattgatctcacggagatcaacttttcctttcattcagcatgttggaaacactttttttgtagaatctgtgaagggacattgggacctctttgaggccaatggtgaaaaactgaatatctccaattaaaacctagacagaatctttctgtgaaactgtgttgtgatgtgtcaattcatgccacagagttaaacctttctttttattcagcaggttgtaaacactctttttgtagaatctgcaaagggacatttaggagcccattgatgcctatgttgaaaaattgaatatccccatgtaaaaactagaaataagctatcagtgaaactggtttgtgatttgtggatttatctcacagatttaaacgtttgtttttattccacaggttggaaacactctttttgtagaatttgcgatgaaacacttgagagccttttgaggcctatggtgaaaaacagaagagcccaagataaaaaactagaagaaatgtatatgtgaaactgctctgtgatacgtggattcaccacacggagtgaaacctttcttttgatgcagtaggtttaacacactctgtttgtacaatgtgcatagggacatttagaagcccattgaagcctatgctgaaaaaccaaatattcccagataaaaactagaaagaagttatctgtgaaactgatttgtgatgtgtaaatacaatgcaaagaattaaacctttcttttaattcagcatgttggaaacgctctttttgtagtatctgtgatgggatatttgagagcccattggggcctatattgaaaaatcgtatataaacctttcttttgattcagcaggttggaaacactctttttgtaggatctgtgaggggacatttgggaacccttggaggtatatggtgaaaaaatgaatgtccccagatagaaacgaaaatgaaactaactgtgaaaatgcctgtgacctgtggattcatctcacagagttgaaactttcttttgattcaacaggttgaaaacactgtatttgtagaatctgcaaagggacatttgggagcccattgatgcctatggtgaaaaactgatactcccagataaaaactgggaagaatgtatctgtgaaactgctttgtgatgtgtggattcaccttacaaagttaaaactttcttttgattcataaggttggtaacactctccttgtagactctgtgaatggacatttgagagcttattgagaactaaggtgaaaaactgaaaatccccagataaaaactagaaagaagctacctgtgaaagtgctttgtgatgggtggaatcatctcgcagagttaaacctctcttttgatacagcagagttggaaacactccttctgtaggatctgcaaagggaaatttcagatcccactgagaactatggtgaaaaaatgaacatctccactaaaaaaccggaaagaagctatgtgtgaaatggctttgtgatgtgccaatttatctcacagagttaaacctttctttaaatgcagcaggttggaaacactttttttgtagaatctgtgaagggacaattgtgagtccattggggcctatggagaaaaactgaatatccccagatgaaaactagaaagaagctatctgtgaaactgctttgtgatgtgtgaaatcacttcacagaattaaacctttcttttcattcaacagattggaaacactctttttgtagaatctgcaaagggatatttgagagcctatagtggcctaaaataaaaaattgattatctaaagttaaaaactagaaagaaactatctgtgaaactgctttgtgatgtgtgaattcatcttacagatttaaaactttgttatgattcagaaggttggaaacactcttattgtagaatctgctaaggggcatttggaagaccactgaagcctaggatgtaaaacagaatatccccagataaaaactagaaagaagatatgtgtgaaactgctttgtgatgtgtggattcacctcacagagttaaaagtttcttttaattcagcaggttggaaacactatttttgtagaatctgcgaagggacatttgcgagtccattgaggcctatggtgaaaaaccaaatatccccagataaatactagaaagaagctatctgtgatgggtggattcatctcacagtgttaaacctttcttttgattcagcaggttggaaacgctctttttgtagaatctgccaaggaacgtctgggggcccattgaagcctatgatgaaaaaccacatatctctaggtaaaaactagaaagaaactatctgggaaactgctttgtgatgtgtggattcatctcacagcgttaaatctgtcttttggttcagcaggatgaatacattcttttgtagcctcttcaaaaacacattttggagcacattgaggcccttggtgaaaactgaacatcacttggtaaaaactagaaagaagatatctgggaaactgctttgtgatgtgtggattcatctaagagatttaaacctttctttttatccagcagtgttttatcaacactctttttgttgaatctgcaaagagacatatgggaacccattgaggcataggataagaaacagaatatccccagataaaaatggaaagaagctatatgtgaagctgctctgtgatgtgtgaactcatcttacatagttaaaactttctgttgactcatctagctggaaactctctttttgtagaatctgcaaagaaacatttgggagcccattgaggtgtaagataagaaacagaatattcccacataaaaactagaaagaagctatatgtgaagcttctctatgatgcgttaattcatcttacagagttaaaactttcttttgattcatctagctggaaactctctttgtgtaggttctgcaaagacacgcttgggagcccattaagtcttatgttgaaaaacagaatatccccaaataaaaactagaaaaaagtttgatgtgaaactgctttgtgatgtgttgattcatctcacagagataaatctttcttttgattcaacaggttgcaaacactctttttgtaatatctgtgaagacacatttgggagcccattgagccctatagtgaaaaactgagcatccctagataaaaactataaagaagctgtctgttcaaccagtttgtgatatatggattcatctcacagatttaaacatttgttttgattcagcaagttgaaatccctctttttgtagaatctgcaaaggggaaactggaggccattgaggattctgctgaaaaacagaataccccagtttaaaaatagaaattatcaacctgtgaaacgtctttgtgatgtgtggattcatttcataaattaaacctttcttttgattcagaaggttggaaacactctttctgtagaaactgcaaattgacatttgggagcccattggggcctgtagtgaaaaactgaatatccccagataacagctagaaagaagctatctattgctttgtgatttgtggattcatctcacagagttaaaccagtctttatattcagtaagtaggaacactgtttttgtagaatctgtgaagggacattggggatcccattgaggtctataataaaaaacccaatatccccagataaaaactagaaagaaattatctgtgaaactgcttggtgatgtgtggattcatctcacagtgatgcacctttattttgattcaacaggttggaaacactctttttgtagtaactgtgaagggacatttgggagcttattttcttatgctgaaaaactgaatattctcagataaaaactgcagagaagcaatctgtgaaactggtttgtgatgtgtggattcatctcatatagtcaaatcttacttttgatcaccaggctggaaacacatttttttttgtagaatctatgaagggacatttgagatcttattgaggcctttggggaaaaactgaataatcccagacaaaatctagaaagaagctctctgtgaaactgcttcatgatgtgtggagtcatctcacagagttaaacctttcttttgattcaataagttggaaacactctttttgtggaatttgtgaagagacatttgggagcccattgaaccctactgggaaaaaccaaatatccccagataaaaactagaaagacattatctgtgaaactgctttttatgtttggattcatctcacacagttaataattttttttttgattcagcattttggaaacacttgtttgcagaacctgcaaagggacatttgggagcacattgaggcctgtggtgaaaaactgaatatctttagataaaaaagaagctagttttgaaactgctttgttaggtgtggattaatctcacaaagttaaatctttcttttgatttaacaagttggaaaaactctttttgtagaatcagtgaagggacatttgagagccatttgaggcctatggtgaaaaaccgaatatccccagagaaaaactagaaagaagatatctgtgaaactgctttgtggtattctcacagtgttttccctttcttttgattcagcaggttggaaacgttctttttgtagaatctgcaaagggacattgggaagcccattgaggtctacagtgaaaaattgagtatcttcagataaaaactagaaagaagctacttgtgaaacttatttgtgatgtgtggattcttctcccagtgttaaacttttcttttgattcaagaggttgaagacactttttacagaatctgcaaatggacatttaagaacccattgaggccaatgttgaaaaacataatatccccagataacaactggaaaaaagctattcgtgaaactcctttgtgatcggtggattcatctcacagagttaaacctttcttttgattcagcaggttggaaacactcttttgcagaattggcaaaaagacaattgggagcgcattgaggcctatggcaaaaaaccaaatatcctcagattaaaactacaaagaccttatctgtgaaactcctttgtgatacgtggattcttctcccagagttcaacctttctgtggattcagcaggttggaaacactctttttgtagaatctgcaaagggatatttggagcttattgaggcctatggtgaaaaactgaataaccccaaataaaatctagaaagtagctctctgtgaaactgctttgtgctgagtggattcgtcttacagaattaaacctttcttttgattcagcaagttggaaacactctttttgtggaatctgcaaaaagacatttgggaacccattgtatgctgtggtgaaaaatcgaatatccccatataaaagctaaaaagaaggtatcagttaaactgctttttgatgtttggattcatctcactcagtcaaatctttcttttgattcagcaaattggaaacactctttgtagaacctgaaaagggacatttgggagcccatggaggcctttggtgaaaaaccaaaaatccctagataaaaactagaaagaagctatctttgaaactgctttgctatgtgtggattcatctcacaaagctaaacctttcttttgattcaacaagtcagaaaaactctttttgtagaatcagtgaagggatattttagagccctttgagttctattgaaaaacagaatatgcccagagaaaaactaaaaagaagctatctgtgaaactgctttgtgatatgtggattcatctcatagagtttaacatctcttttgattcagcaggttggaaatacatttttgcagaaaatgtgaagggagatttggatcccattgagggctatgtggaaaagccaaatatcctcagttaaaagcttgaaattagcaatctgtggaaagtctttgtgatgtgtggtttcatctcagaaagttaaaactttctttagattcagcagattggaaacgtgctttctgtactatctgtgaagggaggcttgggagcacattgtagcttatagtgaaaaatcaagtaatccctgatacaaaccagaaagcagctatctgtgaaactgctttgtgatgtgtagattcatcacaaaaagtgaaatatttctattgattctgcaggttgaaaacacactttctggagaatctttgaagggacatttcaaagacctctgagatctgtggtgcaaaactgaatatccccagataaaaaccagaaggaagctatctgtgaaactgatttgtgatgtgtggattcatctgacaaagttaaaccttaatttagattcagtaggttggagacactatttttgtagaaactgcgaagggacactttggagcccattgaggcctatggtgaaaaaccaaatatccctagataaaaactggaaagaagctatctgtgaaactgctttgtgatgtgtggatttatctcacagagttaaacctttgttttgattcatcaagttgacaacactctttttgtagactctgcagaggaacattcgggatcccattgaagcctgtggtgaaaaaccaaatatccccagagaaaaaaaaatagaaagaaactatctgtgaaagtgctttgtggtgtgtatattcatctcagagagttaaaacattcttttgattaagcaagttggataaacactttttgtagaatcttcaagggacattttagagtccattgaggcctatggtaaaaatccgaatatctccatatgaaaaccaaaaagaagctatatgtgatactgctttgtgatgtgtgaattcatctcacagagttaaaactttcttttgattcaacaggttggaaacactctttttctggaatctgcaaaggagaatttggcagcccattgatgcctacagtgaaaaaccaaatctcccaagacaaaaactagaaagaagatatctgggaactggtttgtgatgtgtggatctatctgacagagttaaaggtttcttttgattcagcatgtgggaaacctcttttgtagaatctgcaaagggaaatttgtgagcccattgaggcctatcatgaaaacccaaatattcccagataaaaatgcaaaagaagctatgtgtgagtctgccttatgatgtgtggattcctctcacagagttaaatctttttttgattcagcaggttggaaaaactatttctgtagaatctgtggagaaacatttgggaatccattccggcctatggtggaaaatgcaataacctctcataaacactagaaagaagctatctgtgaaactgctttgtgatgcttagattcatctcacaaaggtaaaactttcttttgattcagcatttctgaaacactctttttttatcatctgcaaagggacatttgggagaccattgaggcctatggtgaaaaacagaatatcccctgataaaaactagaaagaatctagccgtgaaactgctttgtgacgttatcaacttatcttgcagagttaaatgttccttttgattcagcacgttaaaaatactctttttgtaaaatctgtgaaggcacatttggaagcccattgaggcctatgttgaaaaacagaatatcctttgatacagactagaaagaagctatctgtgaaattgctttgtgatttgtggattcaccacacagagttaaacctttcctttgattccacaaataggaaatactcttttgtagaatctgtgaaggaatatttaagagcctttggaggactatggtaaaaaactgaacatcactgcataaaatcttaaaaaatgttaacagtgaaaatgctttgtgatgtgtggattcatctcacaaagttaaaattttcttttgattcaacaggttggaaatgctctatttgtagaatctgtgaagagatatttgggatcccattgagacctatggtgaaaaattgaatatccccagaaaaaaaaattagaaaaaagcaatctgtacaagtgctttgtgctgtgtatattcaactcagagagttaaaactttcttttgattaagcaggttggaaaaactctttttgtaaaatctgtgagggatatttgggagtaaatttagtcctaaggtaaaaatcctaatatccccataaaaaaactttttttgtgatactgctttgtgatgtgtggatttatctcagagttaaaactttcttttgattcaacaggttcgaaacactctttttctagaatcttcaaaggaacatttgaaagcacattgatgcctatggtgaaaaactgaatatacccagagaaaaactagaaagaagctctctgggaactgctttgtgatgtgtggattcatctcacagagttaaatgtttcttttgattcagcattttggaaacagttttttgtagaatttgcaaagggacatttgggagcccattgagaccaatggtgaaaaagcaaatatccccagaaaaaaaagtagaaagaatttatctatgaaactgctttgtgatgtattgattcatctggcagaattaaacctttcttttgattcagcaggttgtaaacattccttttgtagaatctgcaaaggaacatttgggagtctattgtggcttatggcaaaaaactgaatattccaagataaaaatgcaaaagaagctatgtgtgagtctgccttatgatgtgtggattcctctcacagagtcaaacctttttttgattcagcaggttggaaacactctttctatagaatctgctaagagacatttcagagtccattgaggcccatggtgaaaaactaaataaaccctgataaacgctagaaagaagctatctgtgaaactgctttgcgatgtttggattcatctcacaaaggtaaacctttctttttatccagcaggtttgaatcactcattttttttttttagaatctacaaaggtaaatttttagaccactgtggcttgtgctgaaaaacagaatatcccccaataaaaacgagaaagaagatatttgtgaaactgctttgtgaagtgtgatttatctcagtgagataacttttctattgattcagcaggttggaaacactctttttgtaaaatctgtgaaggaacatttaaaggccactgaagccaatggtgaaaaaccaagtgtcctcagataaaagctaaaaagagaggttaccataaaactgctttagtttgaatggattcttctaaaagagataaacatttctttgcatttagcaggttggaaacactcttgtaaaatctgtgaatggacatatgggagccctttgaggtctattgttgaaaaactgaattatcaacagataaaaaatagaaagtatctatctgtgaaactgttttgtgaaagaggatttgtcttacaaagttaaacatttcttttgattcagcatgttgatagcactttttatagaatctgtgaaggcacatttggaagtccattgaggcctaaggtgaaaaagtaaataccctttgattaaaaactagaaagaagctatgtgtgaaactgctttgtgatgtgtggattcatcacacagagaaaagactttcctttgattcagcagattggaaacactcttttcatagaatctgcaaagggatatttaagagcccttggaggactgtggtaaaaaactgaacatccccagataaaatttaaaaagaagccaacagtgaaaatgctttgtgatgtgtggattcatctcacagagttaaatctttcttttgactcaactggttggaaacactccatttgtataatctgagaagggacatttgtaatcccattgaggccaatggtgaaaaactgaatatcttcaaataaaacctggaagaagctctctgtgaaactgctttgtgatgtgtggattcatcttacaaattaaccctttttttgattcatcaggttggtaaccttctccttgtagaatctgcaaagggatatttgggagctctttgaggcctaaggtgaaaaacaaaatatccccaattaaaaactataaagaatctatctgtaagactgctttgtgatgtgttcattcatctcacaaagttaaacctttctttttattcagcaggttgtacactctttttgtagaatctgcgaagggacatttgggagcccattgaggcctatgatgaaaaactgaatacccacagataaaaattataaagaagttatgtgtgaatctgctttgtgatgtgtggatccctttaacatatttaaaccttttttttttattcagcaggttggaaacactcattttgtagaatatgcaaagggacacttgggagctcattgaggcctatggtgcaaaactgatgtcttcagataaaaaccagataaaagctatgagtgaatctgctttgttatgtgtggatttctctcacagagtttaacctttcttttatttcagcaaattggaaacattctttttgtagaatctgtgaagggacatttggaagcccactgaggcctacagtgaaagatggaatatctccaggtaaaaactagaaagaaattatttgtgaaactgctttgtgatgtgtgtatttatctcaaagagttaaacctttcttttcattcagtagattgaaaacagtcttcttgtacaatctgcaaagggacatttgggagccctttgaggcttatgtttaaaaaactgaataacaacaaatgaaaactagaatgaagttatctgtgaaatgctttgtgaagtgtggattcatctcacagaattaattaacctttcttttgtttcagcaggttggaaacattgtttttgtagtatctgcgagggactcttgggagcctattgaaggctatcatgaaaaacctaatatccatagataaaaactagaaacaagccatcttgaaactgctttgtgatgtgtggattcatctcccacagttaaaactttttttgattcagcaagttggaaacactttttctagaatctgtgaagggacatttgggagcctctggagacttattttgaaagagggaataatcccagataaaaactagaaagaatctatttataaaactgctttgtgatgtgtggattcatctcacagagttaagactttcttttgattcagcaggtgggaaacactctgaatgtggaatttgcaaagggacttttgggagtccattgaagcctgtggtaaaaaaaaaaaaaaaaaaaaagaatatcctaagataaaaactagcaagaagttatctgtgaaactggtttgtgatgtgtggattcatctcacagagttaaaccttcctattgatttagcagtttggaaaaactctttttgtagactctgcaaagaaacatttgggagccctctgagtctgaaaatgaaaaacctactatctccagataaaaactagaaagaagctatctgtgaaacttctttgtgatgggtagattatctcacaaatttaaacctttcttttgattcagcggattggaaacactattttggagaatctatgaaaagacatttgggaggccatggaggcctataatgaaaaactgaacatcgccagataaaaactggaaagaagctatctgtgaaactgctttgtggtgtctgggatcatctcacagagataaaactttcttttgactcagcaggttggaagcactctttttgtagaatctgtgaagggacgttggaaacctcatggagacctatggtgaataacagaatagccccccaaaaatactagaaagaagctatctgtgaaactgttttatgatgtgtgggttcatctcacaggagttaaacctttcttttgatttagcaggctgaaaacactctttttgtaacctctgtgaagggacatttgggagtccattgagacctatggtgaaaaaccacctatccccagataaaaactagaaagaagctaggtgtgaaactgccttgtgatgtgtggactcatctcacagagttaaacatttcttttgattcagcaggttggaaacactctttttgtagaatcagtgaagggacactcaaaagcccattgaggcctatcatgaaaaaccaatatcccaagatgaaaaatagaaagaagctatccatgattctgctttgtgatgtgtggattcctctcacagagttaaatctttattttgattcagcaggttggaaatattccttttttcttgatggagtctcattctgccaccgaggctggagtgcactggcatgatctcggctcactgcaagctctgcctcccagattcatgccattctcctgcctcagcctcccaaacatctgtgactacaggcacccgccactaaacccagctaatttttttttggtgtttttgtagagatgcggtttcaccatgatagccaggatggtctccatcatctcctgaatttgtgatctgcccacctcagcctcccaaagtgctgggatcgcagacatgagccactgcaactgacagaaatattctttctgtagaatctgtgaaggtatatttgaaaccctgttgaggcctatggtgaaaaactgaatatccccagataaaaactggaaagaagctataggtgaaattgatttatgatgtgtcaattcatctcacagagtaaaagctttcttttgattcagcactttgggaacactctttttgtagaatctgcaaagggacatttttgagcccattgaggccatggtgataaactgaacatcttcagatagaactagaaagaagttatctgtgaaattgctttgtgatgtttggattcatctcaaacagataaatacttccttagattcaggaggttggaaacactttttttgtagaatctgcgagtggacatttggaagagcattgaggcctatggtgaaaaacccgatatccccagatggaaactagaaaggaggtatctgtgaagctgctttgtgatgtgtggattcatctaacaaagttcaacctttcttttgtttcagcaggtgcaaaacactcttttttttagaaactacaatgcaacatttgagagtgttaggggactctagtgaaaaatgaaatatctttagataaaagctagaaacaaactatctgtgaaatggctttgtgatatctagattcatttcacagaggtaaatttttcttttgattcagcaggttggaaacactctgtatgtggaattttcaaaggaatatttgagagaccattgaagcctatggtgaaaaaccaaatagctccagatgaaaactaaaaagacactatttgtgaatctgctttgtgatgtgtgaattcatctcacagagttaatccttccttttgatttagcaggttggaagcactgtttttgtagaatctgtgaagggacatttgggagcccattgaggctgatgttaaaaaatagattatccccagataaaaactcaaaagaagctatctgtgaaattttgtgatgtgtggattcatcacacagagttaaacctttcttttgattcagcaggttgaaaacactttttttgctgaatctgtgaagaaaatttcaggagcctattgaggcctatggtgaaaaactgaatatccccagatatacactagaaagaagctatctgtgaaagtgctttctgatgtgtggaatcatttcacagattagacctttctttttattcaaaaggttggaaacacttacttgtagaatctgcccattgatgcctagggtggataaccaaatttcccaagagaaaaactagaacaaagccatctgtaaaagtcctttgtgatgtgtggactcatctcacaaagatatacctttcttttgatttagcaggttggaaacactctttttgtagaatctgcaaagggacatttggaagcacattgaggccagtgtttaaaaactgagtgtcttcagatacgaatgagaaagaagctgtctgtgaatttttttttttgttgtgtgaattcatctcacatagttaaacgtttcttttgatttagcaagatggaaacactctttttgtagaacctgcaaagggacattttgaagcccattgaggccagtggttaaaaactgaatatcttcagataaaactagaaagaagctatctgtgaagctgctttgggatgtgtggattcatctcacagagttaaagctttcttttggttaagcaggttggaaacactcgttttgtagaatctgtgaagggacattcaagagcccattgaggcctatcatgaaaaactgactatcatcagataacaactagaatgaagatatctgtgattctgttttgtgatgtgtggattcctctcacagagttaaaccttcctttgattgagtgggttgtgtagaatctgtgaagggacatttgtgagcactttgtggccgagggtgaaaaacctaatatacccagagaacttgaaagaagctatctgtgaaactgctttgtgatttgtacatccatctcgcagagttaacacattctttaattcagcaggttggaaacactcgttgtgtagaatcagtgaaaggacattggaaaaaatagtgaagcctatggtgaaaaagtgaatatccccagataaaaaatatagggagttatttgtgaaactgctttgtgaagtatggattcatctcatagtgttaaaactgtcttttgttcagcaggttggaatactctttttgtagaatccacaaagaaacattttggagcccatcgagacctatgataaaaatcgaatatctccagattaaaaactagaaagaaggtatcagtgaaactgctttgtgatgtgtggctatatctcacacagttaaacctctcttttgattcagcgggttggaaacactctgtatgtagaatctgcacagggacatttgggagcccctttgaggcttatggtgaaaaaccaaatatcctcagataaaaactggcaagaaggtatctgtgagactgctttgtgatgtgtggattcatctcagagttaatccttttttctgattcaacatgttggaaacactgcttttgtagaatctgtgaagggacattttggagtccattgaggcctaatgtcaaaaactgatatcaaactgatattttgacctaatgtcaaaaacagacaaaaactagaaagaagctttctgtgaattttctttgtcatgtgtggattcctctgatagagttaaacctttcttttgattcagcaggttgtaaatattctttttgtagaatctgtgaagggtcatttgggagcccatttggggctattttgaataaccgaatatccccagaaaaaaactgaaaagaagttatctgtgaaactgctttgtgttgtatccattcatctcacagagtaaaagctttattttgattcagcaggttagaaacactttttttgtggaatatgtgaagggacatttgggggcccattgaggctgatggtgaaaaccagaatatccccagagaaaaactagaaagaagctatctgtgaaattattttgtgatgattggattcatctcacacagataaatttttccttagattcagcagttggaaagacttttttcatagaatctgtgaaaggacatttgtgagcccattgaggcctaccttgaaaaattgaatattcaaagataaaaactataaagaagctctctgtgaaacttctctgtgatgttggctccatctcacagaattaaatctttcttctcattcagcaggtgagagacactctttttgtagaatctgcgaagggacttttgagagcctaaggaggactatcgtgaaaaaccgaatatctttagacaaaaactgaaacaagctatctgtgaaatggctttgtgatgtgtggagtcatctcacagaggtaaacatttcctttgaatcagcaggttgggacactctgcatgtagaattttggaaaaaatatttgagagaccatcaaggcctatagtgaaaaactgaatattcccagataagaactaaaaagacgctatttgtgaaactgctttttgatgtgtgagttcaacttacagagttaaatctttcttttgatttagcaggttggaaacactctttttgtagaatctgagaagggacatttgggaactgattgaagcctatggtgaataacagaatatccacagataaaaactggaagaaagctatctgtgaaactgctttgtgatgtgtggattcatttcacagattagacgtttcttttgattcaaaatgttggaaacggttttttttgtaaattctgtgaagggacaactgggagcccactaatgcctagggtggaaaaccgaatatccccagagaaaaaccagaaaggagttctctgtgaaactgcattgtgatgtgtggactcatctcacagaatcaaaggtttcttttgacttagcaggttggaaaccctctttttgtagaatctgtgagaagacatttgaaagcctatcatggcctatggtgaagaactgaatatccccagataaaagctacaaagaagctatcagtgaaactgcattgtggtgtgtggaatcaactcacagacttaaactgttgttttgatttaacacgttgcaaacacccttttaaatattaaaaaattaaattaaataaattaaattaaattaataatttaaataaataatttaaaaattaaataaaataaattaaattaaatatttaacaattaaattaaataaatatttaaaagctgattgaggactttaatgatcccagatcaaaactagaaagaatctaactgtgaaactgctttgtgaagtgcacattcatttcacggagttaaacctttcttctgattcagcaggttggataaacccttattgtagtatctgcaaagggacatttgggtgcccattcaggcctatggtgaaaaatcgaatatcccaagataaaacagggaagaatttatttgagaaactactttgtgatttgtagactcatctcactgagttagacctttcttttgattcagcagattggaaacaatctttttgtagaatctgcgaagagatatttgggagcttattgatgccaatggttaaacactgaatatctccagatcaaaactagaaagtagctatctgtgaaactgctttgtgatgtgtggattcatctcacagtgttaaaactttctttttttaagcaggtgggaaaaactatttttgtaaaatctgtgaaaggacatttgagagcctatggaggaatatcatgaaaaactgaatatccctacataaaaactagaaacaagctctctgtgaaactgctttttgatgtgtggattcacctcacagagttaaacctttcttttgattaaccaggttagaaacactctgtatgtagaatttgtgaagggatatttgggaacccattgaggcctatggtgagaaagcaaatatccccagataaaaaactagaaagacactatttgtaaatctgttttgtaatttgtcaattcatctcacagagttaaacctttcttttgattcaggagattggaagcaatttttttgaagaatctgtaaaaaacgtttgggagcccaacaatgcctatggtgataaacagagtatcttcaggtaaaaactagaaagaagctatctgtgaaaccgctgtgtgatgtgcctatttatttcaaagattagaccttgcttttgattcaaaaaattggaaacaccctttttgtagattctacaatggaacaattgggacaccattgaagccttgagaggaaaactgaatatccccagagaaaaaacagaaataagctatctgtgaaagtgctttgtgatgtgtggattcatctcacagagataaacctttcttttgtttcagcacgtggaaaacccttttcttgtggaatctgtgaagggacatttttgagcacgttgaggcctatggtgaaaaatcgagtctccccagatacaaactagaaagaagctatctctgaaattgccctgtgatgtgtggatttatctcacagagttaaacctttcttttgattcagcaggttgaaaacactctgtatgtagaattagtgaggggacattttggaggccattgacgcctattgtgaaaaaccaaatatccccagataaaaactagaaagacaatatttgtgaatctgctttttgatgtgcactttcatctcacagagataaaccttccttttattcagcaggttggaaacactctttttgtagaatctgtgaaggtacattatggagtccatggggcctaaggtgagaaaactgaatatccccagataaaaactgtaaagcagctatatgtgatactgctttgtgatgtgtggattcatctcacagagttaatcctttcttttgattcttcagattggaaacacttctttcatagaatctgtgaaaggacatttgggagtccaaagaggcctatggtgaaataccaaatatccccagagaaaaactagaaagaagctatctgtgaaactgatttgtgatatgtagattcatcttacagagttaaacgtttcttttgattcaacagattggaaacacagttttgtataatctgcaaagagacattggggagcccgttgaggcctatggtgaaaaactgaatgtccccagtgaagaactaggaaggagctatctgttaatttgtaatccgtggattcctgtcacagagttaaacatttcttcagcaggttgaaaacagcctttttgtataatctgtgaaggaatatttgggagctcattgatgtctatggtgaaaaacaatatccctagggaaaaactagaaagaagctatctgtgaatctgctttgtggtgggtggagtcctctcacagagacaaacctttcttttgattcagcaggttggaaacactctttttgtaggctctatgaagggacttttgggagcccattgatgcctatggtgaaaaaccaaatatccccagagaaaaactagaaagaagttatctgtgaaagagctgtgtgagaagtagattagtctcacggagttaacactttctttgattcagcaggttggaaattctccttttgtagaatctgcaaatggacatttgaaatagtagtaaggcctacgaataaaaactgaataatatccccagataaaaactagaggaagctatttgtgaaactgctttgtgatatgtggatttatctcacaaagttaaacttttcttttgttcagcaggttgaaaacactctttttgtagaatctgcatagtgacatttggaacctctttgaggcctatggtgaaaacctgaatagcctcagataaaagctagaaagaagctacctgtaaaactgcttgggtttgactggattcatctgacagaatgaaacctattttttgattcagcaggctggaaacactctttttgtagaatctgctaagaaacatttgaaagccctttgaggcctatggttaaaaaactgaatattgacagataaaaactacagtgaagctatctgtgaaacaactttgtgatgtgtggattcatgtcacagagttaagccttatttttgtgttagcatatgggaaacactctttttgtagaatctgcaaagggacttttgagagcctatggaggcctattgtgaaaaacccaatattgctacataaaaactaaaaacaagctatcagtgaaactgctttggatatatggattcatctcacagagttcagcctttcttttgatttagcaggttgaaaacactctttttctagaatctgtgaggggacgtttgggagcccattgtggcctatggtgaaaaactgaatatctgcagataaaaactagaaagaaactatctgtgaaagtacttagagatgtgaatattcatctcaaaataaacctttcttttgagtcaaatgtttggaaacacctttttgcagaatctgcaaatggacaattgggagccaattgatgccttgggtgaaaaactgggtatccccataaagacactagaaagaagccatttgtgaaactgctttgtgatgtgttggttcgtatgacagagttaaacctttcttttgattcagcaggttggaaacactcttttcatagactctgtgaagggactttgggagcccattgaagactatggtgaaaaaaaaaatctccaaataaaaacgagaaagaagctgtctgtgaaattgctttgtaatgtgtggatacatctcacagagttaaacctttcttttgtttcaggagtttggaaacactctgtatgtagactctgcaaaggaacatttgggagttcattgattcttatggtgaaaaactacatattttcaaaataaaactagaaagaaactatctgtgaagctggtttgtgatgtgtggattcatatcactgagttaaacctttcttttgattcagcagtttgggtgcattatttttgtagactctgcaaagggacatttgagagcttattgaagtctgttgtgaaaaacagaatactctcggataaaaagcagaaaatatctatccgtgaaactgcttagtgatgtgtggattaatctcagggagtaaaagcttccttttgattaaggaggttgtaaacactctttttgtagcatctgtcaagggaaattttgttgcccattgaggcgtatggtgaaaaatggaatatccccatataaaaactagaaagaaacaatctctgaaactgctttttgacctgtggattcatgccactgagtgagttaaacctcttttgatttagcatgtttgaaacactctttttgtaaaatctctgaagggacttgggagccctttgaggccaatggttaaaaactgaatatttccagattaaaaattgaaagaaactatttgtgaaagtgctttgtgatgtgtggattcatctcacagattaatcttttttgatacaaaaggttgaaaacactctttttgtagcatctgtgagggacaattgggaccccattgatgcccagggtgagaaattaaatatcctcaaagaaaaactacaaataagctatctgtggaagggctttgtgatgtgtggatttgtctcacagagttaaacctttgttttgattcagcaggttggaaacacttattctgtagaatctgtgaagggacattttggagcacattgaggcctatagtaaaaaaagaaaaagaaattcccctgataaaaaaaaaaaaaaagctgttagtgaaactgctttgcattgtgtggactcatctgtcagagttgaacttttattttggttcagaaggttggaaacacttgttttgtagaatctgcaaagggatatttgggagctctttgaggccaatgtttaaaaacaaaatacctctaaataaaaactcgaaagaagctaacattgaaactgcttcattatgtatgaattcaccttacagagttaaactttttttttaattgagtaggttgtaaacaattgttttgtagagtctgttaatggacatttggaagcccattgaggcctatcatgaaaaaccgaatatattcagataaaaacttgaaagaagctttcagtgaatctgctttgtgatgcactgattcctctcacagagttaaaactttattttgatttgtcaggttggaaacactcttttcatagaatcttgtgaggaagatttgggggcccattgagacccatggtaaaaagccaaatatccccagataaacactataaagaaggtatctgtgaaacagctttgtgacgtttagattcatctcacagagttaaatctttcttttgattcagcaggttggaaacattctttttgtagtatctgtgaagagacgtttgggagcccagtgaggcctatggtgaaaaaccgattatacccagagaaaaactacaaagaagctgtctgtgaagctgctttgtgatgtatcaatcatctacagagttaaacctttcttttgattcagcaggttggaaacactctttttgtagaatctgtgaagggacatttgggagccctttgaggccaatggtgaaaaactgaatatccccagataacaactagaaagaagctgtctgtgaaagtggtttgagatgtgtggattcatctcagattaaaactttcttttgattcgaatgtttggaaacactctttttgtagaatctgtgaagggacaatgggggcccattaaagcttagggtgaaaaaaacaatatccccagaggaaaattagaaagaagccatctgtgaaactgctttgtgatgtgtggcttcatgtgacagagttaaacctttcttttgattcagcatgttagaaatactctttttgtagaatctgtgaagggatatttgggaacctaatgaggactgtggtgaaaaacaaaatatctccagataaaaatgagaaagaagctatcagttaaactgctttgcaacgtgtgcattcgtctcacatagttaaacctttcttttgtttcagtaggttgcaaacactctttttgtagaatctacagagggacaatttggtgcccattgaggcctatgttgaaaaacaaaatatcctcataaaaaactggtagaaaagtattggtgaaattgctttgtgatgtgtcgattcatctcacagagataaacttttatttaaattcagcaagttggaaaaactttttgtaaaatctgcaaagggacatttgatagcccattgagacctatggtgaaaaactgaatatccccagataacaactagaaagaagcagtatttgaaagtgctttgtgatgtgtgggtttctctcacagaattaaacctttcttttcattccacaagttggaaacactctttttttagaatctatgaatggacaactgggagccaaataatgcttatggtgaaaaattgaatatccccagagaaacagtagaaaaaacctacctgtgaaagtgctttgtgatgtgtgcgttcatctcacagagataaacctttcttttgattcagcaggttggaaactttttttgtagaatctgtgaagaatcgtttaggagcccactgaggcctttggtgaaacactgaataaccccacataaaaactacaaagaagctatctgtgaaactgctttgtgatgtatagattcatctcacagagttaaacctttcttttgattcaacaggttggaaacacactttttatagaatctgcaaaaagacattagggatcccattgaattctatgatgaaaaactgaatatgcccagatagaaactagaaagatgctatctgtgaaactgctttgtgatgtgtgaattcatctccttgagttaaatctttcttttgatttagcaggtttgaaacattcttttgtagaatctgcataggaacactggggagcccattgagaccaatggtgagtaacagaaaaaaaactagaaagaagctgtcagtgaaactgctttgtgatgtgtaaattcatatcaaagagttaaaccttgcttttaattcagaaggttggaaacactctttttatagtggtgatgtgtggattcaccacagaaaaataaacctttctttttattcagcaggttggacacaatctatttgtagaatatgcaaatttacatttaggagcccattgaggcctatggtgaaaaaccaaacatccccagataaaaactagtaagaagttatctgtgaaactgctttgtgatgtgtgcattcatctcacagagttaaacctttctgttgattcagcaggttggaaacactatttttgtagaatctgcaaattgacatttaagagcccactgaggcctatggtgaaaaaccgaatgttcccagaaaaaaactagaaagaatctgtgaaactgcattttgatttgcacattcatctcaccaagttaacatatgctttgattcagcaggttggaaacactgtttttgttgaatctgcgaagggacatttggaagcccattgaggtgtatggtgaaaaatcgaatattgccagataaaagcattctttttgtacaatttgtgaggggtcatttgggagcacattgaggcctgtaatgaaaaaccaaatatccccacataaaaaccagaaagaagctatttgtgaaactgtgctctaatgggtggattcatctcacagagttaaacatttctattgattcagtggcttggaaacacttttttcatagaatctacaaaggagcatttgaaagccctttgttgcatgttttttaaaaatggaatgtctctatttaaaaagtagaaacaagctatctgagaaactgctttgtgatgtgtggattcaactgacagagttaaacatttcttttgattcagcaggttggaagcactctgtagaaacatttgggagcacactgagacctgtggtgaaaatctgattatccccagataaaaattagaaagaagctatctgtggaaatgctttgtgatgtttggattcacctcacacagttaaacctctcttttaattcagtgggttggtaaaaatcttttggtacaatctgcaaattgacatttacaagcctattgaggcctatggtgaaaaaagaatatctcaaataaaaactagaaggaaggtatctgtgtcactgctttgtgatgtgtgggttcatctcacagagttaaacatttcctttgattcagcagttggaaacactctatttgtagaatctgtgaagggacatttgggaacccattgagacctatggtggaaaagtgaatatccccggataaaaactagaaggaatctatctgtgaaactgctttgtgatgtctggattcacctcacagatttaaacttttattttgattcagcaggttggaaacactttagatgtaggatgtgtgaagagatatttgggagcccatggaggcctatggtgaaaaatagaatattcccagaaaaatcctaaaaagaatctctttgtgatactgtttgtgatgtgtgcaatcatctcacttaggtaaactgttctcttgattcagcagattagaaacactctttgtagaatctgttaatggacatttgggagcccattgaggcttatggtgaaaactgaatatccccatataaaaactagaaagaagttatctgtgaacagttttgtgatgtgtggattcatctcacatagttatacctttcttttgattcagcaggttggaaacactctttttgtggaatctttggttggatatttgggagtcctttgaggcataggatgaaaaactgaatatctacagataaaaactaggaagaagctatctgtgaaagtgctttgggatgtgtggattcatctaacagaattaaacctttcttttgatttcacaagttggaaacacttttttggtagaatctgtgaagaaatatttgagacctgattgaggatgatagtgaaaaacagaacatccccacataaaaactagaaagaagtaatctgtacactttcattttggcgtgtggattcaactcacagagttaaaccattcttttgattaagcaggttggaaacactatttctgtagaatctaggaagtgaaatttgtgagcccattgatacttatgttgaaaaacgggatatccacagataagaataagaaagaatctatgtatgaatctgctttgtgttgtgtcaattcatctcacatagttacattttttcttttgtttcagcaggtcagaaacactgttttgtagaatctttgaagggacatttggagcccattgaggcctatggtgaaaaactgaatacccccagatgaaaactagaaaggagctatctgtgaaactgttttgtgatatttggaatcatctcacagagttaacatttcttttccctctgcaggttggaaacactctttttgttgaatatgtgaagggacattttggatcccattgaggactactgtgaaaaacaaaatatccccttataaaaacaagaaagaaggtatctgttcaactgctttgcaatgtgtggattcatctcacagagttaaacctttcttttgattcatctgtttggaaacactcttttagtataattggtgaagggacatttgggagctcattgagacctatgataataagctaaatatccccagataaaaggtagatagaagctctctgtaaaactgccttgtgagatgtggattcatctcacagtactaaacctttctttttattcagcaagttgaaaacactctttttgtaaaatctgcaaagaaacatttgaaagcccttgaggcctatgttgaaaaactgaatatcttcagatgaaaactgcaaagaagatatctgtgaaactgctttctgatgtgtgcattcatctcacagagttaaaccgttcttttgattcggcaggttaaaaacactctttttgtagattctgtgaagggaatttgggagcccattgaggtttatggtgaaaaggtgaatatccccacataaaaagtagaaggaaactctctgtgaaattgctttgtgatgtgtggattcaactcacaaacttcattctttcttttgattcaccaggttggaaacagtctttttgtagaatctgcaaagggacattttggggccctttgaggtctatggtgaaaaatcaaatatccccagataaaaactagaaagaagctatgtgtgaaatagctttgtgatgtgtggattcatctcacagagttaaacttttcttttgatttagcaggttggaagctctctttttgtagaatctgcaaagggacatttgggatcccattgagacctatggtgaaaaaccagacatttccagaaaaaactggaaagaagctatctatgaaacccctgtttgatgcgtgctgttatctcacagatataaacctttcttttcatttggatggttggtaacccactttttgtagaatctctgatggacatatcaggtcccattgaagcctatggaaaaaaatgaacttcttcagataaaaaccagaaataagctatgtgtgaaatggctttgtgatgtgtcaattcatctcacagagttaaacctttctttttattcagcatgttggaaacacttttattgtagactctgcaaagtgacattttggagcccattgaggcctatagtgaaaaacagaacacacccagataaaaattagaaagaagctatctgcgaaatgatttctgatgtgtggatttctcttacagagttaatttattttttgattcagcaggttgcaaatattcttttttaagaatctgtgaagggtaatttaaaagcattgaggctggccaggtgtggtggctcatgcttgtaatcccagcactttgggaggccaaggcaagtggatcacaaggtcaggagatcaagaccctcctggctaacacagtgaagccccatctctacaaaaaatacaaaaaacattagctgagtgtgatggcaggttcctgtagtcccagctacttgggaggctgaagcaggagaaaggcaaggaccaaggaggcagagcttgcagtgagccaagatcatgccacttcactccagcctaggcaacagagcgaggctccatctcaaaaaaaaaaaaagcattgaggcctatggtaaaaaacagaatatccctagataaaaactcaaaagaaactatcagtgaaactgctttgtgattggtggatgcatctcacagagttaaacctttcctttgattcatcatgttagaaacactctttttgtagaatctgtgaagggacattagggagccctcttaggcctatggtgaaaaacggaatctctcctgataaaaaaaaaaagaaagaagctatctgttaaactgctttgtgatgtgtggattcatctcacagagttaacctttatatttattcgacaagttggaaacactctttttgtagaatctgtgaaggaacattttgtagcccattaaggcccatactgaacaacaaaatattgctagataaaaacttgaaagagtctgtcttggaaagtgttttgtgatgtgtgaaataatctctcagatttaaacctttcttttgattcagtaggttggaaacactatttttgtagaatctgcaaaggaacatttgagagatcattgaggcgtatggtcaaaaataaaatatccctacataaaaactaaaaagaaactatctgtgagactgctttgtgatttgtagattcatctcacagagttaaatgtttcttttgattcagcagtttggaaacactctttttgtacacagataaacccttctgataaatctcacacaggtaagtccttctgaagattcagcaggttggaaacacttttctctgtagaatctgtgaagggacatttgggagcccattgaggcctatggtgaaaaagtaaatatcccccagaaagaaattagaaagaagctatctttgaaagtgctttgaggtatatggattcttctcacagattaaacctttattttgttcagtagcttgaaaccactctttttgtagaatctgcaaagggacatttaggagtctatttgggtttaccgtgaaaaacagaatatccctaaataaaacaagaaacaagctatctgtgaaactgttttgtgatgtttgggttcatccctcagagttaaaccattcttttaattcaacaggttggaaacactttgtatgtagaatctgcaataggacatatatgacacctttgtggcctatggtgaaaaatgggatatccccatataaaaactagaaagatgctatttgtgaatctgttttgtgatgtgtggattcatctcacaaagttaaaccttttttatgattcagcaggttggaaacagtctttttgtagaaactgtgaagtgacatttgggagcacaatggggcctatagtgaaaaagtgaataccccagataaaaactggaaataagctatctgtgaaactgctttgtgatgtgtggattcatctcacagagtgaaagctttcttttgatacttcaggtttgaaacacttgttttgtagaatctgcaagggatattatacagcccacagatgcctaaggtgaaaaactgaatattcccaaataaaaactagaaagaagctatgtgtgaaactgctttgtgatgtgtcaattcatctcacagagttaaaactttcttttcattcagcagattggaagcacactttttgaagaatctgtgaagggacatttgaaagcccattgaggactatggtgaaaaactgaatattctgagataaaaactagaaagaagttatctatgaaactgctttgtgatgtttgcattcatctcacataggtaaacccttcttttgattcagcaggttggaaacaatttttttagtatctgtgaagggaattttcaaagtctactgaagcctaacgtgaaaaaatcaaatatctccaaataaaatctcaaaagaagctatctgtgcagtgggtttgtcatatgtacattcacctcacagagttacccgtttcttttgattcaacaggtaggaaacactctttttgtataatctgcaaaaggacatatgggagcccattgatgcctatggtaagaaacagaatatccccagataaacactagaaagaaactgccagtgaaactgttctgtgatgtgtggatttagctcactgagttaaaacattttttgattcagaacgttgcaaagattcatgtatagaatctgcaaatggacatttcagagcctattgaggcctatggtgaaaaacatactatctccagttcaaaacttgaaaggacctatttgtgaaactggtttgtggtctgttgattcatatcacaaagataaaactttcttttgattcagcgggttggaaacactctttttgtagaacccgagaatagacatttgggagtccattgaggcctatgttgaaaaacagatatcccaagataaaaactagaaagaagctatctgtgaatctgctttttatgtataaatccctctcacagacttaaacctttcttttgtttcagcaggttggaaaaactctttttgtagaatatgcaaaaggacatttggcagcctattgaagcttatgatgaaaaaccaaatatcccagataaaaaggtagaaacaagctatctgtgaaactgctttgtgatttatggtttcatattccagagagaagcctttcttttcattgagcatattgttaacactctttatagaatctgcgaaggaacatttgtgagccaaatgaaagctaaggtggaaaaacaaatattgccatataaaaaacctatttgtgaaactagtttgtgatgcgtggattcatctgcaagagttaaatctctcttttgattctgcatatttaaacactctttttgtagaatctgcaaaggggcttttgggagcccattgtggcctctgattaaaagctgaatatccacagataaaaactacaaagaatctatctgtgaaactgctttgtgaagtgtggatttatctcatacagataaagttttaatttgattcagcaggttggaaacactctttttgtagaatatgtaaagggacttaggggagctcattgtgccctgtggtgaaaaaccgaatgtcttcagacaaaaactagaaagaagctatcagtgaaactgctttgtgatgtgtagattcatctcacagtgttaaacatttcttttgattcagcagattggaagcattctgtttttagaatctgaaaagggacattttaaagccaattgacacctataaaaaaatggaatatctccagatacaaactagaaagaagctatctgtgaaactattctgagatgggtggattcatctcactaagataaactttgttttgattcatcaggttggaaacactcttattgtagaatctgtgaactgacatttgaacgcccattcagacctgtggtgaaaaactgaatattcacaggaaaaaactagaagggaagtatctgttaaactgctttgtgatatgtggattctgctcacagtgttaaacttttcttttgactcagtagtttcaaaacagtctttttgtataatctgctaatggaaatttggaagcccactgaggcctatggtgaaagaccaaatatccctagatgaaaactggaaagaggctacctgtgaaactgctttgggatgtgtggattcatctctcagagttaaaccttcttgtgattcaacaggttggaaacacatttctgtagaatctgtgaaaagacaattaggagcccgttgtttcctatggttaaaaaccgaatatccccagaggaaaaaaaataagctatctgtgtaactactttgtgatgtgtggattcatctcacagaactaaacttttcttttgattgagaaggttggaaacacttgttttgtagaatctgcaagaagacatttccgtgcccattgaggccaatggtcaaaacccgaatatccccagttaaaaactagagggaagctacctgtgaaactgctttgtgatgtgttgattcatctcacagagttaaatctttcttttcatttggcaaattggacacactgtttttgtagcatctgcaaagaaacatttgaaagcccactgaggcatatggtgaaaaacaatatccccagataaaaactagaaagaagtggtacgtaaaagtgctttgtgatgtggtgatgtgttgattcttctgacagaatgaaatgtttcttttgattctgcaagatggaaacactatttttgtagaatctgtgaagggtcaatttggagccaattgatgcctttggtaaaaaaatgaatatccccacataaaaactagaatgaagctgtctgtaacagtgctttgtaatgtgtggattcatttcacagagataaccctttcttttgattcagtaggttggaaacactgttattgtacaatctgctaagagacatttggaagcccattgaggcttacagtgaaaaactgaatatccccagataaaaacaagaaagaagctatctatgaaactgctttgtgatgtgtggattcattttacaaagataaacttttcttttgttgcagcaggttggaaactctctttttgtagaatctgtgaagaaacatttgggagcccattgatgtctatggtgaaaacccaaatatccccagataaagactggaaagaacctctctgtgaaactgctctgtgatgtgtggattcacctcacaaagttaaacctttctcttgattcaacaggttggaacacacttttggtagaatctgtgaagggagatttggaggcccaatgagacatatggtgaaaaactgaatatccccaagtgaaaattggaaaaaagctatctgtgaaactgctttgtgatgtgtggattcgtctcacacacttacaccattcttttgattccacaggttggaaacactccttttgtagaatctgcaaagagacagtttggagcgaatttattcctaaggtgaaaaaccaaatatccccattaaaaaaactagaaaaatctatctgtgaatgtgctttgggatttgtgaatttattacacagggataaatttttttttgattcaacatgttgaaaagaatatttttgtaaaatctgtgaagggacatttgaaagcccaatgaggcatatggtgacaacttgaatatccgccgataaaaactagaaagaagctacctgtgaaactgctttgtgacgtgtgggttcatttcatagagttaaacctttcttttgattcaacaagttggaaacactctctttgcagaatctgcaaagggatatttgaaaaccctttgaggcctatggtgaaaaccagaatatccccagatataaactagaagaagctatttgtgaaacttctttgtgatgggtgaattcatgtcacagggttaaacctctctattggttaaggaggtttgcaaaactatttatttttgcaactatttattattgaaagcttgtggtgaaaatccaaatactcccagataaaaacgagaaagaagctatcagtgaaactgctttgtgatatgtggattcatctcgcagagttaaacctttcttttgaataagcaaattggaaactctatttttgtggaatatgtgaagagacatttaagagcccattgaggcctatgttgaaaaacaggttatccctagataaatactagaaagaagctatctgttaagctgttctgtgatgtggggattcatctctcagggttaaacctttctgatgattcagcaggttggaaacacttctcttttagaatctgtaaagagacatttgggaacccattgatacctatggtagaaaacagattttcccaagataaaaactagaaagaagatatctgtgaaactgctttttgatgtgtggattaaccacactaacataaacctttctttagattcagctggttggaaacacaatttttgtagaaactgtgaagggacatttgggagccctttgacacctgtggtgaaaaacagaatgccagcagataaaaactagaaagaagctatctgtgtaactgctctgtgatgtgtgaatttatctatcatagtgaaacctttcttttgattcagaaagttggaatctctgttttggaagaatctgtgaaaggacattttggaacttatggaggcataatgtgaagaactaaatattcccagataaaaactagaaagaagctatttgtgaaactcctttgtgatgtgtggattcatgtcacagagttaaatctttctactcatccagcaggttgttaacactctttctgtagtatctgtgaagggacagttgagggcccacacagacctgtggtgaaaaaaataatattcccagataaaaactaggaaaagctatctgtgaaactgttttgtgaagtgtggattcatctcaaagatttaaacctttcttttgattcagaagattggaaacattcttcttgtagaatctgcaaagggacattttggagccctttgaggccaatggtgaaaaaagaatatccccacataaaaactagaaaaaagacatctgtgaaactactttgtggttcttggactcatctcacaaagataaccgtttcttttgattcagcagattggaaatttttttttgcagaatctgcgaatggacatttggaagcccattgaggcctatggtaaaaaactgattatccccagataaaaactaaaaataagctatttaagaaactgttttgtaatgtgtggattcagcttaccgagataaaccttttttttggttcagcaggttggaaacactcttttgtagaatctgcaaaggaatatttggaagccctttgaggcctatgatgaaaaacagaatatccccagataaaaactaaagagaagctatctgtgaaactgctttgtgctgtgtagattcatctgacagagttaagtctttcttttgattcagtgatttacaagcactttttttgaagtatttgtgaaggtacctttgggagcccattaaggcctatggcattaaaccaaaaatcttcaaataaaagtgagaaagaagctctctgtgaaactgctttgtgatatgtggatttatctcacaaagttaaacctttcatttttttaaatgtgcagtttgaattttaatacatttgtacttatagaagatataaacaatttacaaaatgtagaagagatggaatttacccatcatttaaactaaatttttaataatttgttttttctaatttctttctttcatattccaggtaataaagaactatgctatacggaattccattggcattattatacaaaatcatagtagatacactgaaagataaaattcctacaatcaaatatgctactctctggctaaattttctcagtagcattttgcagaatgtttacatctttcatagaagcaaatttattaaaatttcaaatggcacagtgctttacaggaatcacatttattaacactcctttatttattaaaactaataaataattaaactattatatagaccctcctctgtattacaactacaaaggactataaatcatgctgctttaaagacacatgcacacatatgtttattgtggcactattcacaatagcaaagacttggaaccaacccagatgtccaacaatgatagactggattaagaaaatgtggcacatatacaccatggaatactatgcagccataaaaaataatgagttcatgtcttttgtagggacatggatgaaattggaaaacatcattctcagtaaagtatagcaagaacaaaaaagcaaacaccgcatagtctcactcataggtgagaattgaacaatgagaacacatggacacaggaaggggaacatcacactctggggactgttgtggggtggggagaggggggagggatagcattgggagatatacctaatgctagatgacgagttaatgggtgcagcataccagcatggcacatgtatacatatgtaactaacctgcacattgtgcacatgtaccctaaaacttaaagtataataataataaaaaaagaaaaaagatacctattttctaattgtcaccgctaattaccccaagggcagctgttcgttcatctaccaccagctctcctgtgttctgtactgtccatattttgcctctgataatgcataccactaaaaagaatcagggtacctgggaggaaaattgattccagtgttcaagcaggaaaaaaaatggattggtctggaatatccttttgttgtctgaaatgagctattgcttaaaaaatgtcaggagcagtgctaaaggacagaagagcaaacttaacaaggcttccattggctaagctgcaaagaccatcatcataattgtgataataatcatagtagttaaaacctttccttctattcagcaggttggaaacactgactttgtagagtgttggaagggatattttgatgcccatttagccctatgttaaaaaagtgaatattttcatataaaaccttgaaagaagatgtctgtgaaactgctttgtgatgtgtgcattcatttcacagagtaaacagcttctttttattcagcatgttggaaacactgtttttgtagaatcagcaaggagatatttgggagtccgttgaggccaatggtgaaaaaccaaacatctccagatataaactagaaagaagctatctgtgaaactgctttgcaatgtgtggatttatcttgcagagttaaaccttttttttttttgatccagcagtgttgaaacactctttttgtgaaaactacaaaggagtatttgggaatccattgaaacccatggtggaaaaaatgagtatttccacataaaaaacagaaacaagctttctgtgaaactgctttctgacatgtggatttatctcacagagttgaacctttctttcgattcagaatgttgtaaacactctttttgattcagaagtttggaaacaaatggacatttgggagctttctgaggtctatggttaaaaaaggaatttcccagataaaagttagaaagaagctatctgtgaaacttctttgtgatgtgtggattcacctcacagggttaaacgtttctttttattcagctgtttggaaacacacttcttgtagaatctgtgaagggacatttgagagacaattgaggcctatagtgaaaaatcaaatatccccagataaaatatagaaagaagctatttgtgaaactgctttgtaatgtgtggattcatgtcacagggttaaacctttccattgattcagcacgtttgaaaacttttttttttgtaaaattcaggagaagatatttgaaaacccattgagttctatggtgaaaaaccaaatattcccagaaaaaaccttgaaagaagctatctgtgaaactactgtgtgatgtgtggattcatctcacagagttaaacctttcttttgattcagaaggttgtaaacacacttttcatagaatctgtgaagggaaatttcaaagccattgaggcctatggtgagaaactgaatatctccacttaaaaactaaaaagaagctatctgtgaaactgctttgtcatgtgtggatttatctcacagagttaagccattctttttattcagaaggttggaaaaactcttcttataaaatctgcaaaaagacatttgggaattctttgaggcctatggtaaaaaatggattatctccagattaaaaagtagaaataagctatctgtgaaactgctttgtgacgtctggattcatctcacagtttaaagtttcttttggttcagcatgttggaaacaatctttttttagaatttgggagcctattgagtactatggtgaaaaacagaatatccccagataaaaactagaaagaagttatctgtgaaacctctttgtgatgtgtggattcacgtcacaaatttaaacctttctattgattcagcaggtttcaaacacttttttttaaagaatctttgaaaagacagatgaaagttcattgaggcctatggtgaaaaaccgaatatcccagataaaaacttgaaagaaactatcaatgaaactgctttgtgatgtgtggattcacttcacagaattaaagttttgtttgattcagcaggttggaaactttttttttttttttagaatctatgaaggcacattttagagcccattgatgcctgtggtgaaaaaccgaatatcgtcagataaaaactagaaagaagtaatgtgtgaaactgctttctgaggtgtggattcacaattcaccacgtagactgaaacttttctttccactcagcagattggaaacacttttttttttaagaatttaggagcccattgagcattgtggtgaaaaaaccaaacatctccagataaacactagaaagaagctatctctgaaattcctttgtgatgtgtggattcatctcacagaggaaaacccttttttatttatcagcaggttgggaatattcttaatgcagaatctgcagaagaacatttgtgagaccattgagacttatggtgaaaaattaatatccccagataaaaacgagaaaaaatatgttggtgaaactgctttgtgatgtgtcaattcacctcacagagttaaacctttctttggattcagcatgttagaagcacattttttaacattttgaagcccattttggcctaccattaaaaactgaatatccacagattacagagtagaaagaagatctgtgttaaactgctttggatacgtggatttatctaacagaagtaaagctttcctttaattctgcagtttggaaactctttttttgtagaatctgggaagggatatttgagagtcctttgaaaactatcgagaaaaactgaacattccctgataaaactagaaataatctatacgtgaaaactgctttgagatgagtggattcatctcacagggtttaacctttcttttgattcagcaggttggaaacactttttttgtttaatctgtgaagagacattttggagcccactgggaacccaagtgaaaaaccgaatatccacagataaaagctagaaagaatctatctctgaaacagataaaatatttcttctcccagagttaaacctttcttttgattcagcaggttggaaactctctttttgtagaatctgtgaagggacgtttgggagccaattgagacctatggtgaaaaactgaatatcccatgggaaaaactagaaagtagctatctatgaagctgctttgtgatgtgtggatttatcttacagaaataaagctttctttggattaagcatgttggacacactatcattgtagaatctgcaaagggacatttgtgagtccattgagtcctatggtgaaaaatggaatatccccagttaaaaagcagattaaaccttttttaaattcaacaggttgtaaactctttttgttgattctgtgaaaggatatttgagagtccattgaggcctatggtaaaaaactgaacatccaagataaaaactagaaacaaggtatttgtgaaactgctttgtgatatttggattaatctcccagagagaaaatttcttttctttcaacaagttgttaacactctttttgtagaatctgcgaaaagacattggggatcccattgtggtctattgttaaaaatattatttacagataaaaactagaaagaagctgtctgtgaaactgctttatgatgtgtggattcatcttaaggagtcaaacttttctttttattcagcaggttggaagcattcttagtaggatttgggaagggacattttggggcccctagaggcctatgatgagaaaccaaatatctccagactaaaaactagaaagagactatctgtgaaactgttctaagatgtgtggattcatttcacagagttaaagctgccttttgatttagaaggttgaaaacactctttttgtagaatctgtgaagggacatatagagcccattatatcctagggtggaaagtcaaatatccccagataaaaactagaaagaagctatctttgaaactgctttgtgatgtgtgaattcatctcacagagttaaacctttctgttgattcagcaggttggaaacactctttttgtggaatctgctaaatacatttgggagcccattacagactatggtgaaaaacagtataaccccagtggaaaaactagaaagaagatatctgtgaaactgctctggactgtgtggattaatctaataaagttaaactttcctttgatttatcaggttgtaatcactctttttcgtagaatctgcaaagggacatttggaagcccactgaggcctacagagaaaaactgaatatgtgtactatctatgaaactgctttgtgatgtatggattcatctcacagagttaaacctttcttttgattcagcaggttggaaacactttttgtataatcatcaaagggacatttgaaagcccattgtggcctatggtgaaaaactgaatatccccagataaatactggaaagaagctacctgtgaaactcctttgtgatgtgtgcattcaactcaaatattttaattttttaaaattcaacaggttggaaatggttgataagctttcttttgatgcaccaggttggcaactctattattgtaaaagctgtgaaaggactttcaagaaacccttgtgacccatggtgaaaagccaaatatcccctgataaaaactagatagaacctatctgtaaaactgctttgtgatgtgtggatttgtctcactacattacaccttacttttgatttatcaggttggaaatactctttttgtagaatctgcaaagaaatatttgggagccccttgaggcctgcagagaaaaacagattatccccagaaaaagctagaacaatgctatctgtgaaactgctttgtgatgtgtggattcatctcacagagttaaacttttcttttgattcagcaggttggaaacactctttttgtagaatctaagaagggacatatgaaagcccattgtggcctatggtgaaaaactgaatatcctcagataaaactacaatgaagctacctgtgaaactcctttgtaacgtgtgcattcatctcaacaatttaaaaatttcttttaattcagcaggttggaaacactgtttttgtagactattcaaagaaacatttaaggacccattgtgtcctcctgttacaaaccaaaaatccccagatcaaaacaagaaggaagcaatctttgaaactgctttgtcagttgtgggttcatctacaagagttaaaactttcttttgattcaccaggatggcaactttatttttgtaaaatctgtgaaaggacatttaagaacctttgtggcctatggtgaaaaaccgaatatccccagataaaaactagaaagaagctacctgtgaaattgcttgttgatgtgcacttttatctcaaagatttaaacctttcttttgattcagcaggatggaaatacttttttttgtagaatctgtgaagaaacatttggaagccccttgcggcctaaagtaaaaaacagaatatccccagataaaaactagaaagatgctatctgtgaaactgcttttaaatgtgtggattcatctcacagaggtaaacttttcttttcattcagcaagttggaaccactctttctgtagaatatgtgaagggccttttggagcacattgagacctatgttaaaaaacagaatatccccagataaaaactagaaagaagctatctgtgaaattgcttcatgatgcatggattcatctcaaagaggtaagccttccttttgattgagcagcatggaaacacagtatttgtagaatctgggaaggggcattttgtaacccattttttcatatggtgaaaaaccgaatatctgcaattaaaaaatagaatctatctgtgaaactgcttcatgatgcatgtattcgtctcagagagttaaacctttcttttgattctgcagattggaaacactcttttttgtagcaactgggaagggatctttgagagcccattgacttctatgttgaaaaactgaagaaccccagataaagataagaaagaagctatatatgagactgctttatgatgtgtggattcatctcagggagttaaaactttcttttgattcattcggtttgaaacactcttgttgtataatttatgaagaaacatttgggagcccattgatgactatggtgaaaagccaaataaccccagataaaaactagaaagaagatatctttgaaactgctttgttatgtgagtactcatcttaaagagttaaaactttcttttgattcatccagttggaaatgctctttttgtagaatttgtgaagaaacatttgggaggcaattgaggcctatggtgataaatggaatattccaagatgaaaaactatagaaagaactttccatgatactggtctgggatgtgtggattcatctctcagagtcaatcctttcttttgattcaacaggttggaaacactttttgtaaaatcttggaagggacttttggagttcactgaggcctatggtgaaaaactgaatatccccagataaaaaatagaaacaatgtatctttgaaactgctttgtgatggctgtattcttctcacagagttaaacgtttgttttgatccagcaggttggaaaaactctttttgtagaatctacaaaggggaaattggaagcacattgaggcctataatgaaaaatgggcattcccagatcaaaactagaaggaagctatctgtgaacatgctttgttatgtgtggcttcatctcacaaagttcaacttttattttgattcagcaggttggaaacactattttagtggaatctctgatgggacattttggagcccattgaggcctatggtgaaaaactgaatatagctggatgaaaactcaaaaagaggtgtctgtaaaattactttgagatgtgtggatttatctctccatgttaaaccattctattgattcagcaggttgggaaaacactttctgtaaaatctacaaaaggatatttgagacctgtagtggcctatggtgaaaaactgaatatcccctgacaggaactagaaataaattatctgtgaaactgctttgtgatgtgttgattcttttcactgacttaaacctttttttgattcagaaggttggaaaccattttttgtagaatatgcgaagggacatttgggagcccattgaggcctatgttgataaactgaacatacccagataaaaactagaaagaagctatatttaaactgcttatgaagtgtgcattcatctcacaaattaaacctttcttttgattcagcaggttggaaacactctttacgtggaatctgtgaagagacattagggagcccatggaggcctttggtaaaaatctgaaaaatccaagataaaaactagaaataaagcatctgtgaaacttctttgaaatgtgtggattcctctcacagagttaaacctttcttttgattcagctggttggaatcactctttttgaagaatctgcaaaaggacttttggagcccattgaggaatatggtgaaaaagagaatatccctagataaaaactagaaagaaggtatctgtggaatcctttgagatgtgtggattcatctcaagtagctaaacctttcttttgattcagcagattggaaacacagtttttgtagaatctgggaaggggcattttggagtccattgagtcctgtggtaaaaaactgaatatcctcaattaaaaactagaaagaatctacctgagacagtccttcatgatacgtgaaatcatctcacagagttaaaccattcccttgattcagcaggttggaaacactctttttgtagaatctgggaagggacatttgagagcacattgagttctatggggaaaaacagaatatccccagatcaaaacttgaaagatgctatctgtgtaactgctttatgatgcgtggattcatctcaaagagggaaacctttattttgattcagcaggttggaaacactctttttgtagaatttgcaaagaaacatttgggagccctttgaggactgtggtgaaaaaccaaatatatccagataaaaaactataaagaatctaagtgtgaaactgctttgtgatgggtagatttatctcacagggctaaacatttcttttgatccagcaggttggaaactatcttcttgtagaatctgcaaagggatattttgaagcccattgaggctatggtggaaaaccgaacatccctagataaaaactagaaagaagctatctctgaatctgctttatgatgtgtgcattcatctcacagaattcaacctttattttgattcagcatgttggaaacactctttttgtggaatctgcaaagggacatttgaaagcccattgaggcctatgatgaaaaactgaacatccccagataaaatctagaaagaaggtatctgtgaaactgcttgatgatgtgtgaattcaactcacagggttaaacttttctttggattcagcaggttggagacactctttatatggaacatgcaaaggacaattggaagcccattgaggtctatggtaaaaaactgaaaaatccgagataaaaactagaatgaaggtatctggaaagctgctttgaaatgtgtggattcatctcacagagctaaacatttcttttgattcagtgggtggaaaccactctcattgtagaatctgtgaagggacatttggagtttattgaggtctaagttgaaaaacagaatatccacagagaaaaactaaaagaaaaatatctgtgaaactcttttgtgatgtgacgattcatcccagagagttatccctttttttgactcaaaaggttgaaaccattctagtggttgaattagtgaagggacattttagagaccactgaagcatatggtgaaaaactgagtaaccccaattaaaaactagaaagaatgatctgtgaaactgcttcatgacgtttgtactcatctgacaaagctaaaactttctttggattcagctgattggaaatgctctttttgtagaattttggaagggacatttgagagcccattggattttatgttgaaaaaccgaatatccccagataaaaaccagaaagaagctatctgtgaaactgctgtataagctgtggatttatctcaggtagtgaaaccttccttttcatttggcagcttggaaacacactttttgaagaatctgagaagaaacatttggagtcatttgagaaatatggggaaaatctgaatatcccaagataaaaagaagaaagaagctatctttgaaacagctttgtgatgactggattcatcttaaaaagttaaacctttcttttgattcagccaattggaaagcctcttttttagaatctgcaaagtatcatttgggagccctttgtggcatatggtgataaaccaaatatcccaagacaaaaaattagaaagaagttatctgtgatcttctatgggatttttggattcatctcacagagttaagcttttctttagattcagcgggttggaagggctttttgtagaatctggacagagacttttggagctcaatgaggcctatgatgaaaaactgaatattcctagataaaaactagaaagaagctcttggtgaaactgctttgtaatgtgtgaattcatcttaaagagttaaacctttcttttttattcagcaggttggaaacattgcttttgtggaatctgcaaagggacatttgagagcccattaaagcatatggtgaaaaacagaataccccagaagaaagactagaaagaaaatatctgtgaaactgctctgggatgtgtggattcatctcacaaagttaaactttttttaaaattcatcaggttggaaacaggttggaaactttctttgtagaatctgtgaagggacatttggaacccatttgaggcgtatgttgaaaaactgaatatcccaagataaaaaacagagagaagctatctttgaaactgctttgtgatgtgtggattcatctcagagttaatcctttcttttgattcatcagattggaagcacgctttttgtagaatcagggaagggacatttaagagactaatgatgcctatgaagaaaaacaatatcaacagagaaaaaccaaaaatatgctctctgtgaaagtctttcatgatgtgttggttcatctcacagagttcaacctttcttcttatttagcaggttggaaacattctctttgtgaaatctgagaaaggacatttaggagtgcattgaggcctatggtgaaaaaaagaacatctccagataaaaagtagaaagcagctgtctgtgaaactgctttgtgatttgtagattcatctcacacacttaaacctttcttttgatttagcaggttggaaaagctcttttgtagaatctccaaagggatagtttagcaaagaggcaaatggtaaaaagctgaatatcaccagataaaaactataaagaacattctgtgaaactgcttttttatgtgtggattcaactcacagaattaaaactttcttttgattcagtaggttgggtacactctttttgtagaatctggaaagggacatttgggaagccattaaggtctatggtgaaaaaatgaatatccccagttaaatactagaaagaagatatctgtgaaacttcttcatgagaagagatttatctcacacaggtaaacctttcttttgattcagcaggttggaaacactctttttgtagaattctggaagaaatatttgggagcccattgcatcctatggtgaataattgaatatacccagataaactctagaaagaactttctatgaaactgttttatgatgtgtggattcatctcagagagttaaacctttcagtggattcaccaggttggaaacactttttttgtagaatctgcaaagaaacatttgggagcccattgaggtctatggtgaaaaacaacatatccccagaaaaaaaagtagaaagaagatatctgtgaaactgtttcagatgagtggatttatttcacagagttaaacttttcttttgattcagcaggttggaaacactttttgtagcatctgtgaaaagacatttgagagcccactgtgtcctatggtgaaaaaccgaatatccccagataaaaactagaaagaagctatctgtgaaacagctttatgatgtgtgcattcatctagagagttaaacctttcttttgaatcagtagcttggaaacaatctttttttagaatctgtgaagaaacatacgtgagcccattggctttgtgatgggtagatttgtcttaaaaagttaaacctttcttttgattcatcaggttggaaacactcattttgtagaacctgtgaagggacatttggtagccttttgaggactatggtgaaaaaccgaatatccccagataaaaactagaaagaagctatctgtgaaacagctttatgatgtgtgcattcatctagagagttaaacctttcttttgaatcagtagcttggaaacaatctttttttagaatctgtgaagaaacatacgtgagcccattggctttgtgatgggtagatttgtcttaaaaagttaaacctttcttttgattcatcaggttggaaacactcattttgtagaacctgtgaagggacatttggtagccttttgaggactatggtgaaaaactgaatatctccagatgaaaaactaaaaagaaactatttgtgaaatggctctgggatgtgtggattcatcacaagaggtaaattttttttgattcagcattttgtaaacactctttttgtaaagtctgggaagaaattttggagaaatttggggcttatggtgaaaaatggaatatctccaaataaaatctagaaagaagctatctgtgaaacaactttgtgatgtgtgaattcatctcacagagttaaaacttacgtttgattgagcaggttggaaacactctttttgttgaatctgtgaagtgacatttgggagcccattgatgtctatggtgaaaactgaatatccccagataaaaactataaaaaagctatctgtgagactgattcatgacgtgtgaattcatcttacagatttaagcctttcttttgattcagcagcttggaaacactttttttgtagaatctatgaagagacatttggggcccattgagacatatggtgaaaatcaaatatccccaaatgaaaactagaaaaaagctatctgtaaaagttctatttcaagtgtggatttagttcacagagttaaactcttactttgtttctgcacattggaaacattctttttgtagaatcagcaaagggacatttaactgcccattcatgcctagggtgaaaaatcaaatatcaggagataaagaccagaaagaagctatttttgaaagtcctttgtgatgtgtggattcatctcagagagttcaacttttcttttttttcagcaggttggaaacattttttgtgtaatctgtgaagggaaatttcagagttcattgaggcctatggtgaaaaagagaacatcccccaataaaaagtagaaagaaacaatctgtgaaactgctttgtgatgtgtggattcatctcacagagtaaaaactttcttttgatttagcaggttggaaaaactctttttgtagtatctgcaaagggacatttgggagcccattgagacctatgttgaaatcacatatcttcagataaaaactagaaagaagttatctttgaaactgctttttgatgtgcagattcatctgacagagttaaacctttcttttcatttagcaggttggatacacacttcttgtagaatctgtgaagggacatatgaaagcccattgtggcctatggtgaaaaactgaatatccccagtttaatactagacagaagctatctgtgaaactgttctgtgatgtgtgaattcatcttacagagttaaacttttcttttgattcagcaggtttgatatactctttttgtacaatctgctaagaaatttttggagacaattaaggcctaaggtgaaaaaccaaatatccccagataaatattagaataaagctatctgtgaaactgcttcgtggtgagtggatttatctcacaaagttcaacgtttcctttgattcagcagattggaaacactttttgtaggatctgtgaagggacatttgggagcacattgagtcttacggtgaaaaaccaaatatctccagataaaaaatagaaagaagttacttgtgaaactgctttataatgtgtggattcatgtcagagaggtatacctttcttttgattcagcaggttaaaaacacttttttttgtagactctgtgaagaaacatttgggaacccattgaggactatggtgaaaagcagaataccccagataaaaactagatagaagctatgtttcaaactgctttatgatttgtggattaatattaaaaagttaaacctctctttacactcagtaggttgaaaacgccctttttttagaatctgcaaagtgacatttgggagccctttgaggcctacggtgaaaaacagaatatccacaaacaaaaaactgaaacgaacatactgtgaaactgctctgtgatgtatggattcacctcacaacgttaaactttacttttgattcagtaaattataaaaaatctttttgtagaatctctgaagggacatttgggagcacattgaggactatggtaaaaaaacaaaatatccccattaaaaaaaactaaaaaaaaaaagattgtgaaactgctttgtgacgtttggaatcatctcacagaattaaaactgttttgattcagcgtgttaaaataactctttgtgtggaatatgtgaagggaattttggagcccattgaggcctatggtgaaaacaatttttttccaattaaaaactcaaaagaatctatctgtgaaacagcttcatgatgcatggatttatctcagaaagttaaaactttcttttgattcagcaggttggaaacactctatttgtagaatttaggaagggacatttgagagcctttcgagttctatggtgaagaacccaatatccccagataaaaactggaaaggtgctatctgtgacactgctttataatatgtggattcatctcagagagttaaacattttctgtgattcaacagattggaaacacactttttgaagagtttttgaagggacactaggaagccatttaggcctatggcgtaaatctgaatactcccagataaaaactaggaagaagctatctgtgaaactgccttgagatgagtgcattcatctcacagagttaaacctttcttttgaatttagtgggatggaaacattctttttgtagaatctgcaaatagacatttgggagcctattaagaactatggtaaaaaactgactatccccagataaaaagtagaaagaatctatcagtgaaacttttatggaatgtgtatattaatcttaaagaattaaacgtttcttttgattcagtagattggaaacactctttttgtagaattcacaaagggacattgggagccctttaaggtctacgatgataaagcaaatatcccaaaatgaaaaacaaaaagaagctatctgtgatacagctctgggatgtgtggattcatctcacagagttaaacgtttcttttgattcagcaggttgaaaacactctttttgtaggatctgggaagggactgatggaactcattgaggcctacagtgaaaaaccaaatatctgcagataaaaaagagaaagaacctacctgtgaaactgttttttgttgagtggattcatctctctgacttaaatttgtcttttgattcaacaggttgcatacactcttattgtaaaatctgtgaagataaatttgtcatcccattgaggcctatggtgaaaaatcagtatccccagttagaaactagaaagaagctatctgtgaaactgctttgtgatgtgtggtttcacctcagagagttaaatgtttcttttcttcagcaggtttgaaatatcctttttgtagaatctatgaaaggacatttagagtgcattgaggcctatgataaaaaatcaaatattcctagataaaaagctagaaagaagctatctctaaaactgctttttttatgtgtgggttaatctcacataattaaacctttctttttatttagaaggtaggaaacaacttttttgtagaatctgtgaaatgacatttgggagacccttgaggcctgcagtggaaatccaaatatcccaagatgaaaacaagaaagatgtgatctgcgaaactgctttgtgatatgtggattcatcttacagaattaaacctttcttttgattcagcaggttggaaatactctatttatagagtctgtgaagaaacacttggagctgatggtggcctatggtgaaaactgaatatccccagataaaaactgcaaagaagctgtctgtgaaactgctttgtgatgtgtggactgatatcataaaatttaacctttcttttgatccagcaggttgaaagcactgtttatgtagtatccttgaaaagacattttggagatcattgaggcctagaaacaagaatgaagctatctgtgaaactgctttgtgatttgtggattcaccccatagagttacccctttcctttggctcagaaggttggaaacacaatttttgtagaatctatggagaagcatttgatagcacattgaagcctatggtgaaaaaccaaatatccccagataaaaactagaaagaatctgtgaaacagctttgtgatgtgtggactcatctcatagagttaagcctttcttttgattcagcaagttgaaacactctttttgcagaatctgcaaagggacatttggaagctcattgaagttatgattaaaaactgaatatccctggatgaaaagttgaaagaagctgtctctgaaactgctttgtgatgtgtggattcatctcacagaagtaaacctttcttttgattcagcagttcagtaacacttttttgtagcatctgccaaagtacgtttgggagtcccttgaggcctttagtgaaaaatcaaatatccttagatagaactagaaagaacatatctgtaaaactgctgcttgatgtgtggattcatctcaaagacttaaaccttcctttaggttcttcaggtaggaaacactgtttttgtacactattcgaagaaagatttgggggcccattgaatcctatgctgaaaaattgaatatcgcaagatcaaaacaaaaaagaagctatctggaaaactgctttgtgatgtgtggttttatctcaaagagttaaacctttcttttgattctgaaggttggcaactctctttttgtaaaatctgtgaaaggacatttgggagccaatggtggcctatagtaaaaaacagattattcccagatgaaaactagaaagatgctatctgtgaaactactttgtgatgtctggattcatcttacagagttaaacatttctattgattcagcaggtagggaacactctttttgtagaatatatgaaagtatatatggagtgctttgaggtctacggcaaaaaattgaatatccacagataaaaactggaaacaagccaactgtaacggctttgcaatgtgtgggttcatatcacagagtaaaaacttacttttgatcagcagtttggaaacactctttttgtagaatctgtgaagggacatttaaaaaaaccactggagtcctacggtgaaaaacagaatatccccagataaaaactagaaacaacctatgtgtgaaactgctttgtgacgtgaaggaatatttgggaggccattgagacctatggtgaaacaccaaatatcctcaaataaaaactagaaagaagctatctgtgaagctgctttgtgatgtgtgcatttatctcaaagacttaactttttttttgattcaacagtttggaaacactctttttatagaatatgtgaagggacatttgggagccccttgagacctaaggtgtaaaatcaaatatctgcagataaaaactggaaacaatttatctgtgaaactgctttgtgatgtgtggattcttttcacagagttaaaacttacttttgatcagcatgttggaaacaccctctttggagaatctgtgaagggacatttgagagcccattgaggcctatggagaaataccgaatatcaacagataaaaactagaaagaaacacctgtgaattgacattgtgatgtgtggattcatctcacagagttaaaccttactttttatcagcaggttgggaatactcttgttgtagaatctgcaaagtaacatttgggaactatttgaggtctatcgtggacaacagaatatcaacagataaaaaatgtaactaagctatctgtgaaacttctttgtgatgtgtgaattcatctcatagagtttaacctttctttgattcagcaggtcggaaacactctgtttgtagaatgtgtgaagggacatttaggagaccaatgggcccatatggtgaaaaactgaatatcctcagatgaaaactagaaaggagctatctctgaaactgcttttttatgcgtgattcacctcaaaaaggtacaactttttttgtttgtttcagcaggttaaaaacactgttttttaaaatcagcaagaagacatttgggagcccattgagacctataatgaaatgcaaaatattcacagataaaaactagaaagaagctctctgtgaaatggctttgtgatgtgtgcattcatgtcaaaatgttaaacctttcttctaattcagcatgttggaaacactcttcttgtaaaatttgcataaggatgtttgaaacccagttgaggcctatggtgaaaaacagaacatccctagacaaaaactagaaagaagctatctgtgaaactgctttgcaatgtgtggattcatctcacagagttaaaccttactttttatcagcaggttgcaaacatcctttttgtaaatcctgccaagaaacatttggagcccattgtggcctatggtaaaaaactgaatattccaagataaaaactagaaaaaagctatctatgaaaatgctttctgatgtgtgaacttatctcatggagttaaatctttctttagattcaggattttggaagaactctttttgtagaatctgagggtgcacaaacaggggacattgaggccaatggtgaaaaacagaatatcttctaataaaaactcgaaagaagctatctgtgaaactgctttgtgatgtatggattcatctaagacagctaaacctttcttttgattcacagcttgaaaacactctttttgtgaagtacgtgaagggacatttggagaccatttaggcttatgttgaaaaaccaaatatcttcagataaaaattaaaataagctatatctgaaattgcatggtgatgtgtggattcatctcatagagttaaacccttcttttgatcagcaagttggaaacactgtttttgtagaacatgtgatgggacatttgggagcccattaatgcctatggtcaaaaatggattatccccagataaaaactagaaagaagctatctgtaaaactgcttcatgatgtgttgattcatctcacagagttaaactgttcttttgatcagcaggtgggaaacagttttttcttagaatctgcaaagggatatttgggagcccactgaggcctagggtgaaaaatcgaataaaccacataaaaactagaaagactctatctgttaaactactttgtgatgtgtggattcctatcacagagttaaaccatttttttttgtttcatgaggttgaaaataatctttttgtaaaaaatgctaagggacatttgtgagcccattgaatcctatggtgaaaaaccgaatatcttcagatagaaactagaaagaagatgtctgtgaaacttctttgagatgtgtggatcatctcccagagttatatgtttcttttggttcagcaggatggaaacactctgtagaatttgcaaaaggacatttgggagcctattgaggcatacagtgaaaaacaaagtatctatggataaaaattagaaaggagctatctgtaaaactgctttgtgatgtgtggattcatctcacagagttaaacctttctattaattcagaaggttggaaacacactttttgtagaatctgagaagggatatgtggagcccaggaggcctatggtgaaaaacgaaatatacccagataaaaactagaaagaagctttctgagaaactgttctgtgatgtgtggattcatctcaaagagttaaacatttttttttgcttcagtaggttggaaacacgttttgtagtatgtgcaaagggacatttgggagctttttgatgtctatagtgaaaaaccaaatatcctcagatagaaactacataaaatctatctgtgaaaccagtttgtgacgtgtggatttatctgacagagttaaacctttcttttgattcagcaggttggaaataatctttttgtaaaatctgcaaagggacataaaagagtgcattgagatctatggtgaaaaacagaatatccccagataaaatctagaaagaagctatctgtgaaaccgatttgtgatgtgtgcattgatttcacagggttaaacctttcttttgattcagaaggtttgtggcactgtttttgtagattctgtgaagaaacatttaagagatatttgaagcctgtggtgaaacacagagtattccaaataaaaacttgaaagaagctatctgtgaaacttttttgtgatgtgtggattcatctaacagagttaaacctttctttgattcagcacattggaaatactctttttgtagaatctgtaaaaggatatttgggagcccattgaggcctatggtaaaaaacagaatatttccagataaaaactagaaaaaagctatctgtgtaactgctttgtgatgtttggattcatctcacagaattaaacatttctttttattcagcaggttgaaaactcttttgtacaatctgtgatgggacatttgagggcccattgacgcctatggtgaaaaactgaatatcctgataaaaactcaaaagaaactatctgtgaaactggtttgtgatgtgtagattcatcacacggagttaaacatttctttttattcagcagatgggaaacacttttttgtagaacctgtgaagggacatttgagagcccattgaggtatacagtgaaaaaccaagtatccccaaataaaaactagaaagaagccatctgtgaaactggtttgtgatgtatgcattcatctaactgaagtaaaccttgcttttgattcagcaggtggcaaacactttttcgtagaaactgtgaagggatatttgagtgcccatagagacctatgatcaacaactgaaatttcccagataaaaaaattgaaggaagctagatgtaaaactgctttgtgatctgtgggttaatctcattccttctgaaactattcgaaacaatagaaaaagagggaatcctccctaattcattttatgaggccagcatcatcctgataccaaagccaggcagagatgcaaacaaaacagagaattttagagcaatatccttgatgaacattgatgcaaaaatcccaataaaatactggcaaactgaatccagcagcacatcaaaaagcttatccaccatgatcaagtgggcttcatctctgggacgcaagcctggttcaatatacgcaaatcaataaacctaatccagcatataaacagaactaaagacaaaaaccccttgattatctcaatagaggcagaaaaggcctttggcaaaattcaacaatgcttcatgctaaaaactctcaataaattaggtattgatgggatgtatctcaaaataataagagctatctatgaaaaacccacagccaatatcatactgaatgggcaaaaactggaagcattccctttgaaaactggcacaagacaaggatgccctctgtcaccactcctattcaacatagtgttggaagttctggccaggacaattaggcaggagaaggaaataaagggtattcaattaggaaaagaggacgtcacattgtccctgtttgcagatgacatgattgtatatctggaaaaccccattgtctcaacccaaaatatccttaagctgataagcaacttcagcaatgtctcaggaaacaaaatcaatgtacacaaatcacaagcattcttatataccaacagacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaatattccatgctcatgggtaggaagaatcaatatcgtgaaaatggccataatgcccaaggtaatttacagattcaatgccatccccatcaagctaccaatgactttcttcacagaattggaaaaaactactttaaagttcatatggaaccaaaaaagagcccacatcaccaagtcaatcctaagccaaaagaacaaagctggaggcatcatgctacctgacttcaaactatactacaaggctacagtaaccaaaacagcatggtactggtaccaaaacagagatatagatcaatgggacagaacagagccctcagaaacaatgccacatatctacaactatctgatctttgacaaacctgagaaaaacaagcaatgggaaaaggattccctatttaatatatggtgctgggaaaactggctagccatatgtagaaaactgaaactggatcccttccttacaccttataccaaaattaattcaagatggattaaagatttaaacgttagacctaaaaccataaaaaccctagaagaaaacctaggcaataccattcaggacgtaggcatggacaaggacttcatgtctaaaacaccaaaagcaatggcaacaaaagccaaaattgacaaatgggatctaattaaactaaagagattctgtgcagcaaaagaaactaccatcagagtgaacaggcaacctacaaaatgggagaaaattttcgcaacctagtcatctgacaaagggttaatatcaagaatctacaatgaactcaaacaaatttacaagaaaaaaaaaacaaccccatcaaaaagtgggcaaaggatatgaacaggcacttctgaaaagaagacatttatgcagccaaaaaacacatgaaaaaatgctcaccatcactggccatcagggaaatgcaaatcaaaatcacaatgagataccaaatcacaccagttagaatggcaatcattaaaaagtcaggaaacaacaggtgctggagaggatgtggagaaataggaacacttttacactgttggtgggactgtaaactaattcaaccatggtggaagtcagtgtggcgattcctcaaggatctagagctagaaataacatttgacccagccatcccattactgagtatatacccaagggactataaatcatgctgctataaagaaacatgcacacgtacgtttattgaagcactattcacaatagcaaagacttggaaccaagccaaatgtccaacaatgatagactggattaagaaactgtggcacatatacaccatggaatgctatgcagccataaaaaatgatgagtttatgtcctttatagggacatggatgaagttggaaatcatcattctcagtaaactatcataagaacaaaaaaccaaacactgcatattctcactcataggtgggaattgaacaatgggaacacatggacacaggaaggggaacatcacactctggggactgttgtggggtggggtcaggggggagggatagctttagaagatatacctaatgctaaatgacgagttaatgtgtgcagcacaccagcatggcacatgtatacatatgtaactaacctgcacattgtgcacgtgtaccctaaaacttaaaatataataataaaaaaaaaatctcacagagttaaacctttcctttgatgcaaccggttggaaacactctttttgtagaatatgcaaagggacatttgggagcttagtgagacctatggtgaaaaaatgaaatgtcatcagacaaaactcagaagaagctatctgtaaaactgcttactgatgtatggattcatctcacagagttaaaagtttccttttactaagatggttggaaacatgctttttgtagaatattcaaagggacttttgtgagcccattgaaatccacggcataaaacaaaatatccccagataaaaactagaaagaagctgtctgtgaaactgctttgtgatgtgggaattcatctcaaacagttaaactttttttttgattcagcacattagaaacactcttgttttagaatcagagaagaaataattaagagccctttgaggcctctgttgaaaaaggaattatctccagataaaaattcgaaagatgctatcatcaaagctgctttgtgatgtgtggattcacctcactgatttaaaccttgcttttgattcattaggttggaaaccttttttgttgaacctgagaagaaacatttgggagcctattgaagcttttgggaaaaaacagaatatcttcagataaaaaccagaaagaagttatacattacattaaactgctttttcatgtatgcatttatctcatagagttaaaccttgcttttgattcagcaggttggcaacactctttttgtagaatctgtgaagggatatttgggagcccattgaggcctatggtgaaagacagaatattcccagataaaaactagaagggagctatctgttaaaatgctttttgatgcatggattcatctcacagagttaaaacgtttttttatttagcagtttggaaacactctttttgtagaaactgcaaagggacatttgggagccaagtgaggcctatgctgaaaaacagaatatccccagataaatagtagaaagcagatatctgggaaaatcctttgtgatgtgtggattcattccaaagagtttaacctatcctttgagtcagcaggttggaaacacctttttgtggaatctgtgaaaggacatttgggaacccattaaagtctatggttaaaaacataatatcccctgataaaaatgggaaggaagctacctgtaaaacttctttgtgatgtgtggattcatctcacagtgtgatacatttctgttgactcagtaaggtggaaacactctttctttagaatctgtgaagttacatttgaaagcctatggtggcctaaggtgaaaaacagattatccccagataatatctaaaagtaagctatctgtcaaactactttgtgatgtgtggattcatctcacagagtgaaaccatacttttgattcaacaggttagaaaccctcttcttatagaatctgtgaaaggacttcaggaccccattgaggcctatgctgtggcctatggtcaaaaacagaatatccccagataaaaactagaaagaatctatctgttatacttctttgtgatgtgtggattcatctcacagtgttaaattgttcttttgcttcaggaggttgaaaacactcattttcttagaaaatgcaaagagacatttgtgaatccattgaggtctatggtgaaagacaaaatattcatgaacgaaaactagaaaggagatatctgtaaaactgctttgtgatgtttggattcatctcacagagtttaactttccttttgattcagcaggttggaaacactctttttgtagaatctgcaaagggacatgtgaagcccattgaaacctatggtaacaaatggaatatccccagacaaaaatgagaaagaagctatctgtgaaactgctctgtgatgtgtagattcatctcacagacggaaacgtttcctttgattccacagtttggaaacacgttttgtagtatctgtgaagggacatttgaaagactattgaggtctaaagtggaaaacctaaaatacccagacaaaaactagaaagaatctatatgtgaaaccggtttgctatgtgtggcttcatcacacagaggtaaatctttcttttgattcagcagattggaatcactctttttgtagaatctatgaaggaacatttgggagcccattgagacctttgatgaaatactgaatatctgcagataaaaactagaaagaagctgtctgtgaaattcctttgtgatgtgtggttttatctcacagggttaaacctttcttttgatataggaggttggtaacactgtttttttagattgtgagaagaaacacttgggagcccattgacgcctatggtgaaaaacagaatattcccagataacaacgaggaataagctatctgtgaaactcctttgtgatatatggattcatctcacaaagttaaatttttctttgattcagcaggttggaaacactctttatgtagaatctacctatggacatttgggagcccattgaggcctatggtaaaaatcagaatatccccagataaaaactagaaaaaagctttctgtgaaactgctttatgatgcatagattcatcttacagggataaacctttcttttgattaagcaggttggaaaccttctctttgtagaatctgtgaagggacatgttggtgccatttatgcctatggtgaaaaactgagtatcttcagataaaaactagaaagaagctggctctgaaacttgtttgtgatgtgtgcattcatgtgacagagttaaacctagcttttcattcagcagttggaaaacccttctttgtagaatctacaaagggacatttgagagcccattgaggcctatagtgaagaacttaatgtccccagataaaaaaaaatattgaaggaaactatctgtgaaactgctttgtcatgtgtggattcatctcacagaggtaaaacattcctttcatccagcaggttggaaacacaccttttgtagaatctgcaaagaggcattttggagccctttgagacctatggcaaaaaaccgaatatactcagataaaactagaaagaagctgtctgtgaaactgcttactgatggatggattcatctcagagagttgaaccttttgttttactgagaaggttggaaaaactttttcgtacaatatttgaagggacaattttgaggccatagaggcctatggtaaaaaactaaatatccccatataaaaaatagaaagagtctatctgctttgtgatgtcaggattcctctcaaataattaaatttttcttttcattcagcacattggaaacactctttttgtagaattggcaacaggacaattaagagtccattgaggcctctggtgaaaaagtgaatatccggagataaaaattagaaagaagctatcttttaactgctttgtgatgtgtggattcatctcacagagttaaatcttgcttttgattcatcaggttggaaacagtttttttatagaatctgtgtagggacatatgggagcccagtgaaacctatgggaaaaaacgaatatcttcagatagaaaactagaaagatgctatctgtgaaactgctttgtgatgtgtacagttatctcaaggagttaaaactttctttggattcagcaggttggatacactgtttttgtagagtcttcaaaaagacatttgggggcccactgaggcctaaggtgaaaactagaaataaagtatctgtgaaactgctttgtgatgctttgatacatctcacagagttaaaccttatatttgatcaacaggttgaaaacactctttttgaagtatttgcaaagggacattttaaagcccattgaggcctatgttgaaacattatatccccagataaaaactaaaaagaagctatctgtgaaactgctctgttatatgtgcattcttcccacagaggtaaacctatcttttgattcataaggtcgaaatcaccctttttgtagaatttgcatagggacatcttggtgcccatagaggctttggttaaaatcagagtatctccagataaaaactagaaagaaactatcacagaaagtgctctgtggtgagcagattcatctcacagtgttaaacctttcttttgactgagcaggttggataaactttttctgtagaatctgagagggaatatttggcagcccattgaggctcatggtcacaaaaaatccccagataaaaaggagacaaagatatctgtgaaactgctttgtgatgtatggatttatctcacagaattgaatctttcctttgattcagcaggtgggaaacactctttttgtagaatctatgaaggttatgtgggaggccttttaggcctttggttaaaaccaaatatcccccaataaaaactagaaagacactatctgtaaaactgccttttgatctttggattcatctcacaaatttaaaactttctttcaattcagaaggttgtacactcttttgtagaatctgtgaagaaacatttggaagacagtgaggcatattgtgagaaaacaaatattgccagataaaaattacaaaggagctatctgtgaaattgttttgcaatgtgttgattcatctcacagacttaaataatttttgattcagcaagtttttaacactctttatgtagaatctgtgaaggaacatttgaaagccctttgagtcctatggtgaaaaacagaatatccccagataaaaactagaaagaaggtatcaatgaaactactttgtgatgtgtggattcatctcacagagttaaaccattattttgattcagcaggttggaaacacttttttttgaaaaatctgtgaatgcatattttggagactattgaagcctagggtgaaaaatcaaatatccccagggaaaaactagaaagcagcaatctgtaaaacaactttcttgtgatgtgtgaattcatctcacagatttaaacttttcttttcattcagcaggttggaaacaatctttttgaagattctgtgacaatttgggagctcatactggcttatagtgaaaaacagattaccccacataaaacaagaaagaagctatctctgaaactgctttctggtttgtggactcaactcacagatttaaaacatcccttttactaagcagattggaagcactctttttgtagaatctacatagagacatttgggagcccattgtggcctttagagaaatactgaatatccccagataaaaactacaatgaagctatcagtgaaactgctttgtgatttgtggattcatctcatggtgttaaacattactttgaattcagcacattggaaatactctttctgtagaatctgcaaaagaacatttggagcccatggtggcttactgtgagaaactgaatatccccaggtaaaaactagaaagaagttatctgtttaactgctttgggatatgtggattcatctcacagatgtaaaactttcttttgactcagcatactggaaacactctattcctagatgttgcaaagtgacatttgagagtccattgaggactgtattgaaaatttaaataactgtagataaaagctacaaagaagatatctgtgaaacttgtatgttatgcgtggattcatctcacatacttaaaactttcttctgattcagcacattggaaacacgctattttttgaacctttaaagaaacatttgggagcacatggaaacactctattttttgaatctttaaaggaatatttgggagcacactgaggcctatggtgaaaaaccgaaaatttcctgatcaaaactagaaaaaagctatctgtgaaacagtttcgtatcgtgtggagtcatctcctagagttaaacctttgttttgattcagtaggttataaataccctctttgtagaatctgtgaagtgacatttggagcccattgaggcctacctatgatgaaaaacagaatatccaaagataaaaactagaaagaagcaatatgtgtaactgctttgtgatgtgtggattcatctcacagagttgaaactttcttttgattcaccaggcttgagacactctttttgtaaaatctgtgaaaatatattttggagcccatagaggcctatggtaaaaattggaacatcttcagataaaaactagaaagaacctatcggtataactgctttgtgatgtgtggattcatctcaaatagttcaacctttcttttgattcagcagattggaaacactctttttgagattctacgtagggacacttgggaacccattgaggcctatggtgaaaaacctattatcccaaaataaaaaccagaaagaagctatttgtgaaagtgctatgtaatgttttgattcattgtacagagttaaacttctcatttggcttctcttttgattcagcaagttggagacaattttttgaaaacattctgtcaagggacatattggagcccattgatgactttgatgaaaaactgaatatctccagataaaaactggaaagaaactatctgtaaaactgctttgtgatgtgtggattcatcccacagagttaaagttttctgttgattcagcaggttgggaagactccttttgtagaatctgtaaagggagattttggagcccatgaagacctacagtgaaaaacagaacatccccaggtaataatagaaaaatgttatctgtgaaactgtcttgtgctgtgtagattcatctcagagagttaaacattggttttgaatcagcaagttgtaaacactgtttttgcagtatgtgcaaagggacatttgggaaaacattgatgcctatgttgaaaaaagggaggttcacagaaaaaactacaaataagctatctgtgaaatagctttgttttgagtttattcatttcactgagttaaagctttgtttagattcagcaagttggaaacaccatttttgtagaatctgtgaagggacatttgaaagcccattgaaacctatggtgaaaaatcgaatatcttcagttaaaaactagaaagaaactatttgtgaaactgctttgtgaggtatgggttcatctgagttaaccctttctttagattcagcaagtcagaaaaccctctttttgtagaatctatgaagggacatttggtacctcattgaggtccctcgtgaaaaaagacatatgcagaaaaactagaaagaagctatctgtgaaactgcattttgatctgtggattcatctcccagggaaaacactttcttttgattcggcacatttgaaacagtcactttgtagaacctgtgaagggacatttgggagcccaatgaaacctattgtgaaaaacagaacctccccaaatgaaaactagaaagaagccatcagaaaaactggtttgcattgtgtgcattcgtctcacagagttgaaacattttttttgattcagcaggttggaaacactcttttttgtagaatctgtgaaggaatatttgggagcccatttagacctatgttgaaaaaccaaacatccccagagtaaaactagaaagaagctatacttgaaactgctttttgatgtgtgagttcatctcacagatttaaacctttctttaaattaagcaggttggaaacactattttaaagatatctttaaagggacatttgggagcccattgaggcctagggtgaaaaaaaaatccccagttaaaaactagaaaaaaagctatctgtgaaactgccttgtgatgtgtggattcatccaatagagttaaaagtttcaatgattcagcagattggaaacactctttttgtagaatctgcaaagaaacattttggggcccattgaggcctatggtaaaacatcaaacatacccaaataaaaagtagaaagaaactatctatgaaactgctttgtgatgtttaaattcatctcaaagagttacatcttttttttgattcagtagatgggaaacactctttctgtagaatctgcaaacggatatttgagagctcattgagacctgaggtaaaaaactaaacatccccagataaaaactagaaaaaagcaatctgtgaaactgctttgtgatctgtggattcatctgacacagtttaaattttctattgattcagcatattggaaatcctcttcttgtagaatctttgaagggacatttttgagcacattgaagcctatggtgaaaacccgaacatccccagataaaaactagagagaatgtatctgtgaaactgatttttgatgtgtggattcatctcacaaagctaaacctttcttttgattgagcaggttagaaaccctctttttgtataatctatgatgggatattttggagaccattgaggcctatcgtgaaaaactgaatatccacagacaaaacctagaaagaaggtgtctatgaaatttattgggatgtgtgtattcatctcacagagttaaaagtttcttttgattcagcaggttggaaacagttttttgtagaatctgtgaagggacattttggagcccaatttagcctattttaaaaaaccgaacaccctcagttaaaaactataaagaaactatgtgtgaaactggtttgtcatgtttgcattcatgtcacagagttgaaatattcttttgattcagaagtatggaacactctttttgtagaatctgcatagagatatttgggagcccattgaggtctatggtgaaaaacagaacatcaaagattaaaactgaaaagacactatctttgaaactgctttgtgatgtgtgggatcatctcccatatcaaaaacattcttttgattgaacatgttggaaactccctttttgtagaatctttgatcagacatttgggaactaattgaggtatatggtgaaaaactgaatattcccagataaaaactagaaagaaactctctgtgaaactgcttcatgatgtgtagattcatctcaaaaagttaagcctatcttttgattcagtaggttggaaaaactctttttgtagaatctgagaggggatatttgggagcccattcaggcatatggtgaaaaattgagtaccctccagataaaaactagaaactatctgtgacactgttttgtgatgtgtggagttatctcacagagttatatgtttctttggactcagcagtttgaaaacactctttttatagaatctgcaaggttacattttagagcccattgaggcctttggtgaaaacggactatcccaagatgaaaactagaaagaagctctctgtgaaactgctttgttttgtgtaatcatctaacagagttaaacctttaaacctctgttttgattaaggaggttggaaacacacttttttggagtgtgtacactccagggaacaatttgtagcccattgaagcctattgtgaaaaacctattatcctcagacaaaaactggaaataagctaactgtgaaactgctttgtgatgtgtggattcatttcacaaagttaaaccttacttttgatcagcaggttggaaacactttttgtagaacctgtgaaaggacatttgggagcagttggggcccatggtgaaacaccgaacatccccagataaaaaatggaaagaagtgatctgtgaaacttattgtgatgtgtggattcatctcacagaggtaaaccatacttttgatacagcaggttggaaacatttttttttttgtagaatatgcaatggaacatttgtgagcccattgaagcatatattgaaaaaccaaatatcaacttataaaaccagaagaaaccatctgggaagccgatttttgatgtgtgaaatttcatctcatggagttaaacttttcttttgatttggcaatttggacaaactctttttgtagattctgtgaagaaacatttggcagcccattcaggtctatggtaaaaaagcaaatatcaccagataaaaactggaaaggagctgtctgtgaaactgcttggtgatgtgtggattcatctcactgagttaaactgttcttttgatcagcaggttggaaaatagtcattctgaagaatctttgatggaacaatttggtgctcattgagtcctacactgaaaaaccaaatacccatgaatgaaaactagaaaggggctgtctgtaaaactgctttgtgatgtgtggatttatctcacggagttaaacccttcttttgattcagcagattgaaaacacagcttttgtaaaatctgtgatggtacaagtggagcccatttaagcctattttgaaaaaaggaatatcctcagataaaaactagaaagaagctatctatgaaactggtttgtgatgtgtggacccatttcatagatttaaacctttcttttgattcaacagtttagaaaaacttgttatagaatctgcaaagggatatttggcagcttattgaaacccatggtgaaaaactgaaattcccctagaaagaagtgctctgtgaaatggttctgtcatgtgtggttacaactcacagaattaaaccgttcttttgactcaacaggttgaaaacactctttttgtagaatctgctaaggggcatttaggaggccaaaaaggcttatggtgaaaaaccaaatattttcttataaaaactagaaagaaggtatctgtgaaacagttttctgatatgtgaaatcatctcatggagttaaacttttctttggactcatcagcttggagacactctttttgtagagtatgtgaagggacattttggtgcccattgagtcctatggtgaaaaacagaatatccccagataaaaactagaaaaatctagctgaaaacttgtttgtgatgtgtagattcatctcacagagataaatcttggattttattcagcaagttggaaacactctttgtgtaaaatctgggaagttacattaggcagcccactgagacctaaggtgaaaaacagaatatccatagattaaaaactagaaagaagcgatctgtgaaactgctttttgatgaatggattcatctcacaaaattaaaactttcttttgactcagcaggttggtaacactttttttgtagattctgtgaggaaacatttgggagccctttaaggcctataatgaaagaccgaatatccccagaggaaaactggaaggaagctatctgtgaaactgctttgtgatgtacggaatcatcccacagttaaacctttattttgattcagccagttttaaacactttttgtgtaaaccgtgaagggacatttgggagcccattgaggcctatggtgaaactttgaatatcccctgataaatactagaaaaaagcaatttgtgaaactgctttgtgatgtgtggatttatctcacagagtcaaacgttttttttggtacagcagtttggaaacactctttgtgaagaatctgcaaagggaaatttggggtcccattgaggcctaaggagaaaaaccaaatattcccagacaaaaactagaaagaagctatgtgtgaaagtgctgcatgatgtgtggattaatcttacacagctaaagttttcttttgattcagcaggtttgaaaaacttcttttgtagaatctgtgaagggacagttaagatccctttgaagcctagagtgaaaaacagaacatcccagataaaaagtagaaagaagccatctgtgtaacttgtttgtgatgtgtgaattcatctcacagagttaaaactttgttttgattcagcaggttagaaattatcttttggtagaatctgcaaaggggcaatttgtagccaattgaggcctatggtgaaaaacggaataccccaagataaaaactagcaggaagctatctatgaaactgctttgcaatgtgtggattcacctcacacagttaaatctctcttttcattgagcaggtcagaaactctttttgtagaatctgtgaagacacatttggaatcccattatggcctatggggaaaaacagaatatccccagagaaaaagaagaaagaagctatctgtgaaactgctttgtgatgtgtggattcatatcacagggttaaaactttctgttgactcagcaggtgaaaaacagtctttttgtaacttctgtcttaggacatttgggagccccttgatgcctgtagtgaaacattgaatatccctagataaaaactggaaagaagttatctgtgaaactgctttgtgatgtgtggattcatctcacgtggataaacctttcttttgactcagcaggttggaaacactcttttaatagaatctgtgaaaagacatttggaacccaatgaggcttatgaggaatgaaaaactgaatatccccagatagaaactagaaagaagttatctgtgaaactggattttgtagggtggacttatctcacagagttaagcctttgtcttgactcagcaggttggaaacactctttttgtagcatctgagaagccacatttgagagcccatttttgcctactgtgaaaatccaaatgatcccagataaaaactagaaagaagctatctgtggaacagttttatgaagtgtggattcatctcacacagttaacacattcttttgattcagcaggctggaaacagtcttttgtggaatctgtggatggacatttgaaatccctttgagacctgtagagaaaacggaatactctcagagaaaaagtagaaagaagctatatgtgaaactgctttgttttacgttgattcatttcaaagagataaacctttctttttattcagaagttggaaacagtctttttgtagggtccgcaaggagacattttggagcccattgaggcttgtagtgaaaaatcaaatatccccagataaaagctagaaagacgctgtctgtgaaacgactttgtgatgtgtggattcatctcacagagttaaacctttcttttgattcagctggttggaaacacttctttttttagaatctgcaaaaggatatttgggagcccactgaagcccttgttgaaaaactgaatattgccaaatgaaaattagaaagaaactatctacaaaactcgtttgtgttgtgttggttcaccacactgagttaactctttctcttgattaacatgttggaaacactctttttttagaatctgcaaagggacattgcagagcccattgaagcctgcagtgaaaaacgaaatatccccagataaaaactagaaagaggaaatctgtaaaattgctttgtgatgtgtggattcatctcacagagttaaactttacttttgatcagcatgttggaaacagtctttctgaagaatctgcaaagagacatttgggagcccattgtggcctttggtgaaaaacagaatatccccagaaaaaaagtagaaaaaactatctgtgaaactgctttgtgatatgtggattcatctcacagagttaaactttaattcagcagtttctaaactctgcttttgtagaatatttgaaaaggcatttgggagcccattgaggcataaggtgaaaaatatcccaagacaaaaaaagaaagaaatatctgtaaaactgctttgtgatgtgtggattcatctcagagagttatatattacttttgactcagcaggctggaaacactctttaagcactctttttgtagaatctgtgaagggacatttgggagaacattgtagcctatggtgaaaaactgaatatcctagataaaaacaagaaagaatttctccatgaaagtactttctgatgtgtgcagtcatctcacagaggtaagcttaaattttctttctgcagaccggtaacacgtctttgtaggatctgcgaagggacattgtttaggccattgagacctgtggtggaaaacagaatatccccaactataaactagaaagaagctaatagtgaaattccttcatgatgtttggattcatctcacaaagataatcctttcttttcattcattcgcttttaagctctctttttgtaggatatgttaagggacattttagagcttattgaggcctatagtaaaaaacaaaatatcctcaaataaaaactagaaagaagctatgtgtgaaagtgcttgatgatgtgtgcattcatctcagagagttaaacctttttttttattcagtgggttggaaacactctttttgtaaaacctgcaacagtatatctgggagagcattgaggcctaaggtgaaaaactgaatatacaaagataaaaactagaaggaagttatctgtgaaactgattttttgaagtttggattcatctcatgaaattaaacctttcatttggttcagcaggttggaaacactctctttatagaaactactaagggacatttgaaagcctattgaggcctatggtgaaaaatagaatatctccagataaaaacgagaaagaagttatctgtgaatctgctttgtgatgtgtgcattcatctcatagcgataaaagtttcttttgatttgactggttggaaacactcttttcatagaatctgggaagaaacatttttgggccccttaaggactatggtgaaaaatcaaatatccccaggtaaaacaaaaaagcagttatctttgaaagtcctttgtgatgtgtggattcatctcacagagttaagtctttcttttgatttagcagttaggaaacactttttttgtagaatctgcaaagtgacatttgggagcccattgaggactatggtgagaaaccaaatatccacagattaaaacgagtaagaagctgtctgcgaatgtgcattgtgatgtctggattcatcacacagggatacaactttcttaaatgcagtaggttttatgcactctttttttagagtctgcgtagggacagttgggaaccctttgaagactgtggtgaaaaaacatatattcccagataaaaactagaagcaagctatctacaaaactgctttgtgatttgtagattcatcttacagtgttaaacctttcttttgaatctgtacattggaaaaactttctttgtagaagctgcaaagagacatttaaggggcaattgaggcctatggtgaaaaactaattatccccagaaaaaaaaaagaaaaaagttatctgtgaaactgctttgtaatgtatggattcaagtcacaaggttaaacagatcttttgattcagctggttacaaacactctttttgtagaatctgtgaagagacatttggtagtgcattgaggcctatggtaaaaaaaaagattatccccctaaagaaaacagaaaaaagctatttgtgaaactgcttattgaggtgtagattcatctcacagagttaaacctttcttctgattcagaagattggaaacactctttttgtggaatttgtgaggggacatttgagagcccgtggaggcctagggtaaaaaattgaatatcccaagataaaaacgagaaagaatctatctgtgaaagtgctttgtaatgtgtggattcatctcccagggttaaacatttcttttgattcagcatgttggagacactcttttgtagaaactgcaaagggaaatttgagagcccattgagtcctatggtgaaaaactgaatatcccaacataaaaactagaaagaagatagctaagatagtgctttgtaatgtgtggatttatcccactgagataaacctttcttttgattcagtgtgttttaagcactctttttgtagcatgtgcaaagggacatttgaaagctgattgggtcatataatgaaaaacagaatatgcccaaataaaaactagaaagaaactgtctgtgacactgctttgtgatgggtggattcatttcacagagttaaaactttcgtcttattcagctgtttggaaacgctccttttgtagaatgtgttaaaggacatttgagagcccatggaggcctaaggtgaaaaactgagtatacccaaatgaaaaccctctgtgaatcttctttgtgatgtgtgtattcatctcagagggttacacctttcttttgattcagcaggttggaaacactctttttgtataatctgcaaagggacatttgggagctgattgaggcctagtataaaaaactgtatatgcctagataaaaactagaaagaagctatcagtgaacctgcttaatgatgtgtggattcatctaacagcgctaaaagtttattttggttaagtaggttggaaaaactttttgtagaatctgtgaagagaaatttaaaagccctttgagggctatggtgaaaaactgaatatcctgagataaaaacaagaaagaagctatctgtgaaactgcttttggatgtgtggattcatccaaaagagttaaacacttcttcgtgttcagcacgttggaaacacacttcttggagaatctacaaatggacatttctaagaccattgtagcctaaggtgaaaaaccgagtatcttcagataaaaactagatataaggtatctgtgaaactactttgtcatgtgtggattcatttcacagagttaaagctttcttttgattcagcaggaagaaaacacactttttgtagaatctgcaaagggacatttggaagcccattgaggcctacgatgagaaacacattatccagaggtaaaactggaaagaagttatctgtgaaactgcttttgatgtgtggatacatctcacagagttcaatgtttcttttgaatcaggaagttggaaacactctttttccagaatcttcaaagaaacacttgggagcccatagaggcatagggtgaaaaatcgaatatcccagtatgcaaactagaaagaagctatctgcgagactgcttttgatgtgcagatacatatcacagagttaaacctttacttttgattcagcaggttggaaacattctttttgtagaatctgcaaaaagacatttcagaacctattgaaggctatggtgaaaaacagaatatccacaggtaaaaattggaaagaaactatctgtaaaagtgctttgtgatgtgtggattcatctcagagttaaacgtttgttttgattcagcaggttggaagctcttcttttgtagaatctgcgaagggaaatttggcaacccagagagtcttgtggtgaacaatagaatatacccaaataaaaattagaaagaagctatctgtgaatctgctttgtgatgtgtggattcatctcacagggttaaacatttcttttgattcactagtttggaaatcctctttttgtagaatctgtgaagggacatttgggagcacattgaggcctaaggtacaaaaccaagtatcccagtatacaaagtagaaaaaagctatctgttaaactgatttctgatttgtggattcatttcatagagttaaattttttttttatttaacatgttggaagctgtctttttatggaatctgcaataagacatttggaagctatttgaggcctaccataaaaaccagatatccccagataaaaactagaaacaagctatcatttaaactgttttgtgatgtgtcatttcatctcacagagttaaaacctttcttttgatttggcaagttggaaacacttttgttgtggaatgtgagaagagacattttgaagcccattgaggctgataatgaaaagcagaaaatctccatataaaaacttgaaagacactatctgtgaaactgctttgtgatgtgtggattcaagttacagatttaaaaccgtcttttgattcagctggttggaaacactcttatgtagaatctgtgaagagacattttggggccctttgaggcctatggtgaaaaccagaatatcctcagataattactagaaagaatctatctgtgaaaatgctttgctatgtgtatattcatctcaaagagttaaaactttcttttgattcagtatgttggaatactttttttgtagaatctgtgaaggaaaattttggagcttattaagtcctatggtgaaaaacggaatattcccagataaaaactagaaagaagctatctgtgaaactgctttgtgatgtgtggactcatctcacagagtaaaacctttcttttgattcagcagtttggaaatactctttttgtagaatctccaaagggacatttgagagcccatgatggtctaccataaaaatctgaggatcctcagataaaaactagaaagaagctatctgtgacactgcttgtgatgtgtggattcatcacaaagagttaaaagtttttttgattcagcaggttggaatcactctttttgtagaaactgtgaagagacatttgagagccctttgaggcacacgctgaaaaaccaattatccaaagataaaaactagaaagaaactatttgtgaaactgcttggtgatgtgtctattcatctcaaaatttaaacatatattttgattcagcaggtttgaaacactgttttgttagaatccgtgaagggatattagagagcccatttaggcatatagtgaaaaaccaaatatcctcacataaaaactagaaagaaactttctgtgaaattgctttgtgatgtgtggattcatctcagagagtttaaccttttttgattcagcagtttggaaacacttctattgtagaatctgtgaagagacattttggagttcatttaggcctatggtaaaaaacaaatatcaccagaaaaaagaactagaaataagctatcggtgaaactgccctgtaattagtggatttgtctcatggagtaaaacttttcacttgattcagtagtttggaaacaccctttttgtagaatatccaaaggaacattttggagcccactgaggtttatgttgaaaaacctaatatccccagataaaaactataaagaagcaaactgtgaagctgctttgtggtgtgtgaattcatctcacagttaaacttttcttttgattcagcatgttggaaacaccctttttgtagaaagtctgaagagacattagggagccctttgatgcctatgttgaaaaaccgattatccaaagataaaaaggagagataagctatgctttgtgatacgtagattcatctcagaaagttaaacctttcttttgatttagcacgtttgaaacactctttttgtaaaatgtgcaaagggacattttggagtccattgaggcctatggtgaaaaacagaatatccctacatgaaaactagaaagaagctatatgtgaaagtgctttgtgatgtgtgcattcatctcacacagttaaaccttgcttttgattcagtaggttggaaacacaccttttgtggaatccatgaagggacatttgtgaactgttggactatggtgaaaaaatgattattcccagataaaaactagaaagaagctacctggtaaactgctttgtgatgtgtagattcatcacacagagatgaacctttcctttgattcagcaggttggaaacacttcttttgtagaatctatgaagggatctttgggagtttattgaggcctatagtgaaaaacagaatatcaccacataaaagctagaaagaagctctctgtcaaattgctttgtgatgtgtggattcatttcatagagttaaacctttgttttcattcagcagtttgaaaacactctttttgtagaagctgcaaaggaacatttgggagcctattgaaatctttggtgaaaaaccgaatattcccagataaaaactagaaggaagctatctatgaagtgctttgtgatgtgtggattcatctcacagtgttaaacctttcttttgactcaacaggtggtaacactcttttgtgaaaatctgcaaaaagacattttggagcactttgagccttatggagaaaaacagagaatccacagataaaaactagaaagaagctgtttgtgaaagtgttttgtgatgtgtggattcatttcacagagttaaaccattcttttgattcggaatgttggaaacactctttttgtagaatctgtgaggggacatttaagagcattcaggactacaatgaaaaactaaatatccccagaaaaactagaaagatgctatttgtgaaagtgctttgtgattggtggatttatctctctgttaaacattttttttattcagcaggtgggaaactgtctttttgtagaatctccagggggacatttttgagcccattgtggactatggtgaaaaactgaatatttcaagataaaaactagaaagaaactatctgtgaaactgctttgtgatttgtggatttgtatcacagagttaaacctttcttttgatacagtaggttggaaacactctttttgtagactctgtgaacagacacttgagagcccattgaggcctatggtgaaaaacaaattgtccctagataaatactagaaagaacctacctgtaaaattgccttctgatgtgtggattcatctcaaagggttaaactttacttttgactcaccaggtggtagcactctttttttttggaatctgcgaagggtcattttggagcccttttgagccctatgttgaaaaacagaaagtcctcagataaaacctagagagaaacttcctgtgaaactgctttttgatatattgattcatcacacagagataaaactttcttttgattcagcaggttggtaacacttctcttgtagaatctgtgaataaacaatttggagcccatttatgcttatggtgaatgaccatttattgccagataaaaagtagaaagaagctatctgtaaaactgctttgtaaggtgtagatttatctcacagagttaaacttttcttttccatcagcaggttgaaaacacagcttttgtagaaactgcaaagggacatttggaatcccactgagtcctatgggtggaaaattgtaaatcaccccataaaatctagaaagaagctttttgtgaaactgctttgtgatgtttggattcaggtcacagagttaaacctttgttttgattcagcaggttgtaaacactcttttagagaatctgcaaagcaacatttttaacccattgaaacctatggtgaaaaactgaacgtccccagataaaaactagaaagaaactacctgagaaactgcttgtgatgtgtggatttttctcacaaagttaaacctttcttttgattcagcatgttggaaacactttttttgtagaatctgcaaagggacattttggtggccattgaggcctatggtgaaaaacagaataaccccagataaaaatgagaaagaagcaatctgtgaaactgctttgtgatgtttggatttatctcacagcattgaacctatcttttgattcagcaggttggaaacacctttttgtagaatctgtaaagggacatttgggattccattgatgcctaaggtgaaaaaccgaatgtccccagagaaaaacatgaaagaagctgtctgagaatctgctttgtgacgtgtagactcctctcacagagtcacccctttctttcaattcagcagtttggaaacactctttttgtagactctgcaaacggtaattttggaacccgagtttgcctatggccaaacaccaaatattcccagataaaaactagaaagaagctctttgtaaaactgctttgtgatgtgtagattcatctcaaaaagttaaaccctccttttcattcagcaggttaaaaacactatttttgtagaatctgcaaagaaacatagtgggcttattgaggcctgtgttgcaaaactgaatatccccagagaaaaacaagaaagaagctacttgtgaaactgccctgtgaagtgtagatgaatctcacagagttaatcctttcttttaattcagcaggtttgaaacaccctggttgtagattctgcaaagagttatttgagagcattttgaggcctatgataaaaaaccgaatatccctagatgaaaactagaagaaagctctttgaaaaactgctatgttttgtgtagattcatctgaaagagttaaacatttcttttctttcagcaggttggaaacactctttttgtagaatctgcaagggacatttgggcacctgttgatgagtatggtgaaaaaccatatgtccccaaataaaaactagaaagaagctatttgtgaaactgctttgggttgtgttgatttatctaacagacttgaacctttcttttgattcagcaggttggaaacattctttttgtggaatcagcaaagagacatttgggagcccattgtggcctatggtgaaaaaaaaaagaatatccccagataaaaactagaaagaagctatctgtgaaattcctttgtaatgagtagatttatcttacagagttaaacttatgttttgattcatcaggttggaaacactctttttgtagaatctgcacagggacttctggagaccatttaaacctatggtgaaaaccgtatatacccagattaaaagtaaaaagaagttatatgtgaaacttctttgtgatatgtgggttcatctcaaggtgttaaacatttcttttgattcagctggttggaaaccctctttttgtagaatctgcaaagggacacattaaccccccttgagaactatggtgaaaaacagaatatcctcagataaaaactagaaagaagccatctgtgaaactgctttgtgataagtggattcatctcacagagttaagcctttctgttgattcagcagtttggaaactgtttgtgtagcatctgcaaagggacttttggaagccaaatgaggccaatggtgaaaaaaagaatatccccagaaaaaaactagaaagaagctgtctgtgaaactgctttgtgatgtttgaattcaccacacagagctgaaactttcttttgattcagcagattggaaacactctttttgtagatctgcaaagggacatttaggagccaactgaagccagtgttgaaaaactggacatccccaaataaaaactagaaaaaagtgatctgttgaactgctttgagatgtgtggattcatctcatagcattaaacatttcttttgattcagcaaattgaaaacactctttttgtagaatctgcaaaggaaatttgggagcccattggggcctatggtgaaaacaccataaaaactacaaaaaatttatctgtgaaaaatgctttgtgatgtgatgattcatctcacagagttaaacttttcttttgatttaaaaggacggaaacacttttttttaaataaaatctgtgtagggatatttggcagcccattgagggctatcatgaaaatcaaaaatccccagataaaaactagaaaaaagctattggtgaaactgctttgtggtgtgtggattcatctcacagagtaaaatttttcttttgattcagcatgttggaaacactcttttttttttataacaaaaccagaaagtt

SEQ ID NO: 710 - DNA, 3796 bp, Homo sapiens
actatttcttctttttacgaaataggtgatgaagatgatcatgaccctgaacgttcaggaaagaggccgggtgaagtacatcaagcgtccaggtgccgtgctggaagcaggctgcgtggtggccaggctggagctcgatgacccttctaaagtccacccggtatgtggctccacggcccaagtgctctggctggtgcaggtgcactcgtgacctccactggttcagtgagacaggtggactcaaggctggtagcgcttctcctgcctccacctgcagacagagctcgtcgcagcagccaccgtgatggtgcagaaacacaaggaagccgcgccctgctttactcagatccctctctgtggctctccatcctgcttagagcaaaacccaatttctgccagtgacctgcaagaccccaaatgagctagctgttccctgctttcttctctgcctttctcctctgtccctctccccatcacttacttgaatacactggacccctccctcctggcggctgtcctctctgctgtgaaggacctaccccagactttgcagggatcactctcaactcctgggagctttgattccaatgtcttcccctcaatgagggcattcttgaccattgaccaccttttctttttaatagacttaatttttagtatagttttagatgtacagaacagttatgtaagtagtgcagagttcccatattctctgtggccagtttccctgtcattcatttaattatcattcaattaattgttagtattattattattattcatttttttttgagacagactctcgctctgtcgcccaggctggagtgcagtggcgtgatctcgactcactgcaacctctgcctccctggttcaagtgattcttctgcctcagcctcctgagtagctggggattataggtgtgtaccaccataccagctaatttttgtatttttagtagagacagggtttcaccatgttggccatgctggtcttgaactcctgacctcaggtgatccaccctcctcagcctcccaaagtgatgggattacaggtgtgagccactgcacctggcctcaattaattactattgttatcaatttactgttattaatttaactattattgcacgagcatggtccatttgtcatatttaatgaaccaatatcgatatattaggtattattgtttaagaataataattaactttaaaatttaactattattgcaataatatggtccatttgtcacatttaatgaaccaatattggtacattattgttcactcagatttctttagttcattttttaaaaattgtggttaaatacacataacaaaatttaccatcttagccatttttaaatgttctcttgagcagtattaaatccattcacattgttgcacagccatcaccatcatccatctccagcacttgcaaaactgaaacttgacactcgttaaatggtaactcctgagtccctcctccctccagcccctggcaaccattgttctgctttctgtctatcaattcaactcctctaggtgcctcatataggtggaatctatatagtatctggccttttgtgactagcttatttcatttagcgtaacgtctccaagtttcatccatctgatagcatgtggcagaatttccctgttttttaaggctgcataatattcccttgtaggggtgaatcacattttgtttatccacccatccactgatggacacttggattgtttctacctgttggctactgtgaataaggcagctatgaacatgagtgtacgattttcttagtttttacctattgtccaggatcccatccaggttagcacattgcatatagttgtcaggtctctttcaaccgccctttaaaaaattgtgctcacctccacccacgtgcaaacacacaccgtacctcacaaagatgatctcactgattgtcttgttgctttattatttggcctccaggagactggaaacaccgtgagaacagggccttttggctttcttgctcgctgctggggccccagtgccaaaaacagggcctagtacatcagaggtgctctgtaaatattggttgttggatgaacgtgtagcaggcaggtgccgggggcgtccccctgtcctcaggaccaccagggggtgcaccagagtgtctgtcatgtgaccctgagctcaggctcttgggggcacctccaatttagattcctcttaatttgtcaagctgtgtcattaccgatgagtccctgaggtcaaggactactttcgatgtccactgttgtgatcctggggcttagcacagtgctcggagcatagtgggtgctcagaaataacaagtcttgatgaatgaatgaatgtttacaccctcctaagcaagactctaaaataattagtacatctgtccagtaaaaaaaaaatttaaaaatatcacatggtctcttttctccagagtattctattaattgtatttgttttcttttttaaaaaaattataattattatgggtacataataggtgtacatgtttatgggggtacatgtgatcttttggtataggcataccgtctaataatcaaatcagggtgattggggtatctattacctcaagcatttttcatttctttgcgctaggaacattccagttctactcttttggttagtttaaaatgtacagtcgattttaattgactgtagagtcaccctgttgtgctatcaatactatatcttttttttttttttttttttgagatggagttttgctcttgtcgcccaggctggagtgcagtggcgtgatctcagctcactgcaacctctacctccagggttcaagcaattctcgtgcctcagcctcctgagtagctgggacttaaggcacctgccactatgcccagctaatttttgtatttttagtagagatggggtttcaccatgttggccaggctgatctcgaactcctgacctcaggtgatccgcccacctcagcctcccaaagtgctgggattacaggtgtgagccaccatgtccagcctcaatactagatcttattcattctatctaactggatttttgtacccgttaaccatccccactcccaccagccccactacccttcccagaccctggcagccatcactctacattctatttccatgagtttatttgttttaattttcagctcccacatatgagtgagaacatgctaaatttgtctttctgcccagcttatttcacttaatgtaatatcctccagttccatccatgttgctgcacatgactgttgttacaattcttttcattagtctctttctctctttttttgagacagagtctcactctgtcacccaggctggtgtgcagtggcacaatctcagctcactgcaacctccacttcctgggttcaagcaattctcctgcctcagactcccgggtagcaagtacctgggaccacaggtttgtgcgaccatgcctgactaatttttgtatttttagtagtgatggggtttcactaggttggccaggctgatcttgacctcctggcctcaagcgatccgtccaccttggcctcccaaaatgctgggattacaagggtgagccactgtgcctggcatcactagtctctttagggagttcccaaagctaggaatagactgggcctttttggatcagtgggcaggtctgggtacctgcactgtgattcctttcagcacacatttcctgtgctgggttaatgaggcagggcctgcccacccattccctgcagcctcacataaatgcttgtgagacagactggg

SEQ ID NO: 711 - DNA, 2434 bp, Homo sapiens
actatttcttctttttacgaaataggtgatgaagatgatcatgaccctgaacgttcaggaaagaggccgggtgaagtacatcaagcgtccaggtgccgtgctggaagcaggctgcgtggtggccaggctggagctcgatgacccttctaaagtccacccggtatgtggctccacggcccaagtgctctggctggtgcaggtgcactcgtgacctccactggttcagtgagacaggtggactcaaggctggtagcgcttctcctgcctccacctgcagacagagctcgtcgcagcagccaccgtgatggtgcagaaacacaaggaagccgcgccctgctttactcagatccctctctgtggctctccatcctgcttagagcaaaacccaatttctgccagtgacctgcaagaccccaaatgagctagctgttccctgctttcttctctgcctttctcctctgtccctctccccatcacttacttgaatacactggacccctccctcctggcggctgtcctctctgctgtgaaggacctaccccagactttgcagggatcactctcaactcctgggagctttgattccaatgtcttcccctcaatgagggcattcttgaccattgaccaccttttctttttaatagacttaatttttagtatagttttagatgtacagaacagttatgtaagtagtgcagagttcccatattctctgtggccagtttccctgtcattcatttaattatcattcaattaattgttagtattattattattattcatttttttttgagacagactctcgctctgtcgcccaggctggagtgcagtggcgtgatctcgactcactgcaacctctgcctccctggttcaagtgattcttctgcctcagcctcctgagtagctggggattataggtgtgtaccaccataccagctaatttttgtatttttagtagagacagggtttcaccatgttggccatgctggtcttgaactcctgacctcaggtgatccaccctcctcagcctcccaaagtgatgggattacaggtgtgagccactgcacctggcctcaattaattactattgttatcaatttactgttattaatttaactattattgcacgagcatggtccatttgtcatatttaatgaaccaatatcgatatattaggtattattgtttaagaataataattaactttaaaatttaactattattgcaataatatggtccatttgtcacatttaatgaaccaatattggtacattattgttcactcagatttctttagttcattttttaaaaattgtggttaaatacacataacaaaatttaccatcttagccatttttaaatgttctcttgagcagtattaaatccattcacattgttgcacagccatcaccatcatccatctccagcacttgcaaaactgaaacttgacactcgttaaatggtaactcctgagtccctcctccctccagcccctggcaaccattgttctgctttctgtctatcaattcaactcctctaggtgcctcatataggtggaatctatatagtatctggccttttgtgactagcttatttcatttagcgtaacgtctccaagtttcatccatctgatagcatgtggcagaatttccctgttttttaaggctgcataatattcccttgtaggggtgaatcacattttgtttatccacccatccactgatggacacttggattgtttctacctgttggctactgtgaataaggcagctatgaacatgagtgtacgattttcttagtttttacctattgtccaggatcccatccaggttagcacattgcatatagttgtcaggtctctttcaaccgccctttaaaaaattgtgctcacctccacccacgtgcaaacacacaccgtacctcacaaagatgatctcactgattgtcttgttgctttattatttggcctccaggagactggaaacaccgtgagaacagggccttttggctttcttgctcgctgctggggccccagtgccaaaaacagggcctagtacatcagaggtgctctgtaaatattggttgttggatgaacgtgtagcaggcaggtgccgggggcgtccccctgtcctcaggaccaccagggggtgcaccagagtgtctgtcatgtgaccctgagctcaggctcttgggggcacctccaatttagattcctcttaatttgtcaagctgtgtcattaccgatgagtccctgaggtcaaggactactttcgatgtccactgttgtgatcctggggcttagcacagtgctcggagcatagtgggtgctcagaaataacaagtcttgatgaatgaatgaatgtttacaccctcctaagcaagactctaaaataattagtacatctgtccagtaaaaaaaaaatttaaaaatatc

SEQ ID NO: 712 - DNA, 17143 bp, Homo sapiens
accagtaaggaaaaataactgagcaccaaattctatggggtcacagagatagatgatactgggggtctgccctctaaagctgacaatctagctcggcagaaggttgagaggtgggggtaggaacacagaaataagtaatagctatcactgtgcacacccgcccccacgtgtcaggctttctacctacattgacacatttaagctcacaacatctctggaagatccagttattagccccatttatgaatgaagaaagaaaggctcagagtaaagcagattgctctaggtcttcctagcaggaagggctagggccaaggctcaaacctgggtggctcaaggtctaaatccagtgttctaacctgcacagctacgctattcagcctaccccagctggaccgccccctcccactgcaaggaaaccaaccctgacacccagccttctatgccttctatgcaaacctctaggtgcacttcagtcagaaatctttttttttttttttgagacggagtctggctctgtcgcccaggctggatcttggctcactgcaacctccacctcccaggttcaagtgattcttgtgcttcagcctcccaggtagctgggattataggtgcccgccaccacacctggctaatttttttttaagacggtgtttcactcttgtcgtccaggctggagtgcaatggcgtgatcttggctcactgcaacctctgcctcccaggtcaagagattctcctgcctcagcctcccaagcagttgggattacagatgtctgccaccacgtctggctaatttttttttttttttgtatttttagtagagacggggttttaccatgttggccaggctggtctagaactcctgacctcaggtgatccacccgcctcagcctcccaaagtgctgggattacaggtgtgagtcacagcgcctggcctttttttttttttttttttttttgacagagtctcctctgttgcccaggctggagtgcagtagtgcaatcatgtctcactgcaagctctgcctcctgggttcaagcgattctcatgcctcagcttcccaagtagctgggattacaggtgtgtgtcagcacacccagctaatttttgtatttttagtagagacggggttttgtcatgttggccaggctggtctgaaactcctgacctcaggtgatccgcctgccttggcctcccgaagtgctgggattacagtcatgagccactgcacccagcctctctggtggtatcttttggaaagatatctttctggaaaactctttccatcccagcccaaacttgtctctgactcactcatttatttgagggtaggtgacttagatgtcatatcctacaggagggcagactgactgcccctccaaagccaaatgccattttgatcctcttctattgaccctgtaccacctcgatcaagacaattctttgtttttttttcttttatggtcaaaaaatttaagactagttccaacttgaagtagttttgtttcaacagatcaagataattccttgttttttttttttttgagacagagtttcactcttgtcacccaggctggagtgcaatggcacgatctctgctcactgcaacctccacctcccaggttcaagcgattctcctgcctcagccttccaagtagctgggattacaggtgcccaccatcacgcccggctaatttttgtatttttagtagagacagggtttcaccatattggccaggctggtctcgaactcctgacctcaggtgatccacctgcctcggcctcccaaagtgctgggattacaggcatgagccatcgcacctggactagatcaagacaattctaacagttaacaattattgagcactcattttgtgccaggcactgtgctaagagtgcagtatctcagagtggttaaacatggaggctttggggccagacttctagatttaaattctggctctgggtcaggaacagtggccgacacctgtaattccagaactttgagaggctgaggtgggaggatcgcttaaactcaggagtttgagatcagcctgagcaacatagtaagaccccgtctctaaaaaaaaaaaaattagctggatgaggtggtgtgcacttgtagtcctaactactcaggatgcttgttaggtgcagtggctcatgcttgtaatcccagcactttgggaggccgaggcaggtgaatcacttgaggtcaggagtttgagaccagcctggccaacgtggtgaagccccatctctactaaaaaattcacaaattagccgcgtgtggtggcgcacgcctgtaatcccagctactcgggaggctgaggcaggagaattgcttgaacccaggaggtggaggttgcagtgagccaagattgtgccaccacactccagcttgggtgacagagcaagactccatctcaaaaaaaaaatttgttatacaaaggaatgaataaatgcatattacattattacattcctattgtagagaagaggaagcatagctggtggcaaaccagagatttgaacccaggagttcctgatccctgtcttgaacactttctttttcttttttttttagagatggtgtcttgctatgttgcccaagctggacttgaactcctgggcttaacggatcctctggcctcagcctctcaagtagctaggactacaagcaagcccggctagcttagaccctttgtatggccccagtgtggggcctcatataccctttggctgtgtttgaggacgtgtttgacagatttgatgatcttgattgcaccctgaagtataaaaacttaggctactcgagaaagatttcatgctaaatcaggtagtaaagctctagtaatatgatcctaaggttttgtcttcatgaaactgcatgaccttaaggcatcggtttcagctaacctgcccaaggccacacaggctgtaagggaacaagatgtgagcccagccttctcacactagagtccctgtttgttctcctacccggacttttttgttgctgttgttgttttgagaccagagtctcgctgtgtcgcccaggctggagtgcagtggcatgatctcagttcactgcaaactccacctcctaggttcaagagattctcttgcttcagcctcccatgtagctgggactacaggcttgcgccacgacgccgaataatttttgtatttttagtggagacggcgtttcaccatgttggccaggctggtctcgaactcctgacctcaagtgacccacctgtctccgcctcccaaagtgctgggattacaggcgtgagccacagtgccggccttttttttgttttgttttgagatgggagttcaactcttgttgcccagattggagtgcaatggtgcaatctcagctcactgcaacctctgcctcctgggttcaagcgattctcctgcctcagcctcccaagtagctgggattacaggcatgtaccaccatgcccggctcattttgtatttttagtagagatggggtttcactatgttggtcaggctggtctcgaactcctgaactcaggtgatccactcacctcggactcccaaagtgctaggattacaggcatgagccactacatgcagcccccaggagctcttgatctgaggcataaagatgcttagagggtttccaaatatattttatggtcacctattctcccaacaatgtgtgctatactgtgtgtttacacataggtgtgtctttagaggaaagggttcaaagctttcattagattctttttttttctaataaagaaaaaagctttgttgcccaggctggtctcaaactctcaagctcaagcaatctgtccgcctcggcctctcaaagtgttgggattacagccatgagccaccacgctggtcctcattacattctcaaaggggcctattgaaaaaaaaaaaaaaaaaaaaaaaaaaggccgggcacagtggctcacgcctgtaatcccagcactttgggaggccgaggaaggcggatcacaaggtcaggagatggagaccatcctggccaatatggtgaaaccctgtctctaccaaagtacaaaaaaaaaaattagccaggcatggtggtgcgtgcctgtaatcccagctattcaggaggctgaggcagtagaactgcttgaacctgggatgcagaggttgcagtgagccaagattgcaccgctgcactccagcctaagcaacaagagtcaaactccgtctcaaaaaaaaaaaaaaaaaaaaaaaaaaaaaagatgagactgttgagtcaggattaggatccaggtctgctggcaccaatttcagtgctctttatactttctgttgctattcattcattcatccattcattcagcaaatttatatcaagtatctggtatgtgccaggtatgattccaaattacaccattcccagattattctgagaatgctgcagtgccaaactcttggtatcacagactttatattctagtgggggagacagacaaaataataatataacgacgaaggtgcaatgttatgtgctatgagaaaacgcagtcggaggatggcgaggaaggggaacggaattttagatagggcggtctgggatcagaacctccagatgcccgtccatggactccaacgaagggagcgattccaggtaccagggcaccctgcacaaacctctcttgagcttccgcctcgcccaggtggggacggtagggagaccggagggcacacgcatgcgcacgaaggaaacggtaaagcctgaagggaggtgcagagcgcatgctctctcttgcccgagatgccgaggattttgacaaggactccgtcgtcccggatgatagtgctcaggttaatgccagtgggagggcggcgcccaatagtaacttcctttggaggttgtagtaccgcccccagagccaattttccacttccgcttccggcgctgcggcagtccagatcaaaaatggcggtagttggtgtgtcctcggtttctcggctgctgggtcggtcccgcccacagctggggcggcctatgtcgagtggcgcccatggcgaagagggctcaggtactggggccggggtcgacgggtcgagcctcagccccactcgggcgagacagggagggactgtgaccttggcccgaggccttgcgggagggaaagtgagacccgggcccgccccataccggcgctgaacgtttgtggcttctccgcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaaggtacgcccttgtacatctcttcaagcgtccgttctcttttcgttatgtgtgccttagtgcaagttcttcattctctgaaggcatgggtgccaggcgtgtacagcttgtttatcctcacaaacagaaaatgtattttcttccattttgtggatggacagctgacacttgggattacgtctcaattctcttcttcaaggtcatacaataagtgctcttcagtttcccttttctccgattcatcctacctcctgccttctgagacagttcttttttttttttttttttttttttttacttctgagacagttctgaaacaggtgtccgttgtgtaaagcctggaggtttgggaaatccaattagagtggcaaagtctgaaggtggttcgcgtaagcgaacccagcagctacatgggaggctgaagcaggagaatcccttgaacctaggaggcggagtttgcagggagctgagatcgtgccactgcactccggcctgggcaacagagcgagactctggtctcaaaacaaaacaaaacagcaacaacaaaacatgggcatctggcagctactagttgcataatgaagagactgacagctttctctattccccaccaataccttttctcgactgttttatcattggttgttgatgtagatatattacaatgttgtgtcctctgttgtttgctgtatctttaacaagggcttattctgattcttcaatactggccatgcgcggtggctcacgcctgtaatcccagcactttgggaggccaaggtgggtggatcgccggaggtcaggagttcaagaccagcctcgtcaacatggcgaaacactatctctactaaaagtacaaaaagtagccgggcgtggtggcgggcgcctgtaatcccagctactcgggaggctgcggtgggagaatctaggaggttgaacccaggaggaggaggttgcagtgagccaagatccagccattgcactgcagcctgggcaacaggagtgaaactccgtctcaaaaaaaaatagtaataatatacttgatcttagccaaaaggccgagaagtgatgaaaaaagttattattattattattattattacatcacctagcccatataggactggccttgtagaaacttaacctagactcttgaatttgttgagtctttgagcggcactcccatccttgtacaatgcaattagaagccaaacagtaaaggtttctcagcctcagcactgttgacatttggggctgggtaattcttgttggggggctatcttgtgcattgtgaaatgtttagccatatccttggcctgtacccactaggtggcagtagtacctgcgcaaccccactcccgcttccccctcccccgcccccatcacagtgtctcccgatactacccagtgtgccctgaaggggcaaaatcaccctgggttggagaccgttgccctaaagtaatgcttttcaaaggtaataggcaagataattcagggtgggctgcagtttcccagcccagatattgtttgaagtctgggatggtgccagaaatctgcatttaattaagcatctccctcccctaatactgccaccattttgatataggtgatttgaggattacactttcataaacacagcactggatatactagttactagggagaggatgatgagtaactaacttgagcttgcattttctgccatccatatttgtttctggaattaaaactgtcctgtagccaggataactttaagggctcccctggtagttataagagctccttaaataatgggaaggttgaactacaccagtagataaaggactaatttccattttgtttttatatatgatctgtcaccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaatttagattggtcatgagctgagagttactttctttggttgtgttttttcgcagaaattagcatttgagcttcaagtcagtgtccaagttgaaaagaaattggcattagttatttctgtttccacagtgaaggtctaggctgctgtttagtgttacaggtccaattcagcccattgaataagtgtttataacagcccctcttggtttattgtgcctgatgtggataaagggaccaagtggagtggtgctaattaagcatcaagattagtccttggtcaggtgcggtggctcatgcctgtaatcccagcactttgggaggctgaggctggcagatcacctgaggtcaggagttggagatcagccgggccaacatgatgaaatcctgtctctactaaaaatacaaaaattagttgggtgtggtggcgcactcctatagctgggtgtagaggcttgaacccgggaggtggaggttgcagtgagccaagatcgtgccactgcactccagcctgggcaacagagtgagactctgtctcaaaaaacaaaagattggtccttgacgggcctgagatatcaaagacattgaatggctagcagaatgcctgcaatttacacctgaaagaggtatctgtatttctcaagaggaagtgcttgatctgggtctcatctttttcctgtcccattccactagcatttactgcagaatcttccctgtagtcataattttcttgaacatgtcaagttcttttttttctttttttttgagacggagtctctctctgttgcccaggctagagtgcagtggcacgatctccactcactgcaagctctgcctcccaggttcaagccattctcctgcctcagcctcccgagtagctgggactataggcacccgccaccacacccagctaattttttgtattttcagtagacacagggtttcaccatgttagccaggatggtctcgatctcctgacctcgtgatccacccgcctcagcctcccaaagtgctgggattacaggcgtgagccaccgtgcctggcctcgaatgtgtcaagttcttactttgaggtaatctccttcagggctggtagggtcagaaatcttaagagaaacaaagggagcgtgacacatttctgcttattggcttttctgtggaattaaaactatcctgctttaatggatagtaaatggtagtagtagtagttacaaaaccactctgagagggcaattattattattattattattattatttttttttttttttttttttttttgagatggagtctcgctctgtcgcccaggctggagtgcagtggcgggacctcggctcactgcaagctccacctcccgggttcacgccattctcctgcctcagcctcccaagtagctgggactacaggcgcccgccactacgcccggctacttttttgtatttttagtagagacaaggtttcacatgttggccaggctggtcttgaactcctaacctcaggtgatctgcccacctcagcctcccaaagtgctaggattacaggtctgagccactgtgcctggccagagctggtttattttattttattttattttttgagacagagtttcgcttttgttgcccaggctggagtgcaatggcatgatcttggctcaccacaacctccacctcccaggttcaagcaattctcctgcctcaccctcctgagtagctgtgattacaggcatgtgccaccacacctggctaattttttgtattttaagtagagatggggtttctccatgttggtcaggctagtctcaaactcccaacctcaggtgatctgcccacctcagtctcccaaagtgctgggattactggcgtgagccaccgcgcccagccagctggtttattcttaaggctcaaaggaacactttcgtggtaaggttcaagaggcaacaaggtatttcatattatattacattaaactggtaacgcaaaagtaaggcatatacagtacggaatagagaatctcattgtctttgccattttgtaataattaacggaatagagaatctcattgtctttgccattttgtaatattacagcctgcacttctgagtccctatagagctgttttggttgtggccagtctgagtttaggacagatgcattatacttcagcttgctgcctggcctcccttggctgggttccaaacatcttttataatccttggataatggaccctagccagtcataaaatataaatgaagaatgttttgaaatgacattaaggacaagtcacattaaatatgatgtagcaattggtaaagtggagaaaagacaatagaattagggccttctataaatcaagtttcttggtttatttttcagacagggtcttgctgtgtcacccagcctggagtgcagtggtacaatcacagctcactgcagtctccacctctcaggctcaggtaattctcccacctcagcctttagagtagctgggactacaggcacacaccaccatacccagctaatttttttgtagagacagggtttcgctatgttgcccaggctggtctcaaattcctgagctcaagtgatccgcccatcccagcttcccaaagtgttaagactacaggcatgagccaccatacccggcctgtaattcaagtttcatactactttgggtatctaataaaaccaaattactcaattaattgtggggattacgtgacattctgaggtaagtaagtgctctcctgatccttttttggtaccgtagtgtatttgtatagcctattgtggaaattttagaaatcagtgaggttttggctgggtgcggtggctcatgcctgtaatcccagcacttcgggaggtcaagagttcaagaccagccaacatggtgaaaccccatctctactaaaaatacaaaaactagctgggcatggtgatgcatgcctgtaatcccagctacttgggagactgaggcaggagaatcattggaacccaggaggtggagtttgcagtaagacaagattgcgccactgcactccagcctgggtgacagaaccagactgtctcaaaaaaaaaaaatgtgaggtttctgattgccatactgtaccacctagcttaagacaagtcactttttcttcacctttaagttacaaaacacaaaactctccccactgtatatatgaggtttgtagggtaacagggtaatagttccataaaatgcactgagttccagaggcaaataatgatagaaactaaatgttacaatttattccatcttcaggattacagacattacagggcaggatgagtaaacaaggcaaatgaagcgagcaccttcagcttcccccctaccccgacatttaaccagatgcagcattttgacatttttaggatatgcaggttgacaattcactgacttgggttgagagctggcaatagcagatctttgcaatttaggttcttcctccacagctattccaagtatcttaattcctgaactgcacactgagagctctgaaatggtgttcactgcaacattcttgcagctttcacatcttaatctgacacctcttgtgaaggcagggaactgtgttaaaagctgtcttcctctttgctaatccaggccaccatcaatcttaaccattagttactatataaaaataaaagtgtgctcaaaagcactcactgaaactgttgtgcccagatcccttttcagagcattagttccctgagaggaaaaaaagaggtcctaaccaattgctttcataaatagtgaccccagtacagtgtatatgtcttttgcagcagaaatcaagaggtcaggcagctctgctcatcctgactagtttatcatcgtttgcatacaaggtatatttatgtaaagctgattccacgccaagtattgcaaccataatctcaaaaaaattgttcaattttagcacacagttcctgcaagataccacagcaggtgagaaatcatctcaaagagttcatcttttacaactgagaggaaaacatcgaaggaggaaataaaactcctctctcctaagttcctcatcaaatctgatggctatgttcacagagttagttgacaaaaatccagagtcctcaatttctggacttgcgaaatccttcaaggtgactgtcaaggtcaagaagaattttcaggcttttctttgccatggcccatgaactccagtccttcaataggaatctctttctcctttattgctttctggtaggaggagaaaacacattataaagacctacatgaagcttaagttgcaagctttgtaaataaaatatgacagtacaaaagtaaaatcaagctgattataaagacttataaccatgattcaaaccacatactttttaaaaaacaagtaccggtcaggtgtggtggctcacgcctataatcgcagcattttgggagaccaaggcaggtggatcacttgaggccagaagttagagaccaacctggccaacatggcgagaccctgtttatactaaaaatacaaaaattagctgggcatggtggcgcatgcctgtaagcccagctactcgggtggctgaggcatgagaatagcttgaacctgggaggcggaggttgcagtgagctgagattgtgccattgcactccaggctgggagacagagtgagactctgcctcaaaaataaataaaaaccagaagtaccataatgaataaatcaagtgtaagacctgagggagactggaaaaggagttgtgagggaaccgttaaaattaagtgaaatttgaaaaataatcatcactttgtgttagtgaaagacttaggttcaaatctgggttccaggacttactggctatgtgactaactgtaaatgggatgaagacagcaactacctcggggaattgctgtgaggatgtgttgggttaacttattggaagtgctttgcccggtgctgttcttaacaattcaaagcagttccacatccattgggccagaataaacatttcctggctgcagttgcggggactggtcaagagagagaaacaggctaacgaagggtttataacaacaaaaaaatgtgaccctccagtctgaattctgaagtataatcccgcccagaccccagcagtaatagtggaaaagtgcaccacctgcgaaagaaccaaggaaacctgatgctagtgaactcggattaatcacttcctatttctgggtgttagttttttatgtataaaatatgagtaactatgcccaccttgcgagtttagggtgaacaccaaatgaaccaaaggatgtgactgtgcttcttgaaaagcactgccccaatatttgtcattcggagagacacccaagtggcctcggtggtgatggtaggggagcgagctcctgccactggcctcactgcgacttttctccacccttccagtccagtcccaatccccgtaaaatacgatgagtgtggtgggacacagcgccgagaatgcagggcctgggaacagaggcgggagggctcacctgaacacactgctggtagcgcttgaagaggtcggtgcacgggtccccggagctgtcccccttgagaaatttctcggcgaaccagcgattgaagcactggtcgtactcgcgcttcatgtccgtgcatgcctcccccacactgttcatggcgacagtggtggcggcggcgacgacggcgcactctgatgtcatcactctcaggcgcgtcgctcggcgttacgcgcgggcgcactgcgggggccaaggaaggaagaaatgtggtcgcggttggtgtggctgggccttcgggcccctctgggcgggcgccagggcttcacctccaaggcggatcctcaggtaaaggccagggccatctaggcgggtggcggagcaagccgggaggcacttcggagcgccggtgacccacactccccgcctcatccctcctccagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacaggtaaactcgcggctgcagccccgaagccttgaccgtggcccgttcgcagccgtttaatgtgacgattagcgaacagttttccagggggttaaagagtgttagcaagattcaggaacttgcccacagtcacctcgcgagtcagtggcttcactcttccccttgttcattactgatgctctcgctagtgtaagtggaaacaaaacccgaactgctaatcactgcctttgtttttttttttgtttgtttgttttgtttttttttttttgagacggagtctcgctgtgttgcctaggctggagtgcagtggctcgatctcggctcactgcaacctccgcctcccgtgttcaagcaattctctgcctcagcctcccgagtagctgggattacaggcgactgccaccaggcccggcttattttttttgtatttttagtagagacgtggtttcaccatcttggccaggttggtcttgaactcctgaccgtgatccacccgcctcggcctcccaaagtgctgggattacaggtgtgagccaccgcgcctggcctaatcatcgcctttaaggccctactccatagagtccctacctactcactccaacgtactcttctcagtactctccttggctaccttgactgcttctccagcaagacaagttcttttcctctctagatctctgcactggcccttcgtttttttccttcctctcagtatttgcatggctgcctccctcttggcacaggtctcagcttatcttctcagaaagggctctcctaaccactccaaatcccttctccccttctagttagtaactcatcctattgggttttttccctaacattttaatggacttttgttcatttgttatatctcttttattaaaatgtgagctcattatgtagttactgttttattcctgccttgaatttttattttatttgtttttgagatggagtctcactctatcacccaggttagagtgcagtggcatgatctcagctcattgtaatgtccacctcccagactcaagagagcctcccatctcagcctcccaagtacaggaccacaggcgcgtgccacttggcctggctaattttttgtatttttgatagagacgggattttgccatgttccccaggcttgtctggactcctgagcaaaggtgatccacccatctcagcctcctaaagtactgggattacaggcatgagccacagcacctggccgtgtttgattctttcaaatgtcttctctactttgcaattttctttttcctttgggacggggtctcactatgttgcccaggctggtcgcaaacttctagactcaagagatcctcctgcctcagcctcccaaatagctgggactataggtgtgcaccaccacacctggctaatacttaaaatttttgtagaaacggggtcttgccatgttgccccatatggtctcaaactcctggtctcaagcaatcctcctgcctcagcctcccacttcctcaagaaagtttttttttttttttgaggtggagtcctgccccatcacccaggctggagtgcagtggcatgatcttggctcactgcaacctccaccctccaggttcaagtgatttttgtgcctcagcctccggagtagctgggattacaggcacccgccaccacactcagctagtttttgcatttttagtagagacagggtttcaccatgttgaccaggctggtctcgaacccctggcctcaagtgatccgcccatcttcgcctcccaaagtgctgggattacaggtatgagtcactgcactggccaaaaaagtccattcctttttttttttttttttttttgagacggagtttcactcttccacccaggctggagtacagtggtgcaatctcagctcactgcaacctccaccttccggtttcaagtgattctcttgcctcagcctcccgagtagctgggactacaggcgcccgccaccacgcccagctaatttttgtatttttaatagagacggggtttcaccatgttggccaggctggtctcgaactcatgacctcacagtccacccgcctcggcctcccaaagtgctgggattataggcgtgagccacaagtcttcattcttttatacttaggttctttttttttttttttaattgagacaagagtctcgctctgtcgctgaggctggagtgcagtggcgtgatcttggctcactgcaagttccgcctcctgggttcatgccattctcctgcctcagcctcccaagtagctgggtctacaagtgcccactaccacgcctggctaattttttgtatttttagtagagatgaggtttcaccgtagccaagatggtctcgatctcctgacctcgtgatctgcccacctcagcctcccaaaggtgctgattacaggcgtgagccactgtgcctggctatacttaggttctctacctgtggctctcgtgatatccaaaagggctgatttatacatgcgtttatacatctatttaagggatgtgttgagtctctgcccctctcctgctcacccaccttccacagcatgtctgtttttccttatcatgttctcagtggttggcactgagtattcagtaaatgtgttttgttttgttttgttttgtttttttgagatggagtctcactctgttgcccacgctggaggcagtggcgtgatctcggctcactgcaacctctgcctcctgggtttgagattctcttgcctcagcttcccgagcacccgggattacaggcatgcaccaccatgcctggttaatttttgtatttttagtagagaggggtttcaccatgttggcaaggctcgtcttgaactcctgacctcaggtgatctgcctgcctcagcctcccaaagtgctgggaatacagccttgagctgccgtgcccggccacagtaaatgtttaatgaatttttttttttttagagacagagttttgctcacgttgcccaggctggagtgcaatggcgcgatctcagctcaccacaacctctgcctcccaggttcaagcgattctcctgcctcagcctcccaagtagctgggattacaggtgcacgccaccacgcccagctaattttgtatttttagtagagacagggtttctccatgttggtcaggctggtctcaaactcccgacctcaggtgatctgcccaccttggcctcccaaagtgctgggattacaggcatgagccaccatgcccggtcccagtgttctttattaatatctctaggaaaggagggactagaagcacagagtcatcagaatttccccaagttatctagagggtaaatacaaagaaatataaccatcattaataagggaaaaggtcgtgaaaaaagatgaggaatttggatccagtagctagcatctcaacctcgtattcagtgatctgtactgtttttcataaatttggaaaccagtttgggttaataattcccattaatcatttta

SEQ ID NO: 713 - DNA, 4300040 bp, Homo sapiens (residues 1-2,150,020 of 4,300,040)
acccagtgttttacgaataaggaaatcaacagagatcagagcaaagaaattgatccaaaatttaagcaagggctcaggaatgataatcatgacacagctgatgagtagtgttgaagaagatgcagaatcagaggaatctcatgggagaccagacatccacacaccacttctagaggctttccaagatggcgtgagccgagagcttcctgtcatctctgtacttaggaaatgtgccatccttgcattgcccttagcctcagttttactgttccttgtacatagcgggattgttacttccatcaagcaaagcagtccttaagtttcatagactgttacagcattgtctaattggctcctcaccctgtttcagataggttaggaaagtatctttaaaaccactttatatgtcaaaggacttgtatttagaatatggaaagaactcaataagactaacaacttaataaaatgggcaaaaggcttaaattgacatttagcaaaaaagatatatgaagggccaataattacatgaaggtggtcaacatcataaatcatcaggaaaatgcaaacgaaaacctccttgcagaaccactaatgctactttattctcaataccaaggtgaggatgagagactgaaacactcacacattgctgatgggcgtgtaaaatggtacaaccactttggacaactgacccagcaatgaaattgctgggtatttactcaggagaaatcaaaatacagacacagaggacttgaacatgaatattattagcagctctattcgtagtagctcaaaactggaaacaacgcaaacatctatcaataggtaaatagataagttgtggcttctgcatgcaatagatatactcagcaacaaaaaacaaactattgattcaacaccatggatgagtctcagaaacattatgttgatcaaaagaagccaaacacacaagaattgatctgtaacattccatttatatgcagctctaggagaggtggaactatgatgatgaaagtcagaaagtagttgcctccatttagggaaattgacttacttgtttacttgctttatttagggaaattgacttacttgcttaagtaaatgggtgagccagtgcttgaactcaggccaacagatctcagggctagggccccactggctacatcacactctctcagcatagaaggaaggtgaggaagaacgaggcacagcagctggggagcagaaggaaggcaggtaaggtatcaggagaaaggaaaggcagaagtcactgaggtcacatttctgtcctgggcataaggctcataatggcacctgtgatggaaagaggcccttccatcgtggccacctgcagaagtaattaggagggcttgacagatgtgggagagagaagcatcatcatccaactggtggagcctgccagtagagaaggtattaaagttattctcttgttggtatccaaatgggatttttatcatcatagtcccacctctcctagagctgcatataaatggaatgttacaaatcaattcttgtgtgtttggcctcttttgatcaacataatgtttctgagatccatccatggtattgaatcagtttgttttttgttgctgagtaaacaataaacttgttttattcgtaagatcttttaaaaattcttcatgacataattaatacatatacactgcagaaagaaaatatacataaaagaagaaaaaataaaacctcctatggtcttattatcccgtgataatctctgatctttgtttttgtttttcagtaaataaaaacattttaaacaaaaatgggatcatatactatacgtgctgttttataatatgccttttaaacaacatatcagtgaacatttctctctatcagagggtataatttctattggatacataacatcctatgggtggatatatccaaattttgtttaaccaaacctctgctactacatatttaaattgtttccagtttttagttactacctactaccccctacaagagaacatcttgaacataacacatttgctcactttttttcagtatttcctcaaggaaaactctagaagtggaaattctaggtcaaatggtttggacatccttaaggaatttaatacatattgtcaattattgtttttgaaatggttttagcaatttacattctcaccagcagtgaatgaatgtgttattctgtgtcaccttaacaggtggactataactttcgtccctgtgctaagtactacctcttttcattgaagcacctgtcaggattagaaattaacctttgatgttgtctagctccatctcccaagcaatggctgaattcccttttggattctgctagtttgaaatgaaaaccatttctttaaaaatgttaatttgaaaacatgattgatgtttgagtgtagtagaaaaattggaggagccagaaacagaagtgatcctggggtcagagtacctgggtttcagggctggccgcgtccttgtctgtagttgtgtaatcaccagcaagttgctgacgtaccctgcctgggtctctgtgtccccatgtctaagacaaggggattgaggggggctcaatctctacattgtctttagttatgacattcaataaatcttcggctatttaaagcattcctttcaagggctgggcttgtaaattaagcgtggcaggcctttgaaatgcagcttgtgtgggaaaggaaacaaacccagcagctagtttgctgctggatcagaattcgatgttctttgtgaagtaataaattgtgtcttggctcctggattgttccaggttgcctcgggtttcacggaagtggctttttcaggaatggttcccattgccggaaagtgggtgttaatttgtgccttggctatttttcagggcacattctggcaaaatcctggcatctttttcagaggatcagcagatgtaatgacctgggggttgctccccttgcaagaggacacatgctctatgttaataccccaaatcaagcctatagtcagaggcctaggttttataatagagcacttatcctgggcatgccaagggtttttgaccaagtggaaacactttgggacatgtaccacaggaaacaggacagcggaatgcttagtaatggttagcatttctaaataaagtatctgctctccactgaaatggggtacaggtggtgtcctggaagaggagaggaagctaatggaagtgaagaaagaataaaatagaataacatctgtgtttggtgctccacagcttgcagcctacattaacatactttatttactctacacaatgtccccaggatatcatcattgccattttgtcccaatttaccaccgagcaaatgcaagggttggagtgttggtcgtgagtggcccaatcacctctgcaacaacctcacggcttggcttaaaataccgtaaatccctgcttccttggcagatcttcatagtctcatacctcctttctcttctatgacaattgaaaaattacttttttcttactctttgagtccatagtcataaattcaagtcatttgccaatcttcagtataatgcaattggaaaacattgtctagtctagtatttcccagactttaatttttaaaattattttcaacttttattttagttatttgcacactgtcttcacaatttatgccacatctgtgtgccacctgtaccattatttacattatttgttttcagacaaattacaatttcacttttttcttgctctaagaactctagtaactgaaatcattagtttgatgtaccagttatagttttctaatgtatgctatcacatagctgttaaaatcttgtgttcattttttgtagtacataatatatctcacttctccctttgatatacacactatactctgaggaattaatttaaatgaaataaaatttcaaaattcagtttcttggttgagttagctgcattttaagtgtccagttgacacatgtagcttaacggctgccatattgggcagggcagactagaacattctgtcatcccaggaagttctatcagacagactcttcctaaggtttgtccagggcacttaaagcagcagacatttcactgctttcattagcctaagctagactaacatacaagattatcaaaagaaaggtgaattaatttaagaactgctaccaaaaatgtcagataatagtttctttcattgaccactgtccaagtaagcagcaagacaagtcaaagcatctgatttgataatggatcacttcagtctgctctaaaccagctctctctcagggctgtctcttcttccatccccgccactcccattctccccttctctccttcccagtccatgtctctcttcagtgtgtgtctgtgttttcgctttcatgcttcttcttcctcttgcttcacctgtgtgtcctaacctcactttcattctagccctcagtcctttctctccctttctgcctattttaccttcccaaccttctgaatctccctcattcaaaatttaagtatatttggattttgttttgtaaattcttcttcaagtacaataatttcaggccaaaggacattctcatttgtaatgtgaataagggatacctcctagcagaattccacaagatgtgataagtctcactggcatctcagctctgtgttaatgcacataaaacgactgtttcctgctcaaacctctgcctgtctctcactgatgtaaaaccataacaaactaattgctttactctactcctcatccaaagtctcctttaaagaacaagagaatttttgaccatgcttctcttcaggcccatggaaaaaggtccaaaccttgctctgtggcattggttacacttcttgagcagactaaaagccaggcattgccttgaaggcctgatgccacttctatttaatcagaactccttccagagccataaggttactggaggtcccccagagggaggaaagtgctgtgtagacatatttatgcttcatctgttggccatgaatgtcaaggaggagaactgactagactgccttctctttgttttaattatccagagattccaaaaggaaaggaaaggccaagtggacccaagagccctcagaagtgcaagatgctctggggaacatatgtgcattgctcaattccatgaaatagacccttccttaggagtacaaaattgaaagtttcccttacttcttgcggggaaacctgtttacctccccccacctccccaccccttccaaatgtactcagttaggctgtggaaaatttaattcctcttgctaatttatataagaagttatgataccttggaaatttttatctgtcagctttaaaacgttaaatatgggatccactattctcaggaaaatgatgtgatgatctgctgtctttctcagacaaagggaggcatttttccaagagtggaagtccctacctgcgtgggaatgatagagacatcctctgactgggttttgtactgctccagactctgaaaaagagaaagagatccaagtttaagtgactttaatcttagtaaagttttaaggtttatgttatcctctggataataataactataatgatgttttgagtgcttggaatttgtggagcagtgtgttaggtgctgctgctgtaaacacaatctcattaatcctcatgacaaccctgatgaggtgactctcccccaccaccatattctaattggaggaatttgagtctcagagaggcgaataatttctcaaaggcaacacagtcaataaattgtcagagctcggattcaaacccaggacagagctttgtggtctttagatccattgttctgtgttggtttattcagcaaatgtttattggtggttactgtggccaggcactgttgctcagggattccacaatgaacaataaaggcaacactcctgatcttatggagcatatgccctggagaggaaagacagaagaacaggaagttaaaaaataatataacatttttaaacaattaataatctggcatgataatttcagatgttggcaatgccataagaacaatagatggagtaaagcaatagtgaatatggggctgctttatgttgggagctctcagaaggattttctgggatgacttttgaactcagacctgagtgatatgaaggatccagaatccagtgttgggggcagaggaaacagcaagcgcaaaggccctggggtgattgagtgccatgtctttcaggagcagcaagaaggccagttttgctgtgtagccggtgggggtgagtgacaatataaggtcagagatatagacaggctttggattttgctccaagtgtaatgggacaccacagggttctaagcagaaacggtatatgatctgaattgtttttttctttttctttttttgagacggagtctctcactctgtcacccaagctggagtgcagtggtgtgatctcggctcactgcagcctctgcctcccgagttcaagcaattctcctgcctcagcctcccaagtagctgggattacaggtgcccaccaccacacctagctaatttttgtatttttaatagagacagtgtttcaccgtgttggccaggttggtctcaaactcctgacctcaagtgatccaaccgccttggcctcccaaagtgctgggatgacaggcatgaaccactgtgcctagcctgaattaagtgttgaaagataactctggtttctatgtatggaacagagtgtacagtagcaagacaggaagtgggaaaaatggttagaagaacatgaacatcagaagggctggaggtttttgaaggaggaggatagtgctttggaaacagcaaagggggagagtgggcaagaaatgactgtttatcctacctccaggccctgggtgtgaggagtgatcctcaggggccagccaggtccagggagtaggcaaaaaggaagggagccttcagaaaagaagatgtagctctaggggagtttgctgcagcggcagtggtggcaaatcacaggatagctagtttttattgaacatgtactgtctgtctagcaggattctaagtgcttttcctgcaataacttgtttagtcctcttggtaatcctaaactgtagatactattattagccccatatcacataggaaactgacagggagttaagaaacttgtagcaagtaagcaatatggctgggatggcattactaatttcagaagtcagagtggaaagttggaggggttgtcagagagggttggagcgtgctctcactaagggaggggtcgactggtctagagatgagacccagatggcaaacgtgacctgggaggttttgatggaggtaaagcttgctccatgatgccatttgccctgaatgacactagaggaagtttccccatcagttcagactggaagcatggagcctaggagtgactgctctttcttgaagcttcccgtggggtggggcccagggcctcctcactgggattgctttcttaggcagcttgtggggcaagaagagtttcgtctaaacaaggcagtgtcttgaccccttttatcccactgcctttgagttgggagaatgttcatatttacacatttctgggatgttttactgcagttctcgtttggagataataatagataacattcatcattcattaagcacttacaatgtgtcaggttctatgctgagcacttgacatatagtattccttcaataaacacagtagtcttatgacatggctactattcttgctcccctttttctgatggactaactgagctctagacaggttacgtcatttgcccaaagtgctatatagtgagtggtggacctgagatttaaaccttacaacctgacaccagaggttatagcctcactctgctgcaagtgaagaagatatgtttgctaggtttggggcaatgctgcccaggaagtctttgtaaatcccaaaagaatgagtgattgtagcaacacaaagtttgaagggaaaccttgagagtgagtggctagcatcttccttccgtgaccatactgatgttgaaatgttggtagatcaactaccagcatcagagacgaacctgaaggtaatggactcaggaggggaagacaagggtgagaaaggggaaattgttgtaaatagagaaaaggaaattattggtttacttaacttgtcttccactacgtgatctaaaagtaacagtactcagataatactttctctctcttttaattccagtaaatgaacacctaaaaaactgcttacttccccactctccctgcaaacaagaaaaatggtgggattatggatacttttctattaagatgttttagttttctattattttaaaagaaaaatatgtggggtatttttaaaagaaattgtttaaataaatgaaataagattctttaggcatcatatttaattgaattcatttcatccctttaaaaaatatattttctttgacattcatctattcctatccaaaaacatgggtggatgatcggatctcagttttcttaggctccgtgatcctggcagagttactttttaatcacttgtctatgtttctccaacttgaaaatacctagacttccaaggcaactgaactgctgtggaagagccatgaacttctctgccaaatggccgtgagtaagaagatggcctcttggattgctctcagtccctcatttgtgttctaaaagaattcattaacctgtagatcagtttggggttttttttgactcacctggtggatcagattttgctgtccctaaatgttcctctgagctccttggagaaaaaagttacgagtaatagacatgtgtttatcattttacaaatgcatattgagtgcctactgcgtttcagactccagatgccaaaatgagtaagctgggatccttcttcctaagggctggttgtttgaagaaattattagaaaaattggtggtgaggggcaaatacagccacctgtgtggtgagccagtctgtgtccctttgtgtaaaaaattccttgaaagttagagccctaatgtcttgaatgtactaatataaaatattcatcatcagttcactgttacaatttttcacccttttacacctgatgtgaactttgggctttgcacctcatgaaggcacatacctactctttaagatggagtgatgttacccagagggaccacctacctggaaaatggcaaagcctggccttgaacttctaattcctacttcagggcactttcttctgtctaaaataaaaccctgctcattatctgtgtactttatttacctttccaaatgttactattattattaatattattattataaccaagttatttagattagccaacatattttactgaggtgacatggtagaagcaaactcaaaactgtcctttgggctgcctccccagtccagggcatgcacagttgtggacagatcatagaagacagcttctctctgaaggtatggggttaggagtggggatgagggaggtccaggacaataagagaaacatgcaactgctgattgagtgtttggaaaaatgaaaagtattgctcactgattgaaagagatgtagtcagaatttcatgcttaagtgcgaccaattctggatgtcatggttgtcacctaatatgtgcccaataaacacatgttgactgaatgaataaatgtggggtgaagaaatacaaagcaaggagagcaagccaacccagaatcttccttgactttctgtgtgcctcctggaatagatgatttaacacctctgtgtctctaggtagaactgaaaggtgtcagtggcagagtttatggatatctaccttgagatgctatttagaggagtaggttttgtatacctggaaggtgaaaaggaagatctagtaagttcaaaagagggagactttggagccaacaacttaatgggacttcagtctgaaccacggcaaaggggcagccaagcctgtctggatgcctcccttgcacaacatcaacacacatgtgcccaccacagtgagggtcctgcttggttatctggcatgttatgggaacagaggagtcaacactttggagtaagtcagtgttagctcgtgttgcttcatttttagagatgagtaaaaagatgtgataactgcagtagcttcctataactgctgtaaccaattactacaaactcagtggcttgaaacaacagaaatcaattctctcatagtgctggaaacctgaaatcaagaatcaaggccagcagggctgtgctgcctcctgaggctccaagggagactcaatcctggcctcttccagcttctgtggactccaggcattccttgcccactggctgcatccctccaatctctggctccatcaccacacggccttcttttctctctgtgtttctcttctgtgtgtctctccataaggacacatgccattggatttagggcccacctggacaatccaggatgacctcattatgagatccttagtcacatctgcaaagaccctttttccaaataaggccagattccagggattgggacatgagtatatcttttgggagaccacgcttcaacctactgcaatgatgctgatgtattaggaagatggtttgacagggggagtgtgatagcaagggtagggtgcagacactgggctcactggctgctgtggccttagtccaggactggggaaataaggaacgaccacagcaggagccatgggaataaagaggaggaaatggaagcaggagatatttcatggaagaatttgccagaacttggtgataaattttggtgtggtcagtaagagaaagagaaaatcctaatttgacaccaaggcatatttccccaaaatatgtgctacagaatgctggatcttgggatatcagtagctattgtgtgaggggaaaatggttctatacataaagacatttgggggacactggattaaacagcattgaacaggtgtctatcctgcaggatttctgtaagcctttaacatccccacgtatatcataagtgtctaaagaaggtttctagaggacagtctttcccatacttacttgaccataggcctgctttatctagattatcttgaagaacaagtggtccacacacctctgaaaaatactgctcgatggcatccaccctctgagaaaagataatataagtgacgttcagaaagatggaatgaagaaaactggaatcggacagtctgatgagggccaggcttgtttccaagacccctgccagccttaaagatagccacagggactgacaccagtaactggcagctggcagaagccatttgcaggtttgcacagtgacgctctgactttaatagtccgtgcaactgtcctgtggtttggtttcttatttctctggtaccttcttgacagtagaagctgttgctttagagcagttgcagcaagtatgtttcacccagtgtgccaactctgctgcattggatggctgactctcatgctgccttgagaaggatgctaagctgcaggaggctgcgcaggaaagagtgctgtaaatgacttgtaatgtctgccatgagcacaggaggaagatggagatgagctaagagcccttcttggtttatgcctcttttttttttttttttttttttttttttgagacgagtctctatctgtcacccaggctggagtgcagtggtgcagtctcagctcactgcaaactccgcctcctgggttcatgccattctcctacctcagcctcccaggtagctgggactacaggtgcccaccaccacgcccggctaatttttttttttttttttttttgtattttttagtagagacggggtttcaccgtattagccaggatgatctcgatctcctgaccttgtgatccgcctgcctcggcctcccaaagtgctgggattacaagcgtgagccaccatgcccggcctcttgctttatacttcaaagaacttccttgcccatgctccctccctcccttgtccatgcctcaaaaggggccaaccaagatcagcagttatgcatcttggatgcagtcttcctggactcttcaatcttgagctctcacctagaaggaaaatggtggtatcaatgagagaaatgtagccatcaatttcacaatgaataataaaaatagctaatatttactgagcacttattatgcatcaggctccctgctaagtgttctacatgtaatgtctcatttaattctcatggcagcctcaagggataggtaccatcaatcatctaattgtacagatgaggaacatgaggcacatagagattaaattactagcccaggaacacacagctaatatgtgctacaaccaggatttaactttaagcatcctaatgttaaaaccgacactcataaccactgaactgcagatttaattatagacatgttggatttgaaacattggtaagacttgcaagtggaaatatgcaggaggcagaggaagatacagaactggacaaggtcaggcatgggcacagagccagggagtgggggtggttgaaaggtgcccacagatgcgtttattcaaactatgagttgagagtcagttatacagatgtacaatgtacagagaaatctgcgcaaatgttttatgtattagggagatgttttcccaagtaatgagttagaaataactgacttttgttatggtccatggacagaacattccaactgtgaggaaacaggacgcagatgaagaagtctgtgtcctaaatcatgctgaaaagtcagaatctgttgggatttttggagatacattctttgcatctcatctcatctcaatggtctcacaagtgcaatagaaaatcatggtccttggtgagagctggtgagagctttgccttagcatccccagctacagactcaccacctttcccattccctgtagaacctgaacccctcaaggacagggaatgggtctcattcatccaggagcttctaacacccgacacacgcagacactcagtaaacagtaagtgaattagtagaaccaaggaaataagaaccgaccctattcggttacatctgctcctggatatattatcaaatttagagtgttttcactgacccatcactatttcattgtaaatggctgaattttccccctgtaggctggggacaatgccacaataaattactgcctacttgaaccgagtttcattttgttctgattgattgccggtttcaaggaccgtctaaaatctcagtttatggactttacttcctggtggttcccagagagaaatgagcctggattccagagaatgcaaatttcttcaaacttgcagccggcttccagactccctgcaaaggtctcttaagcctctaaatatttcctctcttaaatcacacatcactggcacaggcagaatattttccagttacttctttcttgttaggagagagtcgcttagaggtctaccaagtagacagaaatgcagtcgttttggcagttttattgtgctgtctttaggtttcgtttagtgattctttttttaagttgtgtttggttttttattcctgaaagaaactatttcaggaatagttgcactggaatattccaggaatagtcgctgcattagaaacacgatgttgactctctcttggcatgtttatgggtgggatgaactgcatatgtgaaatgaagcttaatctctcacttgtgcaaatgtcgagactttgatttgacacttttccaattaggtgatgtgaatccctagggctagtgtggtagcttattgtgtagcaatggcacacaggtattctgccaaattttgatgtgtatctaaaatttgtatttgattcaacctagaatagattctcttatagtgtctgttggacagtatgctgaactgagcaagttatggagtgtggcacagaatgaggcacaatttatggtgccatagctaagaggcacagtgtcatgtcaagttagtatgtatgaaaaatgaccattgccttggtctgaatcttccccaaaattcatgttgaaacttaatcaccattgcagtcgtattaagacgtgggtcctttaggaggtgattaggtcatgaagactcctccctcataaatgggattaatgccttataaaatagccttcacccggggttcagccttttttgcccttctgcctttcaccatgtaaggacacagcaacaaggcgccaccttgaaagtagagacggggccctcaccagacaccaaagctgctggagccttgatcttgaacttccagcctccagaactgggagaaataaatttctattatttatagattactcgttctcaagtattttgatgtaacagaaaactgactaagacagccatttattgaaacacacaaactcttctctgatgaatacaaaaaggcttgtggtcagggcaataaataattctcaaatggagggcaacaaaagtgaaaaatgtgacaacagaaggaagtttttataacttcccaacactttctttttcataatgtattccccattaatgcccttcaaatgtatagccaaaaatttgagtgtttgaaagtgcaaaaaggttgcaaaccactgatccattcccgacatcatcagttaggttctgacacacatacacacacacagcactttagttaatgttttttcttttggattttctttaaattttgctgcttttcttcattgatgttactcagattttgttgattttttttccccatgtttatcctcttttttttttttttttttttttgagacagggtctcactttgttgcccaggctggagtgcagtggcacaatcatggctcactgcagctttagcctcccaggttcaagtgatcctcccaccttagcctcctgagtaggtaggactaaaggtgcacaccaccacactcagctaatctttgtattttttgtagagacagtgtcttgccatgttgcccaggctggtggtctcaaactcctgggctcaagcaatcttcctgtctcagccttccaagatgctgggattacagttgtgagccaccgcaccaatcaatttaaactcttcatgtcttgcctgatatatcctaggtataagcctaagaaaattgccttaagtaagactgaacagtgccttggactctcttgctctcagacaaatacccaactttccagagtgtttattattgaaaaccacaaaagttgaaaatgggagacagctaacttggaaactctccctcatccctccatctctgccattgtcagagtcagtgataagaatgagaggtaaatgctcttgcccatgtatcgtacttttgcagtggatggggtccttgactctctgagagtcatggcccttaagaacatctggagcagccactgaggactttgtcagcaacttctcattccaggcaacaacccacagtggcagccagcagccctcagctccgtgggaagcagtatgggggaagtacgtggacttggatagcactcaaaccaaagtgtaactcattactactgcaacctttagtagagttgtccacttctgtgagcttggtctcctcatctggaaaatggaaataaaatttctcccccgtggttattaaaattaaataagatgtctgtcaggcatccttatagaggaggcactgtataaaggttcttttccttgcctccctgcatcccataatgtaaacacaacctccctcactggctaccttttgttactgacactggaatatctgaaaatcaactgatagagatgatgagacatgcttctttcacagattcatcagatttcctgactggccttagatgaagcaggagcagagggggaaatcttgatctgtggcaggtgtttaggtttcatggatggtaaagagtaagtctgagctatccatgatcaatttattactaatacacatcacactttcatataacttagataacagctatgaactcacttctttggaagatcctgactgctatggcaaagactctttcgttgtctgccaaacctgagtctctttcctcctgggtccatagctaggccgtatttcccagccttcttgaagttggatgtagccaatggaagatgggccagtcctggtgattctccactttttcccctctccatctgccaggtggatatcagtgtccagtgcaaccttggaaaccatgtattgaggggcatagagcctctggcagcctgggtccttaagtggttgtgtggagctttaccctccctgcccaccatctgagttttaccctagcaagaaataagctcttcatgttaagccatggaggagttgtcaaggttcatctgttatagcagctagctttgccttaacgaataaacttgatgaaacaggaggtgagttttttaaactttccccttttatgatagcactgacattcttctgaacattttctatgttgttactgtgggaaaacaaatgtcataattacttatctattcaaaatatgctgtgtatattgatcataagaaagatggaatgaggttctctgtcagcaggaagtctatttgactttttacctaacagtctcaattgaaagctggggttagtgattaactacacttattgtgttttcaatcagattaaacactcatggtgccaggtgctaggttgagaaggggaagcttagtaaagacagaagaaataaaagtaattttttttctaaatagtcagaaatccagaaattagacaatcatcaaagatttgtctaacgtatcctatatacttttatgttttcttgaacaaaatgtactgaaaatagttttaccttttccagccttcagcttcatcaactgtaaaatgaaggatacttaatctacaggatttgagaattaaatggggatcatagctacctcccagcctaatgcctgacgtaataaatattaaaaccctaccctttcttaatgacctggtttgttgggatatgctcgggagttatgcttatgaacatgaattatcacattggagacttgtaaattatctgtggctgcttatcccaacatggaatggtgctaggtggcagtgcttctgttatggtaactacttctacaatttttattgatttcttcttgccactttttgcttgtagttgcagccttcaaaactatcttcttctaatcctttttattgggggaagaaaatgaaacacccctgttagaaattattattggaaaatgaacgagttctgtatgcaagctggaagacactccagccaagaagactaccagccgaatggcagttacagcagctcaggggccagcacactcagtgccaagattggggctggttccagcaagttgaggttagcagcagtcagaactccccagttcagtatggtgctgccacacttcttgccagctcagctcctgtggctgggagaaagcggggaggaaggaggtaaagatcagagattgaagcaggacaggatatccagggtcagatgtaactttagtgattcttcattgaggaggccaagcagtggtttttgggtgtgagtttttatgacacactacttatttggggctaaatatgacatgcccacgtatttaaaagccccaatcattcattatccagcacaaagatggtaatatacacatctatttaatatggtatcagctgacatctcagtgatttgaggaactttagaaaggatctgtcctccaaaatatctcctcatccagtttgccttgattaaggaatctcaccctgaagagatgtatcccttagggtcagtggagtgtttgctctctttcactcatatggtcaccagaaaacatgggttgatacctactgtgtaccaagcccccgaaaaaaaaaatctttgcctctgccttcaggaatcttactgtctacttgaagagattattacatgagaaatctgtgctgtggatgaggaagggggtctagaaagtgaagtacaggggcttagagagaaattaaatggggggcgggggcattgacggggataggggcaggggtgctaacttagattttgagtcagaatgcctctctggaagaatgtgcttctatcagagacctgaaggagtggtccttggccaggcaaaagaagggatgagtttagagccataggaaaaaatgagtgaacatttgaggcaggaaggagctaggagctagagggagaccagagggtcataaggaaggggctggggagtgtgggatggggctagatcctgctgggcttctgggcctggctaaggacttcttaaattcagacctaaggacttcctcattcatcctacaggcaataggaaacgcctgaagtaataaaagaatgacctgtttccgctcttgttttaaaatatcattctactcaagatgtggaaattgtgttggaaatagacaaggtagaagcccagagatcagttaggaagtgactgaaaaaaatcccgggaggtgcaaggccttgaacttgtggacacatgaaaatggatagaagtgggtgaattcaagacacatttcaaaaatgcagtcagtaagattcttctactgcattgtggttaagcacctcggctgtggagacagacgccctgggtttgaatccctgctttgctgcagacttgtcatgtgatcatgagcaagtcacttaacttttccaagccttgacctgacctgtccactgggcatgttatttaaaacagagaatacactcgtggtctcttaacacagtgcctagtggcacagatcaagcactcattaaatgttgttcttttgttgaaatgcagggagaggtaacactacaattcagttatcacttaattagctctttgttctgagttagtctccccgatattttccagctgccaaataagagaagcagaaactgggcagaagacgcctgaattctgggtggaggaagaccagggctgcattagaatcccttgtgaacttgaaaaccatcagtgtgtccccctcttcatgttcctcttctccagctcacccataaccccagtcttaagcttttactgcaaggtcagtttttccagttttttcccgtactttctccaagtcctcagaaatttctgtaagtcctgcagcctaaaatacagtccaagccatgctgaggagtaagtaaggttacactgttgtgttaatctgccatgagcagacatgcaacggtggtcactgggacctttggtgcttattctatagccttggcctagagggaagagagacatgacccagaagggtaacagccgtcagcaatgccaacactaaactcttagcactgactgaaacaacaaagggtgagagagagagagagagagagtgtgtgtgtgtgtgtgtgtgtgtgtgtgtgtgtgtgtgtgtgtgtgtgatggagtctcactctgtcaccaggctggattacagtggtgccatctcagctcactgcaacctctgcctcctgggttcaagtgattctcctaccccagcctcctgagtagctaggattacaggcacatgctgccatgcccagcaattttttttttttgtatttttagtagagacgaggtttcaccatgttggccaggatggtctcaatctcttgacctcgcaatctgcccgccttggcctctcaaactgctgggattacaggtgtgagccaccacatccagccagggtggaattacttaatgtagaatttatcttgccacatatttgttaaactctttcaccagagtgtttggtgctggctgtttataatatagatgtttgacaaatctcttaaaacatgcaaagccattttctttctttcttttttcagaaagtaataatcatctctgttctattcgaagcagaaaattatatttaattaagtaaaaataagattagagaaggagtgtgttgaagacccttggaagaaaaccaatgagttggttggctctgtcattttcccactggtaatattttttcagctccactggtgggagttgtaaagttttccatttaggcagagagtgaacacctttggtcatggaaagaaagccagtccttttgagatattcacttgccatgtgtgtgccttctgaagtatgagttgtatttgctgagcaattgagtcttccctgggtttctgggatcaggtgcctgcagtttgataaaataacctctagatggagcttttgcaccttttggttgagctgggttgcccgtggggcaaatccccggtaatctgagcaggatcaaaataaacttcgttactccttcttattacgtaagtattgtgtgtttgtggtgggaacactaggaaatatagatttgcaagtgggagaaaataaaaatcaccgtgcagaggtaaccagcattaccatgctggagaatagccttctgatcactttttctgtgtgtaatgaaaatggtttcatcctcgaaatccccttttgtaactttttttcacttagtaaattgtcacatcaatacagcatacaccaatcagtgtcactaaatattacaacaccttagttttataattaaagagtatctcagaacatacagtaagatgtatttaactcagaccttgtgattaaatgtttacattatttaagatttttcaccattatgaacaataccaagatgaaaactcttttttagacaaattttggctcatgtccacgattctcagagatggaactggtgttcgttgaaaatgtatgcattatgaagtccgctgatattgcctgcttagagcaggactcccacctgactagtaggagaaaatttaatcacaagggtccttaaaggtggaagaagaccaaggcagatgagggaaggttgtgagaagaactcaacctgccattgctagctttgaagatgaaggggagacctactgatcgggtaggagatgtgctctaagtaggcattattggcaggcttagtaatgcatatattttgaactaaaataaccccaatatcattaggggttattggaaatccaaagtctcaggccccatcccagacctactgatttaaaatcatgttaagatacgaagtgatttgtatacactttcagagacagggtcttggtctgttgccctggctggagtacatcagcgcgatcccagctcaccacagcctcctgaatagctgggactgcaggtgcacacaacacacttggctagcttttcaattttgttgtagagacagagtctcactatgttgcccgtgctggtctctaactcctgggctcaagcaatcctcccacctcagcctcccaaagtgctaggattataggcatgagccacagtgcctggccaaagcccaactcttaaagcacctgtattcatttgcagtctcaaccctgtgtcagactacctgtttccctagactcttgccagtaatgggcatttatccttcataaaaattattttccagatgaacgtagcaacgtgttatttgattttgtgtatctttggttactattaatgttaaattggttttcgtattagagtctcatattgcatttgtgtatcttcatttgtgaactgcctattcatggtcattcccatttttatcatttcactatttttccaaatgagaataatttttgttttgttactatatttttctgctcactgtaaaaacaattagaaaataacaaaattaaaagaatgtgatactcaccttttatgtttgctcaaaataaaattatattaaggatggcattttatggcctactttttaaacagcatattaagatacaatttatggccaggcacgatgtcctgtaatcccagcactttggtaggccaaggcgggcggatcacctgagttcaggagttcgagaccaacctggccaacatggtgaaaccctgtctctactaaacaacaaaaattagccaggtgtggtggtgggtgtgtgtgtttgaggtatgagaaccacttgaacccgggaggcaggggttgcagtgagccaagattgttccctgaactccatcctgggtgacagagcgagactccgtctcaaaaaaaacaaacagaaaaaaacaggtataatttatacatcatccaattcactgatttcatttttttagtatatttatattcacagggttgtgcaactctcaccatagtataactttagaacattttcatcactcccaaaagtaatcctatacccattagcagtcactccctatttccgctcaccctcctcgggcctgtgaaacaactaatctactctctgtctccatacatttgcctatactggacatttcatataaatggaatcatttaacgaatggtcttttgtgaccgacttccttcacttaatatatcttttcaaggatcatccattttgtagcatgtatcgatacttcgttgctttgtattgccaaactatattctgtagtgcggatataccacattttatatatatctgttcattaggtgatggatatttgagttacgtccatttcgggggttgggctatcatgaataatgctgctacgaacatgtggacatatgttgtcatttctcttaggtatatatctaaaattggaattactggatcatgtggtaattctacatttaactttttgatacagctgcagacttttccaaggcagccgcaccattttacctgaccactagtagtatgtaagatttccagcttatccacacccttgccaacatttgttatcacctgtgtatttgattagtggttttgatttgcatttccctaatgactcttgatgttgagcatctttttctgtgcttattgaccatttgtatgttttttcctggagaaatgtctattcaaaccttttgcccatttttaattgagttttcattttattattaaagtataagaatacttcataggttctgatacaagtctcttatcagacatgatttgtacattttttctcccattctgtggattgccttttcaccaacttgatggtatcattagcagcaccagggtcttgaattttgataaagtcccatttatttatttttcctttttcacttgtgcttttggtgttacacctataaaaccatcacctaacccaagctcatgaagttgctcctgtgtttccttctaagagttttaaaatcttagctcttatagtcaggtctatatattagtgtcctatggcttttacaacaaattaacaaatttggtggcatcagataacaaatttattatcttacagttccagagatcagaagtccaaaatgggtctcactagactgccatcaaggtgttggcaaaaccgcaggccttgtggaggctttaggaaaggatccctacttctggctctttccagcttctggaggctgccacattccttggttcccaggtccccttcatcttcaaagcctgcaatggcaggttgagttcctttcacaaccttccctcctctgcctggcccttccacatttaaggaaccttgtgattaattgtgcctaccttgataatctaaaataatctctgtattttaaagtcatcagagtagccatgttaattccatctgccaccttgttttccctttgctatgtaatgtaacatattcacaaatttcagggattaggacgtggacatcttggtggagacattattctgcctaccatgatctatgatttatttgtttaatggacaagtaaaaattgtatatatttatggtgtgccacatgatgttttgggtttatgtacacattgtgactgagtaaatcaagctaattcacttatgtattataagaacacttaaaatctctcttagcagtttccaagtatataatatattattattaattatagtgaccatgatgtagaatctttgatgtgttttgagttaatttgtgtgtgtatgtgggaggaagtaggggtctatcctcattcttttgcgtgtagatatccacttatcctggcaccatttgtggaaaagactattcttcccttattgatgtagcctacttttgtcttaaaatgtaacatcaaaatgttgttagtatcagcagtcaatggcatggtcactctaaaggattggataggagttcactttttggatataccatagtgtatctaggacctcccctacggttagacattgagtccaacctttcacagttaacattgtctttaagggttttgtgtttttaaaaatatattgtggacctgagccctttcccactataaatgttgtcaattatctttgaaatcattcacttctttccaccatcccagtttaagctcttagcccttttcatctggactacagccataatcttctaactggtcttccagcttccattcttgcctccctctaatcccttcgccatacaacagaagtagcctttgcaaaatgcaaatctggtcctataactgctgcccttgcccttaaagtagattctcattaagagaaagaaaaaatctctgcaacatggcccctccctttgtcctcagcccatctgatactgggctggctcccccttggttgcttctattcagccatacccccttcctctcaagtcatcaggaaggcaagtattgctcctctcacaagccaatctctctaatgaggacaatctccctatattaccatatatctttcctttgtaattcttttcacattgcaattctaaatgtatttgttgggtttcattaatgttggcatcctgcaccagacaaaaagttccgtaatgataagaattgagtctgtttttcctggttcaagcagatgataagtactgatattttcagtaaatggacaagtgaaatacattctctactgtgtatttggctttaaaaaaatttttttttatttttttatttttatttttgagacagagtctcactctggcccaggctggagtgcaatcacaatcacgtgttctcgactcactgcaactgcctcctaggttgaagtgattttcacacctcaccctcccaagtagctgggtttacaggtacatgccaccatgcccagctaatttttgtatttttagtagggatgaggtttcaccatgttcaggctggtcttgaactcctgacctcaactgatccacctacctcggccttccaaagtgctgggattacagacatgagccaccgtgcccagcctatttgtcttttaattctgtttatgatattttcaacttacagaattttaaaatatatatacaaatatataaatattttcttttgtgtttttgtcttcattatagctctgcttaaaaatccttccccacattaagaatatagaaatatagacacatttccttttacagttttcatacttccgttgtttgcataaaacctataatccacctgcaatttattttgtcattgatataaattagagaaataactttactcctcaagtggctggccacattcccaaccctttgccttcctttccttgatgatttgaagtgactcattgattgcacacgaaatccctctacatgtttagtcaggtaaatgatctgtctcttctgtcgctggttgtttttgccactgttttcattattacggcttcgtgctatgttttagtatctgacagttaccttttgtaagaaaataagatttcataaaataatactttgtgcaatttgaattaaggttttctagacagataattattgcttgaagcagtggttcccaaaccagcaggcatccacagggcttgttataacacaaatcaatgggcttaacccccagagttcctaattcataagtctgggatgaggcctgatagttgcattttaaaacaagttccctgatgatgctgatccagggaccatagttgagaacctctgccttagagcaaatacttgaaacaaagaatacagtcaacatgagaatggttccaatgcattgtctgaactagctcccctgtgtgctgtaagagttaggatgggcctgtatggtttttttgagcatctccctgattgtgtctctggcccttctcctggccccactttaaatccctgagcccagttgagccaagtaacataaccctcctttcagtgaacctgcaaggtgctcagcctaactgcatggctgccctgatagttacaagtgctgatccagccaggctttggcccctttcagatagaaatcagagaagggtaaggatgcagtgacttgctttgttgtagattctcatgattgtccttatctttgaagagaagggagagcaatcaccagaaatgcagcagagaactcttctttgctttcctcatttcccacctctgtggctctttaatggcttcttggttttgtacaaagggagagttaattactaacacctgcttctgcttctcctttcctgcatggccagctccctgactgatagccagctgctttcttgacaagagactttttccacctattccacacaatgtcagcatatgtaaagaaataaacatagtttgaacactttagccataccatatggacctctgtggagaaacctgcatcttccttcttccttcataaagaatacacattctttgcaggaggtaaaatagccttagaggtgacatctgctatggtttactcttctttattagtaagaggtagtgcacaattatattttacatgggatgtgtggttttaggcatcatatgttcattttccgtattttttgatactctcgtttgtaccactaacattttctctttttaggtcacccaaaagttaggttgaaattatttgaatttccttgaggaatataccttctgggaatttctcctctgcgttttctgttttctggtatctaagatgaaccattagaagacctcccgtcataagcagattagagtttgctataaagccctcctttgcatccgttctcttgtttggcattcattgaatcaggctatctgtgtgctgactcttggggccacagagaaaaagatgcatctcttgttatggagggctcactctgtattgatgaagacaacacattaattaacaattacaacacatcatgataaatattacactggagataatcagaggatatctggagacagaagccagggcagtgccctcagcttgacagggagcctgatgagatataactcctagaaaaagtgacatttaagggaatcattgggagcaaggaggacttgtgcatggcttcatttctcttcttaactattattacaaccattatttcattttatttacttttttttttttttttttttgagatggagtctagctctgtcgcccaggttggagtgcagtggtgtgatcttggctcactgcaacctctgcctcctgggttcaagcgattctcctgcctcagcctcccgagtaactgggattataggcatgcaccaccacgcccggctaatttttatatttttagtagagacggggtttcaccatgttggtcaggctggtctcgaactcctgacctcatgatccacctgcctcaggctcccaaagtgctgggattacaggcctgagccactgcacctggccgccttttttttttttttaaacgagtctctgtcacccaggctggagtgcagtggcaggatcttggctcactgcaacctctaactcctgggttcaagtgattctcttgtctcagcctcccgagtagatgggattacaagcacgtgccaccacactcagctaatttttgtatttttagtagagatggggtttcaccatgttggtcaggctggtctcgaactcctgacctcatgatccacctgcctcaggctcccaaagtgctgggattacaggcatgagccactgcacctggcctcctttttttttttttttttaaacgagtctctgtcacccaggctggagtgcagtggcaggatcttggctcactgcaacctctaactcctgggttcaagtgattctcctgtctcagcctcccgagtagatgggattacaagcacgtgccaccacactcagctaatgttcgtaattttagtagagatggggtttcaccatgttggccaggctggtctcgaactcctgacctcaagtgatccacccacctcagcctcccaaagtgctgcgattaccagcgtgagccactgcgcccagcctcattttatttactttttgaatagcaatacattcacatgtttgacagttcaataagtatgaaagggtatatagaaatgctgtccaccagtgtggctatttttctaatagccacattttaaaaagtaaaatgaaacaagtgaaattaattttaatactatatttttttaacccaacatattcaaaatattatttcaacatcaacccaacataaaaatatatgaatgagatattttacattcttttgcttataccaagttttcaaattgtatgaagtgcattttacacttacaggatattacaatttggaatagccgcatttccagtgctcagtatttgtgcatggctaagtggctgcagtatgagacagcacagatgtataataataaattttcctcgcatttctgtcctgaagcaactcagtttccctccctagaggtaaccattgttggtagtctccagtgtgttcttccacagatagcacatagacaagcaattataaacatgcatatgcaaataataggatggtaatcacacctctgagcatcttacttttttcactcaataaatcttggatatgtttcatatcattacataggaagcaaactcaattttttgttgttgttgcttcagggtacctcattttatggatgtcacaaattattcaattagtctctattgatgggcatttaggtggtttccaatatttggtgcttatgaacaatttgggctaagtttttagagacaaaaagcaacaggagctagctcagtgaggatgggggaatgacctttctagagaaagggagtaccaggaaagaaggtatggagcacaaggacacatggtatttgagataatttcttgtggcttaagatggctggagaatgaagtgtgtgtgaacacaagacaggaggaggaggctggaagggcaggaagagaacgtattgcaaacagtcttgtaattgtcatatgaagggatttggacttcatcccaaaggacactcatcaaaagattttaaggagcagaggagtaaaaataaatgtttgaattaataaatatatggaggaggcgggacaaatcatccatactgctgaattctggttaaatgcagaaggcatgagagaaacagaaaatcaccattagaacactgcagtaataattactgcaggcaagatctacagatgagtattaaaattagcagagaaaacaggacatttgcatagcctcaaagtatctcctctaaaatatttatgaatttgtgatggttttaacatatgttggaatattctttgatactccccctccaggaaggagatcttaattctatgggatttactgattcatttctaatgaataggctatggaaaaggaaaaatactatctttacagtggagaaacctggcagataccacctgaaccacatggtcaaggttaacatcatcagtggtaagtcatattgaaatagaatacccctgacgaatgtgataagaagggcattttgcttctatagtattcttcgtaaaaactcattaacccctgtctaatcatgaaaaaaacgttagaaaaaaacaaattgggccgggcacagtgtctcacgcctgtaatcccagcactttgggaggccgaggtaggcggatcatgaggtcaggagatggagaccatcctggctaagatggtgaaaccccatctctactaaagatacaaaagattagctgggtatggtggcgggcacttgtagtcccagctactcgggacgctgaggcaggagaatggcgtgaacccgggaggcggagcttgcagtgagccgagattgtgccactgcactccagcctgggcaacagagcaagactctgtctcaaaaaaaaaaacaaaaaaacaaaaaaaacaaattgaaggataatctaaaaagtacctaagcagtagtcctgaagagcatcaaggtcatgaaaaacaaagaaaggctgagaaatggtcacagaccaggagagaccacagaaatgtgatgactaaatgtaattgtggtctcctggattgggtcctggaatagaaaaagtacattttggagaaaaactggggaaatgtgagtctgtagtttagttaatattattgtgccaatgttaacatcttagttttcataaatgtatcatagttatgtaagatgttaacattgtgaagagatgccatgatattctgtgctgtctttgcaatttttctgtaaacctaaagttatttcaaaagaaaaaagttagaaaaaaatcaggagagtgacatgattggagtcacattttagaagatcccagtggctgcactgggaaagaggcctggaaggagaagagaacagaacaagaaggttgctacataaagtcaagaagagatgatggagggctggatgggagcagggcagcaggaatgtggggccatagacctgttggggagctctctagaaggaaactcaatcagacccaatgatggtttggatgaaaaagcgagggagtgggaagaccctgttgtcagcccctgggaattatatggataatgatgtcatttactgagatggaggaaacaggaggaagaacaggtttcagggaaacactagctcagttttagacctgttgaatttggagtacatttgaggaatgcaagtatccattaggcaactgggtatatcgacctacaggtcaggagggagacctggctacagatggttgtagagaatcacagatgtgggccgggtgtggtggctcatacctgtaatcccagcactttggcaggccaaggcaggtggatcacctgaggttgggagttcgagacctgcctgaccaacatggagaaaccctgtctctactaaaaaatacaaaattagccaggcatggtggtgcaagcctgtaatcccagctactcgggaggctgaggcaggagaattgtttgaacacaggaggcagaggttgcaatgagctgaggttgcaccattgcactccagcctgggcaacaagaatgaaactccatctcaaaaaataaaaataaaaaaagagtcatggatgtgtaaagcattggggccattggaaggataggatggcccaacaagggcagatagagaggagacagggcctagaatataggaatttaggagctaggcccagggtgtgtcaaggagtccagagcaatggtaacaaggcagtgctgtcattaagagtcaggctctggacaaaggcttttagggtcagaatgccgactgccacctaccgctgtgtgacatggagcaaattatttaataagactgttgtcatggttacatgaaactattttaaaagtttttaaaataattttagtaatactgggctcatagtgctcaacgaatgttggctgattagaggcaaaggaaatctagagccatagccctggaagctatggaaagagagtggttcaaacaggaggacatacgtttcacacccattaagatggttattgtcaaaaaagtggaaaataataagtgttgtcaaggaggtagagaaattgaaccttcatgcattgctggtgagaatgcaaaatggtgtcaccactatggagaacagtttggtagcttctcaaaaagttaaacatagaattaccgtatgattcagtgattctactcctagatatatatctaaaagaattgaaagcagggattcaaacagatacttgtacagccatggtcatagaagcattatgcgtaacagccaaatggtagaaacaatccaagtgtccattaacagatggatgaatgaacaaaatgtggtatatccatacaatggatattgcttaaccttaaaaaggaatgaagttttgatacctgttacagagtggatgaaccttgggaacatgctctgtgaaataagtcagacacaaaaggacaaatactgtagtgtatgattccacttatatgaagtacctagaccaggaaaactcatggagacagacagtagcatagaggttgccaggggcttggaggaggggaaatggagaggtagtgttcagtgaatacagagtttctgtttgggataatggaaaagttctagaaatgaatagtggtgatggctgcacaacattgtgaatgtacttaacgccactcaattgtatacttagtaatggccaaaatgataaatttatgttgtctatatgttaccacaatattaaaaggaggacatggttacagagaagtaaatgagttcttagtgattctcttttgaattttgtgacacaggggccattggtgacctttccagagcccttgcagtagagcagacaggtcaaaagattgcagtggattgaagggtgattgagaagtgtctagaccaggggctggcaaactactgtcaaatctggccgcctgtctgtttttacaaataaagttttattggaacacagctacacccattcatgtgtgtgttgtctgtggtttcctttgtgctataatggcggcgttgagtagttgctacttgagcccacgtggtctgtaaaacctaaaatatttaccatctggccttttacagaaagtttcccaacccctggctagacaacactcctggtctttcaagaactttggctttcttaaataattcctgcatttctcatgaggttactcggtagataactttgcccctttagttaggtagcagaacagaaccaaagctgaacagtaacaatgactaagaaggaggaagaggaaaaattcattcctttctttccttaactggagatattatcctcactatacctttttttctcttacagccctgtaaaaaggaatgaaagttcttccctccctgtcccccaccaaaaaactccccactggtaaatggtcatgtgactggtgataataaactttctgagatggctacgaactgcagttaggtttaaagtttcctcattaatgcaggaaaatgctcataacctgaggcttttcaagtgtttattaatttactttctggggctggctgctgatacttatttcagatcaaagagaaagcctgtgtctttagtagttactgtgtgccaggaactatgccacattttgtgcctaggtgagctcattgatagtcatcataaccataggatggcatttccctatttcacaggaggggagactagggctcaccagggttaaatactcacccagagacacacatgaagagtttgaagtacaactggagtttaacccacacctgcctaattccaggacctcagggtgtttccactgcaccgtgcagtcatcctatcctctgtggccaccaagagcctcagaatagcaccttgagcccactctaggcagaatacagtacttgatgggttctaatccattttaaaccatggtctctgctatttcaggataacaggtgaccatgtaaagtgtatctcaagtgcattgtaggctttaggaagacccttttcccagcctgctccccatgctcccaagccccactttgatggtctatgtgagtctactcagaggtagctcttatttctttaaaaccatcctgcatttcagtgtactctgacagcactgtctgacacttgggattcacttgttcccatgttaccacctatttttacattttctgcaataattcctcaagctcttggttaggcatagtgacccagggatgcagcaagagggggatataatggcttccacagttcccatccgtttgtgtctatacaactggtgcacaaacacacatcacccttgtgacttctgtccctgttgaggctgcccttgataatgcagcttttaactgcctagatttctgcaaccatcaaatcagatctaaaagggaactcagaagtcattcacccaacctttgtataagtgagaaaaataaactgcagcccagagcggactggcaacttgtccaggcaaacacagcttgtcagtcccagatcctggactaggaaggccctggctctccccgttcccagcccggagctcatcctgctgcaattcactgcctcctccctgcctcagtggacgaggtaggggctgtccccctgcatgtggcgtgcttaccttggaacccttttcatgaatgagaccagatgcagaactccacattgatcatttctgtccctcccctttctgctttctgttaaaggcagccccccagctcccagctggctcctgtcccctcccccagccgggagaagttattacatgaagagatcagcttaccagttttcttcagaacagaggctgagctcgaagcgccgggcagtacagtgagggagagccgagggaaccagcgcggtgcctagcggaactccagggctggaatcccgagacacaagtgcatctgctagctgttagcacttggcagacggagttctcctctagggtagttctaactttgggtaataatgtttgtcagctacctgatattaacattgctccacgttcaaacagcagtgttagcaagacctgggggagaggtaagccaaataaaatatcttgtcagaagttgtattttttttcagcattatatttcctcttctatctaccaagagggatcagggaatggaattttatggggtgcaaagagtaatgctttatattacttttgtaggcttctcttgccttttcttatatgaagacttcttttcttcttgaagaattttatactttctaaaatgtcattttgaagctgtctgtgcagttgccacactgggaagttgctctggccttggtgacagatgcctgtagcacgcacgcttctcctgctgtagcagaaaaaaaaaaagatgtgccatgtcagatttcgttagggactgttaccttttgagaatttttctccagtgctgcagagagaatgtacatgctaggggaattgcttttcttccctgcttttgcaacacttctctctttttttttttctttgatgtgcttagaaaaatctgtgcttaactttctatcatagatttgaagagggagaatgatatacaacagggctaggagtgtacccagatgtaccttagcagggagacatattttaagttcatgaggatgatttattattactggtttagttcatgtgattgttgggtacagtttttttttttttttaacatcagtgatacctcctggagtcagtttttgatgcaggcaaagagattgggatagatgatcattgagtccagagagggaagcaccttggtgtatccaccctcacctgcaaacaagcctgcaacgtatttccctcatccactcctttccctccttaccctgatgcctgagtaacgaaaggacagcctttctcctgcatccatcttcgtctttgaaaagccaaatgaaaagtgtatctcctaaaaaggccatgaggccacttcacagctttgccttttgttagccttgtcagggaccaagcaggctctgaaagcctaatgtaattactttcccttgtctaagaagagtggaagtgggagtgctcccaagcccacggctgcaaggctagctgtggtttcagcaggcttgttgctctgttcaaaacagacatgcagctcagagacatgcagcaacgggtcacttgttgtaggcttttcacttattagttactcatgtcctctgctctgtagacattttctgggcctgtggggggattgagcccttgaatgggagcaggaggaactgaatgggtgagtgatgctggaagctgaaagcagaccattgccctctagttgtagttgaagttcgcaatttccctgttgatttttttcgtgtgtagagtgaatgacaaatgggctggcctcactcagcctggagcatttaagcaggcgagaggagagctcatatggaaaatatttctatcaccgctgcatgcacatatggtctggggagacccccgaactgagcaaatcacagtgctccagcagcccctcagtggtgtgccaattattcttattaacagcaagcaaagggcaggctttagttacctgcacacagctgactcgtggggaaggccacgccggaatctgtgtgcccctagccttgtgtcacatgcagagtggcaaatggctctgcttcacctgacaatcagcaaagcagatgaaaaatgaaagggattatacaggctcacccaaatcttggtgcttttcagacagtgctcagcgtttgagagaggaaggcagaggttttgtcttatgagttaaaagtatgtgtgcttaacatgaatagctagaaaacccgatcagaggtagtgagatgcctgccctcctgcccctttgttccactctgctttgctaagtaaagatcctcttgggcctcttcctcttttctttcttgctttccctctttcccctagtgtgtgcatgtgtgtgcatgcgtgtgtgagtgcgtgtgtgtttctgtgctgttggctccagaacgcctgagctcctaggaaattatacaattaggattcctttttccttcttggaaatgaaatgatgaggaaggagcatgagtatgagtagcccccacctcttaaaaagaatgtagtttatatagagctttgaagaatgtggcatttatttataacagcctcttttttattgtcgtgttacttgcaaaacttacccataaacatgtggcgtcgtcactaagtcaccaggattttccttttctctgccagctggttttcttgcaggttttaattatcttccctttggatgttcctaaaaacacatgaggagaaggaagaatgggtaagaaagcgtcatacacctgggggcgcttggagggctgtgttctccacgtggggctggaagccaagcggcacactctgggaagcagtttacagtcagttttctagggtgtgaggtcctttcagataagcaggacctggcaggtggggagaggagggctgtgatgcaaagcaagccttgtttggcgtcctgtggctggcactgtcagtgctggtgactgtggtccaaggacagaacaacctggtatggtgtcagtgcatgggttggaggacagacacagaaaagaactgtgccttctttaattttcccattgccagagcattaaactcagaacagtgagatcatgagaatcccttttgtcttagtcaaggttagggtggcagtcgtgtacacttgtacagatggggcgtatccccgaaaagactgtaaaggacttttaaagtcaagctggacttttgaggcatttgtcagcgtggggagcgtgccaacgtgcagcttctttgcaggatgcagcagaatggcggggaaggggaggtgggaatgggaggcttgcattttctttcttgaacttggacttaccttctcagataagaccaatgagacattgttatatgtagggacagggagggagatgcaactagaaatctgctacattccatatttggaataatatgataaattctgcaaagtgtggtcaaaaagatgttctttaattttcttatttttgagacagagtcttgctctgtcgcccagactggagtgcagtggcacaatctcggctcactgcaagctccgcctcccgggttcacgccattttcccacttcagcctcccaagtagctgggactacaggtgcctgccgccacgcccggctaattttgtttttgtattttcagtagtgatggggtttcactgtgttagccaggatggtctcaatctcctgacctcgtgatccgcccacctcagcctcccaaagtgctgggattacaggcgtggatgttctttaattttgacggtacagtatggcaaaacctatcaaaatgaaaaataaatatcttagctgctgatgggtacagacaaggtttcttttcatggtgatgaaagtgtcttggaattaggtagtggtgatggttgcacaattttgtgactatcctaaaaactactgaaccatatcctttaaaagagcaattttatggcatgtaaattatatcacagttttttacattaaaaataaataaatgtcttttggatccagattttccatttctaagactttttatcatataggtctactctgagtgtgtaaaatgttctatgagccacctgtcataattaggtcctttccatcctactgtcctagtgataaggcatgctgtgcatttattcagaaagaatgaggtagctctagatgtgtaatgaaatgactaccaggatatgcttttaggtaggaaaagcaaattgaatgtgcataaaatgctcccattgtgtaaaatgtgttatcgactataatcaccattgcaaatgctaccaagtgtattaaccctgtgctgaaaaaagaaaggtgaaaagaccagatctttgtatttgatgagcttatactctaaaaggggcacagaatacaaacagtgaatgatcatgcaataagggtctctcattaattgcaagagcaatgggaagctacctaagaaagcaaagaaagattccacaaatgatgacatatttgaactgaggcttgaagggctgtgtgttgggggtcttcaagataacccctaagattcaattatctgtcgtgattcagtgacttagcatacattggcaatcacagctatgatttattacagtgaaagtatacgaagaaaatcaacaaaaggaaaaggttcctggggtaaagtctgggggaaacgagatggaagctcccgaggtttttttttcccagggaaggcacgcaggacccacttacttcccctagcaatgggttatgacaacacatgggaaatgttgccagctaggaagcttgttagaggcctagagcccagcatctttactggggctgaccacatgcacaccctctgcctgccagctaacaaaattccagactcccacaaggaaagcaggtgttcagcataaaccatattgtctatacagtagaggcgcagcaagcaagccacccttaccagttctgggaatgatgggaaccctccccaaatccaagttaccagatgccagcctagggccagccttgtaagcagatcttttcaaggagagcagtcaggtctgcaatcttaactcttttctgatggataagtaagcactttaagtgggaaaagagggggagcattccaggcagagggaaaacatctatagagccccagaaataagaaaggacatggcatgttctggaaacaatgcatagttcagatcacagaagcatccattgtgaggggatgtggcgggaaatttgtcagtcagctcgatcctgagaactggagtttttctctgggcctatgaaagttctcaaaattctagatctacagtcttaagattatctttttatgacgtgtcatttaggtcatcattgcaggacattttcttcttcataaattatttcctaaggagtaaatcaaattaaataatgaatgtaggactgctttgtaagcagtgacaccctttatttaaaaaactagttgtcactcttcattcctagagtgttatttgtggcaaatagaaatgaagggtcaatgtaatgaccttaatgactatttcgtggtacacaattctccctggctttgcctttctttttctagtatctaaaatagccagtcagctatgtggaactcacttgctaatgcaagacccaagtttgagctttgggtcaatcacttgggtgaaaactcaccatatgacttttctcatttaaatgtttttgttgttgttgttgagacagagtctcaccctgtcacccaggttggagagtagtggtgcgatctcagctcactgaaacctctgcctcccaggttcaagagattcttcggcttcagcctcccgagtagctgggattacaggtgcccgccaccatgctggctaatttttgtatttttagtagagatggggtttcactctggtctccaactcctgacctcaagtgatccgccctccttggcctcccaaagtgctggaattataggcatgagccaccgcaccagcctagcaatttttttacattataaaaactattgtaaaaacaaattcaagcaaacaaatacagagaataaaagttaaaggttcttctttaccctcattctctcccctatccttcttccctgccaagatgaaatcgttgttaacaatttagcatctgtccttctagaaccattcttgtacatttataaacgtaagggtatgtgcctatgtgagtgtctgtgggtttatgtgcatatgtgtatgtgtatgcctatgacttgcaatggcagagtttttccttcttttctgatacctgtgcttcttgtttctacctcatgtctaactgcatttgctagaacttccagaatacagtactgaataagataaatgaatgtgaacgttcctgtcttctactagacttttttttttttttttgagatggagttttgctcttgttgcccaggctggagtgcaatggcgtgatctcggctcactgcaacctccacctcccgggttcaagcgattctcctgcctcagcctcctgagtagctggaattacaggttttgtgccaccacacccagttaatttttgtattttcaggagagactgggtttcaccatgttggccaggctggtctcgagctcctgacctcaggtgatccacccgccttgaactctcaaaatgctgggatgagccactgcgcccagctcttccagacttaaatgggaatgtttctaatatttcatcactaagtatgatacctgtcacagatttaggtagatacattttatccagttacaagtttatttctaagtttttatcaggagtgattgctgaattttatcaaatattgtttgcctttatcaaaatgctcatatgagttgtttccattaatctacttacatagtgaatatattatggatttcttaatgtcggactgtctttgcattcttggaattaactatcttaatcatgatttcttcattaaatttgctactgtatttgatttataaatattttaaattttttcttctttttaaataagtgttattggctctcggctgtattttattgtgctagaccagggttttgatagttttgtaaaatcaattctgaagtctttcatctttttgtatgctttgaaacagttttgttttgttttttcgtttgttttttgtttggtttggttttttttttttcagatggagtctcgctctgtcgcccaggctggagtgcagtggcacgatctcagctcactgcaagctccgcctcctgggttcacgccattctcctgcctcagcctcccgagtagctgggactacaggtgcccaccgccatgcccggctaatttttttttttgtatttttttagtagagatgggtttcaccgtgttaaccaggatggtctccatctcctgacctcgtgatctgcccgcctcggcctcccaaagtgctgagattacaggcgtgagacaccatgccccggttttttttgtttgagacaagatctcactctgtcacccaggctggaagtgcagtgccccaatcacgtctcactgcagcctcaacctcccaggctcaagtaatcctcctgcctcagccttccaagtagctaggactacaggcatgcgccgccatgcctggctaattttttactttttgtagagacagggtctcactgtgttactgtgttgcccagactcgtcttgagctcctggacccaagtgatcctcccacctcagactccccaactactaagattacaggtgtgagccaccacacccagcctctgaaacagtttaaacaaccaaaaagttaccttttttttttttttgaaggtttattgaactcaaccgtaacaccatccagctctttagtggagtgatggtatttgagtatctttttaaccatttattttatttcttaaaaaggcataatactgaatatatgtaggagaacatatgtaatatataagcaattatgaagtagtataataaagcaaacacgtatgaactcaccacacaactaaagaaatcaaaattcccagtactatgcaccactccccactcatgtcctcctcgcttctctccttgaaagacaaccatcaccctgaattttatggttttcacttcattgcttttatttataatataatcacaggtgtatgtgtgtctaaagaatatgctatttgggccaggtgcagtggctcatgcctctgatcccagcactttgagaggtgcttgctagaacttccagaatgcagtactgaattggcgggtcatggagaatgtgtttgtttaactctacagttaatgtcagattgctttccacagcagttgtattagttttcatttccactagtagaatgtaaaagttctcaatgatttatctcctttccagtattaggcattatcagacaggttaatttttactgatatataagatataaaatggtatcagtgtatgctaatggacatttctctgatcattaactattgatattgtataatgtttatgtgtatacatatcattcacgtttcctcttctgtgaaatgcctgtttgtatttattttctggttttaaatttagttctttgctttttcactactgatttaagagtgctttgtgtatcttgaatatgaaccctctgctttttattccatgtaatattttctccactttatgacttgtaaagtgtctttagctaaacagaagtccttgattttagtgtatttgaatgtatccattttatttctttgtgttaacactctctttttcttgtttaggaaattattgatcccaaggttatagacatagtctcctatattgctttctaaaattattgaggttttgcacttcacagttaagtttttatacacttagagttaaattttctgtatggggtaaataagggatctaatttcatttttcattaagggatctaattttcttttttccccatattggcaatgagttactacaggaacatttattgaatagtctttccctttcaacaaatttccagggccatttcttttcagtaccaagtttccatatatatgtctatctttttctggcctctgtatttgctccattggacatttctatgtctgtacaagtaacatgctgtcttaattactatggccttataataatctgtgtagggcaaatcagttcgcattattctttgggagtgtcttagttattcttagacatttgctcttccttatgaaatttgaaattatcacatcaattttccttgaaaaatcatttaagaatttttatcagtattgtattgagtctatagatcaatatgagaacactaaaatcattctgacattgagccattctatccatgaacatagtgtataagctttacatttaattaagtcttctttgacattttctaataaagttttacaattttctacacaaaggtcttatacatctttattttatatttaatcctaggttccttatttttattataaattatgtgtatgtttttctaattaattttttattttggttgctaatgcttagaagtccaaatgatcatctggccatggtggctcatgtttgtaatgctggtagcactttgggatgctgaggcaggcagatcacgtgagcccaggagttcgagaccagccctgggtgaaacccgtctctacaaaaaaaataataataattgaaaaatagaaaaaatgttagctaggcatggtggtgtgtgcctatattcccagctactgaagaggctagggtgggaggattacctaaacacagggaggctgacgctgcagtgagccatgatcataccgcttcactccagcctgggtggcagagtaagaccctgtcttaaaaaaaaaaaaaaagtacaactgatgttatatcaaaacagctttctaaactcttattaatttaaatcagttttatgtaggaacttttgtaatttctagtacataattatgtaatctgtgaataatggccattttggcttttttccttttccaaattcttgtatatctaatttcttttttaatggccattttgagtttgtttcttttccaatttttataatttttatttcttaacctttgcaatggctagaacctccagcaaaatgttgaatgggggcagtattattttgttcctgatttgctcaagagaacacttctgacattctgccattgaaaatcaagtttgctgtaagtttatgcttgtattagctcaataaaccctcttctattcccagtgtactaagagatttattttttaaatcatgaacatgtgttgaattttatctgacacattttctctattaagatgatcatttggttttacttttttaatctgtcagtgtgataaattacagaaacagattttataatgttaaactatccttgcattccatggataaatccaacttggttatgatatatttctatttttattaaattaattttataacatgactatttttaagagggttctttaaaaaaatatatatttgagagtgcctgtaaacttttctttcttatggtttactttcctgttttgctataaggctataccagtcttataaattcatttcagaagtactgccttgttttctaatgtctggaggattttctataatataaaattattgtaatttattcctagaaagtcacctaaaaaactggctaagcctgatgtgtttttcccccacagggaaattttaaaccaccagttatttttatttaataattataggagtattaaggctttctatttattcttggaaaatgtttaaaagttaaatatgtctaggaatttgtccatttcatctacgttttccagtttattaacataaatgtgttcattataccttctaattatctacagcatctgcagatctccaggtgctgcagagcccttttttgtttcctaatattgttcaattgtgccttttattttattaaccattctttccagaatactgtaaattttactaatcttcataaaaaaatcaacttttggctttgttcttcctcttcattgaagctttgttttctattccattcaattctgctctttccgcgggtttatttatgtcatcatttttttctttaactttagtaacttttaaaatttatgtgggccgcatgtggtggctcacacctgtaatcccagcactttgggaggtcgaggtgggcagatcacttgaggtcaggagttcaagaccagactggccaacatggtaaaaccccatctctactaaaaatacaaaaattaaccaggcatggtggctggcatctgtagtcccagctacttgggaggctgaggcaggggaatcgcttgaacccaggaggtggaggttgcagtgagctgcgactgcaccattgcactccagcctgggtgacagaatgagactctgtttcagaaaaaaatatatgtgtgtgtatgttcagctcatttatttttagcctttaatctgttctaatgtattaaagatggcaattttttcttgtagtgttacttatgttgcatctcttaagttttgatatacagtatttttattattagtcagttttaaggtttttttgttttgttttaagacagagtctcactctgttgcagtggcaggatcacagctcatacagcctcaacctcctgggctgaagtgatccttccacctcagcttccccagtagctgggaccacagatgcatgccaccacatctggctaattttttaaaattttttgtagagatggggtctttctatgttgaccaagctgatcttggacttctgggctcaagcaatccttccaccttggcctcccaaagtgctgggattacacacgtgagccactgcccctggcctcagttttaaatatttttaaaatttttcattatgatattttctctgacccaagcactatttaattatatttttaagtatggagggtttcggtgtttttttaaatttgaaattaatttctaacttgattatattgtggtctgagaatgtggtatgtgcgatgctgatttttctgagatttgttgagacttgctttatggcttagtatgtgagcagcctctgtaaacacgccaagtgtgcttgagaaaaatgttggttttgatgaacattcttgataattggttcggagacttttatatttctattaaatcaaggttgtagattaggttgttcaagtcttctgtgtcttttctaatgtgcgctgcctcatctgtcagtattcgaagaagacatgttgaaacctccctccagcatctttgttggcctgtggaggggtggggcatggctgacctcagcattcttcaggcaatcctttccttgatgttagtggccactctagcttttgctcactgtacctgtggtttctgagtttagaattttttcatctctgcaatagtctgttttggtggtttcttctgctgtggtttcttgccaacataaactttctaatatccagaaattcctcagaatgttttatctggtaatcatatcctttcttgttttatagttgtcattacaacttgtgtgttttctgcgatttgaatggaattttgcaaaggaaagaggaaaacaaatacctttgctcaatctgccatcttgaccctacataagacacatttttatccttcttttcctcctttttttttttgcaataaatgtttattgggcaagtaatttttctagacctctgcttctctaccttcttcccataaaatgggaagaagaataatattcatcgcaatgacatataaggaacattaataagataatgttcatgaaagtgctttgcaaactgtaaagatttattcaaatgcaaaggatggcctttagttccttactttaactcactctccttttgtgtagccggtgttataaagcagctcagctacattagagaaaagtgattaattgtggttagcatatcgtgagaggctcaaacaaaattttattgttacttcttgagaaaatttattgccaagaaactattgaataccttaagagaaagtcacatatttaataaatgaaaatattatttagtctaaaaactaatgctacaatgagtatcttttttcctccctattgtcttatactatacttttgacatgcatactcaattaggcatttctcctttaaaaataacattttacttaaaaaaccttattttctgattcagcatattcaataaatttatttactttagcttagaaagttaatatgaagcaacagaaagaatgctgaaatttcaagcaaggcatttttaagggacaaaatgagtaattgatgtaaaagacagagtggtttatatcagaatgtattgaattctgcctgactacaatatttttcatattcctacattgcaccaaggcaaaataaacaattctgaattaaattcaacaaccatgtattgagtgctattttttgtgtcaagttttgtgctaagtgctgtggaattcataaagaggtgagacccaatctgccctctaaagacaggaaacaacaaataggttagtgagggctaagatataaattactctaataaacatatcacactcttttgtgagatcaggaacagcctatggagaaagtagcatttgagatgggattgaagaatgcttaggggtttcgtaggcagatattagaggaatgcattccaagtcatttttgtaaatgttctgtggaagcttgtaaagatgtactttccatttgtgttataaatatagttgtatataatacgtgtgcaattttccatgtaattgtatcatttcttttctctgtgtgggtatgctcttatatttcttaggttctactagaagtaactaaaattaagtgacttcctaagtatgttccagccttaacattatctgaatgtaggagtgaccactaaactacaaacacatatcataaaccccttgaatagagttgatgtcttttgtatagtgggagaaagtccatgagctttcaaacacacaggcctgagcttgactctctggttcttgcttaggcaggctacaagtaagttcactaagcatcattctctttatcttttttttttttttttttttttgagatggagtctcgctgtgtcgcccagcctggagtgcagtggcacaatctcggctcactgcaagctccgcctcccgggttcacgccattctcctgcctcagcctcccgagtagctgggactacaggcgcctgccaccacacccggctcattttttgcatttttagtagagacggagtttcaccgtgttagccaggatggtcttgatctcctgacctcgtgatccacctgcctcagcctcccaaagtgctgggattacaggcgtgagccaccgcactcggctctctttatctttaaaatgggaggatcatgtcaatatcgtagagttttagtgaagattaaggaggtgatttccgtaaagtgtttggtatgagaatatgctcaatgaatggcagctatcaccattattaaaaaattgatctctcaagcctaatggagaaagattctttatatagactaagggaattgtgaaatctgtgagtgggtatttgtccaactgaagtagaatgcaaagtgagaagaatgagagggaattaatatggagttgggggtgagggcatcacccatgagaataaaaagacaaacatgggatcctagagaggggaggtatacagtcaggaatccggagtgtagctccaaattccttaaccaaatctgatgacccacaggctccgattggagagaaaggagaagaaaatatgtaggatgctttaaaatggaatgacagagtgagcagttgagaaagaagaaagagcaaaaaccaggatttccaaagctacaagtgtccataccctcccaggtggagaaggaagggctgggaagtcactgggattttctcagcaaagggtggacccaggactccttttaaaataaacacacacacacacacacacacacacacacacacacacacacacacacacacacacaaacactcactcactctctctcttctctagagccagaaagtgatgttaagcaccaaattccagtgtcttgaatcattatttaataaggaacctcagagataatctagtctaacctactgattttacatatgaggataatgaattttttggaggttatgtggcttgcccaggaccacacagttgtttaacccagacctggagggtgaatggtctagaaacaaaataatcttcacacacccagttgtggcttctgagacctttaggcaagggaaagcttgggggtacttggaagagagtatttgtggttttaaatcagatacagtttaaaccaggtacattaaatgtgttcaaagctatttgtaagatacctcagctgtatagtttgttctgtcagtatgcttgcgctatagagatggttagttttgtacatcaaccatctgagtgtgttggaaggtggtaggaagggaagggaaggggtgaaaccatgcctcctcattaatcaacttatcatattatgattcatcaacatattatttgcagagagcctaccatgtgccaggcattattcaaagtggttcgcatatatgccgataagccagacagacaaatatcctgacctcacgttctgacactcttgctcctggaagtgtagcagaaaagcaggaacctgagaactgccagggcctaaatgtaatgttatatccgtttcacagttcctgcttcatgcctattctaagtcccacctcttccagaacacctaagcctaccacctttggtccttttttttttttttcttttctgaaacggagtttggctcttgttgcccaagctggagtacaatggcgcaatctcagctcactgcaacctccacctcctgggttcaagcaattctcctgcctcagccttctgagtagctgggattgcaggcatgtgccaccatgctcggctaattttttgtatttttagtagaaacggggtttcgccatgttagccagctggtctccaactcctaacctcaggtgatccacccgcctcggcctcccaaaatgcatctctggtctttaaatgccctttgctgtatattctataacatcaagtctcagatctggtttgacctcagttggcctcttaatagttttcccctatgaacattctggtctcccagtaagcctgtaagcagctgagactgggaaaccatctcttatatcccacatcgtcctatggtgcacagcgttggacacatgatgcgtgagtacagcgcatgtttagtgaacctttacatcaccacactggagcagaaaagctgtatcatgactgatgaggacccccatcagaggcaagaggcatggtggagtcttgctggaggacccactagcaaaaccactctggaaatctcggatagtaaagactctgttagtaccctgaaggccgcttacttggaaccgtatcttctaaatgctctgaaaacctatccaaaggcaattaaaatcacaaatatcattgaaaacatctaagaactacgtgtaagcacttcgggatagtcaggtaaaggcggccctctaattatgaagcattttgataattaatagaattctaagccaaagcttaaatccggatacacatcataatggttaagccaaataacacttaatcattttaccttttattattgataaagacaacacactgaagtagacagacagtaaagaaaaagtccacatctttttattgggtccaaataacctgattgtaaatacttagcctctgattttcatgtttcagaatttgtatgttaatgaccttagtagatgtggctttgtccagcctcaaaaagggttgctctccagccagggccccttttttccagttactgctcccatctcctttaagtatattcaactggtgagtgaactctttatcccgtgtgacaaatgcgtattgaggccctaacatgccccagacctcagatgtgctgctcatacatttgaggtagccctgacttgttttgggggtgtgggggtgggcttttccatcagttgtcttggttgatgtgccagtcagccaattccaaattgcactgagttttcttcattttacttttgtatattaaaaactaaatagttttttgcagcatcgtagaatagattagaaaccaagacttctgtttcacaatttataaaattggacaaatgtattgtcagtgattctgcaatgtttctgcccatttttccctcttcaggaagttgtagaggtaagatgccctattcctgctatgcttatgttgggcattataccagaaactgaagattcaaaggtgggtccccactcctagaagcccttcaaggggcagaggttcccagagaggaccataatccagtgtgaaaactgttgtactgtgtgtggatcaagtgtcatgagaacccacgtaacagcatggctgattctgctgaggaaagtcagggaatgtttcacagcagagaggacattcaggttagggcatgttgcctaagtaggagtttctcagttgaagaagattggaggtggaaggggagggaggtaaacttctcaggcagagggaaaagcaggtgcaaaggcaggaagtctgtagaagttcagattccattacccaaaacccttgagactcagatgtgtttcagaatttggattcttttggatattccacatattgtacattatgcgtaatacaatatatattgtatattataacatataatacaatatatagtatattataacatataatacaatatatagtataacatataatacaatatatattgtatattataacatataatacaatatatagtataacatataatacaatatatattgtatattataacatataatacaatatatattgtatattataacatataatactatatattgtatattataacatataatacaatatattgtatattatataacatccccagcaggttctagtcaaatacatgaatatatccaggacaaaaaggttaaatagtcatactaaatgggataaggaagactatcaatagtatcacatcaattaagtcatgttttgtggccaaatgagtttgaacaccaaacttacaaagagaacaaaaaacaacaaccaaaagaacaccttaggtttttaagccttttgaatcttggaatcttgaatacaaggactgtggctgcaggtccagcagatttctagagctaactctcattaagctgactgaggtcacatgctcatccctgacccagtggagataaatgtgctgattgccaggctgaagtcctgggcacaccctagaatggcaggatgctcagcctgccaggatcacaaagtgacctcagagtgctgtttgcaggaaaatggacacttagtaggtaaaaatcataagcgataattatatatgcatcacagatgtacccacataatattgactgtgtaatgcagcccagagcagaaccaggattcagaccatcatctctcctattccagagcccacatcagattaggctgctcacacatcagtggaaaacagtctgccccatgtaacccactgctcaattatgtgatacagacaattagaacttagcaaagtacataataagttgctaattgcatggagtacagtgcacccattcgttgaaatgatttagagaagtaaaagactttagcaggctggaaggatgtgttagaagtgatggtagagaccttatccctctgatttctgctccagggactctctttttttaagtttaattgcaaacaaacactgaacttgaggagggaaggattaacaggcagattttcctgggccctgaatgaacctctgaaaccacaggacataaattacagaggaatggaaacaagggggaagcatcgtctaatttattgacaagggaagaaaagcaagggaatcattaagggttagaggctctaagccagcttctgaggtgcttagaacaaagtatgatgatggcagacagaagtaagtctctatgacctcatgaaggacttgtttctctgctttcccagaggctcctagaattgaaaccaactaaagacctgaaagggcactccaagtgcatctggcccaacgctccctgattttagttacaggaaatccgaggcccaaggaggggaaaaatttgataaggttacagcttaaagaaaaataatgactaaaccatttcttttctttctttcttttttctttttctttttttctttttttttttttgctgaaattcggtagtgaattcaagttctcttaaggcacagttattctataacaatgcgtggtttggaggttgtgtgttttctctttacagggatttaataaaataaaaatgcaaactacttttgaaatagctataagtaaaaatacccagaagtctgtggtcagaggcaatgtccatgtatttccttaattcaggatcagcccacagatttcaacaccagtacttactgagcatctactttgtggtcaggtgttagatactctcctttaatctccaccagagccctctgtgacaggggttgtgggggtagacagataactagcttgctgaatataacttgttaaagggtggggcttggagtcctcagccatgttgagtgataccgtgctgccccgagagtttctgtgctgtagatcctggtctcttggactgttttccccataattccccatccctacctttcctaccctgcaagattgtgttggatataacttgctcactaggccttcaaaggccgggtcattttcccccctggtttataaattggcctcttatcccagggccccccctctttccccctgctccccgctccccctgccattcccacttggtcatcaccttgagagatctccagacattggcatttctttccatggggcacctccctgtcttttcaccctgagtacttaactgggattctttgaaaaacacatcagcagagagtactgtcatttttttttttccctaaacacttaaactcacataggtgtggaagtttatgccaaggaatcttggaaccagaagggagcaagggaccaaccctctctcgttagagatttggaaactgcaggacagatagagtaattggcccaacttcgcatagcaacgctaaaagttaatttatgaagtggacccctcactcagagcagtgcccggatagctgtggcattcataatgtggaactgccctcgactgtactggcggaccctataagaggcagcacgttgcaatcatggtgtttcctggaagcattttaagacccctgttcactagatcccagagaggtctttgctttagtttgggttcccccagacacagctgagccaaggacctgagtgccagtggttcctttggcaggtggttctactggtgaaaacaccagcagaggacagaggaagtgagataggaagggaagcggcctgatacaggggtgtgatcaagccagtagccactgtgggcaccagagctgaatcctgctggagacatctaggagtcagtgaagcacacacctcagaattacccagcaatgaagcaaggaagcaggcatatttgtccaccagctcctttttcattgttagttgagtaccgctataggagcattacctctttagcacttccaacttgctcctggacaagaacaaagacacccccccacacacacacacacacacatgaaagagagtcacagtgtttctagcaaactgccttcaggagctgagagaggaaggaatgtagcagtgcatgggcagaggatccacaagaggaagcgccatcagcggtcaaaaccagggaagccagaacagctggagagagaaagagagagagagtgtgtgtgtgtgtgtgtttgtaggtgtgtgtgggtgtgtgtgtctgtcttccccatgaatcccatcatgcttgcttcttgattttgtccatttggaagctcagaaccaatttacaccccacctctagctgttggataagaccttaagggaatgtcatctcttcacccaccttaccctttatttctcttatttatttcccttctgcctctctttctttgtatacttattattatcctgtttgtgcctttgaaagtccccttaagttcctttcttggtataggatgagtataaataaatacaaaagccaattacacaccaaaaagatacaaacttgggactagtcacaagcatctgccacactgctagctcttctctagttttacctcagaaatattttttttaacgaggactccctggtcttcacatgaaggccctgactgcatgggaaaaccacagaattcttgcccatacatcaaccttgcattgagaactgcaaataaagcaaaatgcatgttttcttcaaagtggccacagagacagatgcccatcatccccacaatgctacaaaataggatgcagcacatgggtgacatgatgagaggtccttgaaggccaagtaggatcccgggattctattttgctgaatcaggattcaggatcccatgattctgttttgctgaatcaggattcaggacctttttcaaaacaagtaaaacagaaaaataaagtgcaagtaccaacagaagcagcctccagaacttttaattgttatactcttacctctttttctctttttttttttttgttttttgtttttctttttttaattatactttaagttctagggtacatgtgcacaacgtgctagtttgtcacatatgtatacatgtgccatgttggtgcgctgcacccattaactcgtcatttacattagatatatctcctcatgctatccctcccccttcccccgaccccacaacaggtcccggtgtgtgatgttccccttcctgtgtccaagtgttctcattgttcagttcccacctatgagtgagaacacgcagtgtttggttttttgtccttgctatagtttgctgatctttctctcttttttaagaacaatctttaaaatgtttcctcctatgcatgatttttgttaacttttttactgcttgtctatagagtatatgacaaattttctttaatcagcatgtattactttaaaatggggagaaaatgaaaaagtgttgtctcatctgaatatgtttttaccataacatcccccaaaatgccttcttttctaaaaatagatgttttgctagaagcatccagggtaaaatgtggcctgccactcagaaatctaaagttttagttgttttctttgctggtcaggagccctgaagcagcggagattctgccctctgatattcatggatgtgagtgctgacccacacggaggctttctttgctatttgatttcatgtttcaagggaaatgttaagtcagatgtcactgttaaagggaaagagggaggaaaagaagaaagagagagagagagggagggaggacaggagaaagaaaccatataaatctagagtccagtcttgtttgtttctttatttggcccagtgatcaataatgtattgactaaacatctttcaaaagttatttatttataatgccttcattctaaaaagaatttaaaataatgtttacaaatgtagtgaatagaatttacaagaaaacaaataagggaggaaaatggagcaaagaggaaactgggtagaaaaaataggacatgagtaagactggtgtctaaactccgtgcctttacatctaactagagatgtgtcaaaaattttactgtgagctccctagcagccaaagcaaagaaagaaacaattgaatgtgtaactcataggtaaaaataagtgaaaggctgggtgcggtagcttaggcctgtaatccctgcactttgggagaccaagtcgggcagatcacttgaggtcaggagttgaagactagcctgaccaacatggtgaaaccctatctctactaaaaatacaaaagttagctgaacgtggtggtgtgtgcctgtaattctagctactcaggaggctgaggcaggagaatcacttgaacccaggaggcagaggttgcagtgagctgtgatcgcgccactgcattccagcctgggcgacaaagttagactctatttcaaaaaaataaaataaaataagctgatttatttatttattgagttaagtaagttggggcaataaaataaagcggataaaatatattagccctttgactcaagaagtcaataccactttttatgagaacaattaataacacctaacatcagtgaacacttcttatatgccaagcactaacctaaccaatgtaattatgacataagaacaccatgcatcaggtaaagccagttatattttaaaagtagaatttggggtttacaaatggctttctcgtttgtgttgttacttaattgctcacaacaaccctatgagagatattggtcaggaaaatatttttatatgaggaaagtaagatcacatttctaatcattgttgcacccggaatataaatccagattactcagatatactttttttttctttttttttttgagatggagtcttgttatctcacccaggctaaagtacagtggcgccatctaggctcactgcaacctctgcctcctgggttcaagcgattctcctgcctcagcctcccaagtagttgggactccaggtgcacaccaccacgcctggctaactttttgtatttttagtagagacggagtttcaccatcagatacacattttacactacttcataatctgggagcaaaaccctggtgatgggaatatggacatttggctttaggatcttaagctgagtttgttcaggtgagttgtctactcctgggcctgccattaagtggctgtgtggtgttgggcgagtccttcttctccctagagtggcagtgtcttcaactggaaaataagaaggttgatgacttgtctgggaagattcattccagctgtgacagcctgttcatctctgggtgtctgtggctccaggcagtttcccagactacactccagggtgttcccagtcattttcacattagcagttgctctgtggtacagacgtggctgcgcctctgtggatcattgaaccttcaccattgccccagcctgcttggggctagggtgtgtgggctgtgaattaaaggctgtgagacgtcagaactccctatgagcctgaggtgtcctatggggcatttccaccgtgtcggcggaacatgtttcattgttccttccttgatactttgtcttccatagattttttgaagggattcaaagtggaaagcaccagaagttggaactagacctgctgaagaactcacttttttttttttccttttaaaacttctcttgagcccaaaaatcacatggacacatcttgaattcttacaagttagccgggtctcagtgaaagggcttccctgaggggtagaatgccgcatgctcgtttcctatgcctagataaataaaccctggcccaggctttaggctccaggtttgtttctggcatccctttgcctgaaagtttctgtgttgaataaaacagaaatgtttagcaaatcccaagaaattccttatttaatggaaaaaagagatccctgggcttatatttcaaaatgtgatttccatgttcccactgcattaaggcaaggtcgcctcaccaaatccccagatgtctggtatgcttttcgaaaaatgcctgtatttagcccctagaacacattttgagtacctattgtggacaggattctcctctgagccctgcaggagatagagcagccaaatgagatggaaacccttccttcaaatttagttgtaatggttgcattagaatctataggaagtctcacctttacctacagacaagctttattcccccacgctgatcttttaaactgtacaatattgcatctctgtgtggccatctgtcctccttcatgacaatgggagattcagctgctggggttggccacaaacagcttatcttattagctaacctaccatgtatgagctgccttggcaatatccctattaattatattttctttcttcagcatcttagaagagtggggtttttcatttgcttcatgtctctgccaatcctaacctctctctcctaaaatgtttatttatcttttgttataaaagtagttgatgtttattgttgacagaaagagagagagaaacagggatggatattgcagagaaaaaattttaaaaagctatttataataaaataaaatcctaccacaacaagcttattgttgtttatattttggatttacaaaatctttagctatttatcctcaacccttgccaattatgtgaatttccagttgggtgagagtagctatattaaatagtgagcagttttcctgtatcattaaatagtcttcaaaaccttgattgttcatagctgaataacatttaatactatgggtgaagcaattattttaattgtttcctttgtgctgggattgtagattgtttctatctttttacttcaaactcacctgtagtagtggctgttgcaaggtagccacttacacagtataccactttcttccctgcatgctgggaactgcactgcatgctggaaagcacagcctggcactgggctggctctagggtaaagaaagaagagacactggcttgccctcagggagaggggtggggagctctggcgctgggcatgtatcatgtctactaatgtgatacttaatattaggagccacccccttgaagacagcggagtccaaaagggcttgctgagtcatcaaatactaagttggttcagcataatcttaggattctgtgtgttttattttccaagtcggaaagtagggttaggggtggggagaacactctccaagagaagctgactcaagctacttctcaaagaacaaagtgacacacaggaaggaggttggttgggaggggaaaggagaggtcattccaggaaaggcaaacaatgtcaagaaagggagcctggcagggttaggtatgtgccaggtctttgttctggcctgagtttaagatacctgggaaggcatgccaggagctgttcctggagaagtctgtagagggcataccctgagaggcctttgatgccccaccaaggaggacgacttcatcccaaagacttcgtgaggctgctaggggttacacatagaggcctgagcttggcagacatgcactttgggaaatacactgtggcatctgcaggagggacaacagacttagggtttctggggagagttggtgggtgaggaatccgagcctcctaggtacaggaatcatgacttgtttactgctcacccagggccttgcacagtgcctgacatgcagtaggtgcccagtatttattaaatctgggaaaagttgttaaacgaatccaggcagggaatgccaagggtggtggcagtgagaatagaagatagggatcctcttagaaagacatttaggagggacgtgggtgaaaatttttaatctgaaatccaaggaccgaagaaacttcattttttagtgaagcgcaaaaactagaaggtagctttgaaaaggcgtttgacttcaggaaccaattggccaaaggaatgtttctagacctttcaaaactttaatctgtgctttgtgaattacacagtttggttctattcaatagttccctttttccctcaaatgccacctgtgaaataagttaaacaccatactgttttaatgtaaaaatatttcctcaaatccactgtataaattaattactctttggggaataggataatctaatttcccttctacaatgtgctccattcatatgctctccattgctgtagaggtaggttatgaatcaactgtttctgaaggattatgagctataataaatgtcaatatgagctctgattgatttcctgcagcctcactagttgtgacttcatttagtaacttaatactaattgtgtcgctttgattactttgattttagctgtttccccagcacctactggagtgtctaggacaagcaaggattctaatgaatgtctgttgaatgaagggcttttaatctttttaaaatgttccatagaggattttagagaagtcggagtgaatgcctgcagttcagatgggtattgactgaagaggcgaaaccataatttcaattcttgagaaagtagcgcagaacttctctagctcactactgtatcgcagtacctcagtgcacagtagacagtcagtgaatatttgctgactgaccctgtattgtagtgtctgatggtgagccacagcccttagttcaagtatatgccttagagagtaatgcatcccttcatgtatgcattcaacatttattaagcccctattgtgtgtcaatgcaatggcaaacatttatgataggctcaagttttgaaccttgcaacaaccctggtagatattattgtcatccccttttgctgacaagcaaaatgaggcttggaaacactaaactatttttcatataattaaaaggtatgctgactccctcatctagatcctcatgatacctaacactaagttttggaaacactaaaccaagatcatataattaaaaaggtaccatccatccaattaaaaaggatccatcctcacctggatcctcatggtaccaataactgggtcctgaatctcctttcactaactaagtcagcagcgatggctatgaaggtgggcattaggatgtcaaagggactgtcacacataggtttgcatctctggcatcatgctatgtgaccctgagcagtccgtttgtctgtctgagcctcagtttgtagtgcccaggttagaggtgatacaagacctctaaacatgaggtcttatatctcatacatgaccgtgatcatctcttcacaggaggagcttcaaagtcacatttccacaggaattgatatggaaaggcatgaacaggtatagccatttttgtaatctaccatagcgattgcctgaaactgttacaatctagtccatttctctagatatcctggaatatgttctgaccaagcaggactggcagaagctgcatacctggaccacagcattatagtcttctgtggaattacctttatgcttggggctttagcgatgcatcagccgtatatagaggaagttataggaaaccgaactcatgcatctcactatcgtatttactaccagcttgttgctgagggcattgttcattttactgcaccatgggagagattactctcttgtctcagcactaggcaaacctagacttctctaaagctgggcttgtttggttttttcaattttatggatttgtaacttaggaagccaatggatttctctcttcaagttgtctgctggaaagcttaaggctgaatatgtgatctaccaccagcaaatacaaagaccatgtgacatgtattttggcactgatttcacttttagcttcatattattattcctttaaacagatctcatctgtacatactttaagttttattttgttttagtgatgagcaaaaactagaaggtagctttgaattgcatactttgtaagttgcctaaaatcctgtttgaatacagtaggtgataaataaaatcactaaaatgaatgaacaagaagagtaccttcatatacccagaaatgcactggaaatcgggacattttgtttcttcgtctttaataagttgtgtttgaagtcctacattgagccaaaattcatacctggaaactgaattctagaaagattattttggaaagcctgtagttacgtgtattaccactagatgaccttccctcattattgtctctaaagtggagctgctagttatatggactttccagaggactgtaggaaatttatgaataatccctctaaagcaacaacgacaacaacaacaaaaaagtctactttatatggtgttgagtgtacaaatatttggcaaaggaatgaaaaaagttagaaagttgtctgtctgtgggctaggctctgcctgcaagatacttacaatctaggtcagaggttcctaaatccttctcaatgccgtttgcactggccctgaggaaagtgtgaaaatgaagactattgtagagtcttacatgaagctaaatttgttcatttatatcacttctcttttattatgagattatgtcctctgcagttttttggtattaaaatgtcttttatgaaaggatagtaagagttagatagtagtcttttttgtggaaaaaaaaaaaaattgttctcacttgacaataaaaagtggacaaatccatggagccctcaaaattctttttggaaattttgttctataaaatccaatattctgaaaacctgtggttgaataagagaaaaatatttagtataatctttctcaatacatttgcatgcatcaggaccttaacagaaaatactacctgttagcatttgcagttgagctcctattaaaaaccatgtttgtttgtttgtttttaaagatgtttaggaaaacagtttaaggaacattctccttcctcccctctcactgggaattctgaatctactctttgagcaagtcaaaatacttggacctcagctcaggcccctctacacgtcacctccagaaagctacattctgctactatgttcttagcttttatgaaagatgaaacagccaattaaaaatctacttctgccttcattttgttttttgttaggacagtcatgtacatagtacatactatgaaattatgtcagtttgattgacaaccatttgattttactaaaactctgcctcctgaattcaagtgattctcctgcctcagtgttaaggacactttctcttatatcacacagtagacgttaaggaaattttagtatcctttctaatttcctttgaatttatcttttctccccctttcagataaaaagataacatgttaccttttttgccttggctaccagtggtctcaaagtcaggtgttgtactcagccagaacagctttgttatacccttaagcttgatatcttttctgtttcctggtttcttccatttttatcaaccttataatgtcttttattcagagctcccaaaagcctatattggagtgatatacaattactttttaaataaatagaatgttttatataataaatggtatttttggaaagtactggattatgcagtatgaactgtaaatgtctccagagtatattacatgattgtcctaacaaaaaaaaaaaaaacctttagtactttattaagtatttctcatattcaaaattatctcacctgtgtgctgaactagactgtaattccttttgtggaaggaaattttgttttgtatgttgttttaaatctcttgcagtttctctcgatcagtgccaggacatcagacatgctcaatgaatacttgctgattgactaatccactgatctgtgtgttctgggggagttagaaaagctttcctagaggagatgcaaagagatggccagaagacaggctgtttgccactctaatccttggcttctcacatgttaaacatgatggctaaggtctctaactttctggggcttgacagttgtaaaatacgaggaggataggagactgtgagggggtgaaagccagttttcagattcacagaggctggaaataaatttggtatatggggaagctttggagatggagaaatgctttcgaaactgtgaagtacatactatgaaattatgtctctttggtttacaaccatttggcgttactaaaactttcacttgatgccctaattcagctctaaggggtctgtcttggcatttatgaaagccattgtggactggtgcaacctttatttatttattttattttattttattttatttttgagacggagtcttgccctgttgcccaggctggagtgcagtggcatgatctcggctcactgcaacctccacctcctgagttcacgttattcttctgcctcagcctcccgagtagctgggattactggcgcccaccatgcctggctaatttttcgtgtgcggttttagtagaggtgggatttcaccatgttggccaggctgggctcaaactcctgtcctcagatgatccgatggagggaggctgctactctctaccatttcctgtgtgcctccactgtggcctcaaccctggcagttaaagccactgctcccttcccctacctggcatgtgtgagcccttctcactggattttatacccttgtgtctgtgtacattatcgatctatatagtatatatatacattatatctatctatatagtatatatattcattatatatataatgaatatatatacacacaattgataaattgaatatatatataaactctgcactggtgcatcttgtaagcggcagtgtagactccaggtggttatcttggcagtggggtagctagcaccaacatctggctgagtgcccttcttaacaggtgactcgaggtttgctaatttatagcaaggatgatgctcattatgatgtcaacctgtttgataagtgtcatgtcatttggattctgccattgatttcttttgactttatttttttaatggttaaattatataaactttgtataatgtaatccataaacatgctttgtgactttgtgactttcttttttggtggtgacaggatttcgccatgttgcccaggctggtctcaaactcctgagctcaggcaatccacctgcctcagcctcccaaagtgctaggattataggcgtaagccaccacgcccagcctatagtatactcttaagtgtactcttcttaagtggcctacgacgagcaggtaaacagccattcgatagactaaataataaatagaaaatacttgtttaggttatattgtgataatatatgatagtaaataatgaacactgttttaatgatatttggtgttatctttgcatacattaatttgacttgggggactctggactgcattaactttttttttttttttttgagacggagtcttgctgtgtcgcccaggctggagtgtagtggcacaatctcggctcactgcaagctctgcctcccgggttcaagtgattctcctgcctcagcctcccgagtagctgggactacaggcaccagctatcacacccggctaattttttgtatttttagtagagatggggtttctacgtgttagccaggatagtctcgatctcctgacctcgtgatccacccacctcagcctcccaaagtgctgggattacaggcgtgagtgcattaactttttaatcaaactagcagtaattatgttttcagtttaagataagttgcctttataaatttggggataaattggatttaggtaaggcagtgttattactttacttcttttgtattctccataacagctggctcttcatggttgtacagtagctattgttaacttgcttgaggccagctgtgtgtgagcattaccgagagccagaatgtcctcctgagaaggggctcctcacgcctgttctcatgatcatctgcgtagcagaagcctatggagttccgatgagaaagggaactggaaatccctttgagtaaacaagtccccagaagagggagagcataggtgtgaaaaataataattctaccatctaaattccatttctcagccttagttaacacaggtcagaagatctgtcatttgattaaagtcacttccctgggactgagaaaagattgctactgtactcttgaagggtgattctactccactctgtagtaaatgcctccacatggtagatcccctcaaattgggtcatgtatctctcctctgccctcaacccttgggttttatttcccatttatagctttcaaaatattggagacaccatggtttggaaggtaaaacaatagcaatgagagacacctgtttataagtagagcaattaaaaacctagctggtgaccaaacctgcccaactctatgtatattagttttctatcactatataacaaattaccacaaatttagtggcttaaaacacataaacggtggggttttttttttgaggagggtgatgctcagcatcgaatgacgaatttgtcattcacctagcatttattaagcaaccacaggatgcaaattacactgtgactaattggagatattaaaaaatcacataataatatcctgctcttaagaaatttgtgctttcccaagagagagttttcaaaaaagaatacatgtaatttgtacacagcaggcagtaagaagtatagatgtcatgctaggatagttccaaggagaggaaaattatttcagggaaatgggcatggtgacctgcgagctggacttgaaacgctagagagatatggagagatgtaggctttgtctagactataaagtaagaagtgacattgggaaagaagttaaatccttaaatggcagactctaaggcggttaggctccagagtctaagcttttctttttccagatttattgacatataattgacaaatgataattgtatatatttaaggtatcaaatgtgatgttttgatatatatatacattgtaaaatgattaccacaattcagctaattaacatatccatcacctcacatctttgtgtgggtgtgtgtggtgagaaaatgtaagatctactcaatttcaagcatacaatacagtatcattaactatagtcaccatgttgtacattagatcttcagaaattatttatcttgtgtaactgaaactttgtaccctttgactgacacctccacatctctccaacatgaagttccaccaccaaggccctggtaaccaccattctactctctgctttcatgaattcaactttttttacattccatctataagtgagatcatgcagtatttgtctttgtgtatctgactcatttcacttagcataatgtactccaggttcattcatgttattgcaaatggcaggattttcttcttttttaaagctgaataatattccattatatacatatatatgtgtgtgtgtatatatctacttatatacacatatgtgtgtgttatatatatacacacacacacaccccatattctctttatccattcatccatcaatggacacttaagttatttccatatcttggctattgtgaataatgctgaaatgaacatgggagtgcagatgactcttcaaggtaatgatttcatttcctttggatatatactcagaagagggatagctggattataaggtcattctatttttaatgctatgaagagcctgtatactgttttccttaatgaccataccagtttgcatttccatcaacaatgtacaaaggtttccttttccccacattctcaccaacacttaatcttttgtcttttggcagtagttattctaacaagtgtgaggtgatgttggattctggttttgatttacatttccttggtgattagtgatattgagcatcttttaatgtacctgttggtcatttgtatgccttactttgagaaatgtctattctgttatttgatttttttgctactgagtcaagccccttatatattttggatattatattccttatcaggatatatgttttgcaaatattagcttctattccataggttgcctttccattttgttgattgtttcatttgctgtgcagaagatttttagtctgatgcaatctcacttgtctgtttttgcttttgttgcctgtgcaacaaaaaaatattattgcctggaccagtgtcaaaaaacttttttcctcttttctcctggtagttttacagtttcagatcttacacaattcagtctttaatccatttgcattgatttttgtgtagagataagggtttgattccactcttctgcatgtggacatccagttttcccagcaccatctgagagactattctttctccattgtgtgttcttggcaccctggttgaagatcatcagttgactgtaaacgtgtgggtttatttctgggctattccgttccattggtctataagtctgtttcttatgttcataccatactgttttgattactgtagcattataatattttgaaaccagaaagtgtgatactttcagctttgttcttgctcaggattgctttggctatacaggattttttgtggttttatttgaattttaggattgtttttcagtttctgtgaaaaatgcctttgtaattttaataaggattgcattgactctgtagatcacttttggtagtatggacatctttaattcttccaatccatgaatgtagatctttctatttatttgtcttcttcactgtctttcttcaatgttttatagttttcagtgtacagatcttttacctccttagttaagtttattcctaagtatttcatttttgtaaatgagattgttttcttcatttctttttggatagttcattgttaatgtatagaagtgcaactggtttttgtatgctgatgttgtatcctgcaactttattgaatttgtttattagttttaacaggtttttttgttagggtctaggattttctatgtataagatcatgtcatctgcaaacagagacagtttgatttttttcctttcgaatttggatgccttttatttctttttcttgcttacttgctccagctagtagttcagtattatgttgaatagaagtggcaagagtggacatccttgtcttgttcttgatcttagagaaaaagctttcaatttgtcactattgagtatggctttagctgtgggcttgccatatatagccatattatgttgcggtatatttcttctatacctgatttgttagtttttatcatgaaggatgttgaattttgtcaaatgcttttttctacatcagttgagaggattatataactaactttagtccttcattctgttaatgtggtatatcacgtcttgatttgcacatgtcaaaccttccttgcatcccaaggataagtaccacttgattgtagtacatgttccttttgatgtggttttgaatttagtatactagtattttgttgaggatttttgcatctgtatctatcaagaatatcgatgctggccttataaaaagagtttggaaatgctctctccctttcagtttttttgaagggtctgggaaactttggcattaatccttctttaaaggtttggtagaattcactggtgaagccatccaatcttgacttctcattgttgagaggaattactgattctatctctttacttatcattggtctgttcagatttgctatttctttatgatttagtcttagtaggtggtatatgtttcagaatttatccttccaagttattcacctttttggcatataattatttatagtagtctcttaggatcctttttgtttctgtcatatcagttataatctctccgctttcacttctcattgtttgagcctttgactcttttcttatagtctagctaaaggtttgtcaattttgtttgtcttttcagaaacccaactcttagtttcattgatctttctgttgtttttctagttttatttcatttatttctgctataatctttattactttcttccttctgtgaattttgggctttgttttttttttcctagttctttgaggagctaaagtttctaaagttacgttgtttatttgagatccttgttttttcacagtcactataaactttcctcttagaactgcttttgctgcgtctcttataagttttgatatgttgtgtttccatttttgtttgtattaatatgtatttttattttccctttcgatttcttccttgatggttgttcaagagtggatttagaggtgcattgtttaatttccacatatttgtgaatttttcaattttcttctgcaatttctagtttcatactattttgatcagaaagatacttgatataattacactcttcttaaatttgttaagacttgttttgggcataatatatgttctatcctggaaaagattctatgtgctcttgagaagaacatgcattctgctgctgttggtagaatgttctgcacatgtctgttgggtccatttggtctatgtgttgttcaagtccactgttccttatggattttctgtctggatgatctgtttactgttagttagactggggtactaaaggcccctattattattgtaatgctgtctatttttaccttcagttctgtcaatattgggtgctccaatgttgggtgtgtatgtatttataattattatattctcttgatgattctcttgatgaattgattcctttatcatcatataatgattttctttgtctcttttgactgttcctgacttaaagtctattttaagtatagtcacctctactcttttttggttaccattcacgtggattttttttttcactttctttttttttttttttttttttttgagacaatgtctcactttgtcacccaggctgaagtgtagtggcatgatctcggctcactgcagcctccacttgaatcagttcaagtgattctcctgcctcagcctcctaagtagctgggattacaggcgtctaccaccatgcccagctaatttttgtatttttagtagagacagggttttgccacattggccaggctggtctcaaactcctgacctcagattatctgcccaccttggcctcccaaagtgctggaattatagacatgagccaccatgcccagccttgacttttttcactttcaaccagtgtttatccttaaagctaaaatgaatctctgataggcaatgtatagttgatcttgttttttaatccattcagccattcaatgtcttttgattagataatttaatctatttacttttaaaataattattgatagttaagaacttactgttaattgtttctgttttttagttccttttttcctttcttcctctctagatgtcctcatttgcaatttgacaattttttgaggtagtaggctttgattcctttctcttcgtactttgtgtgtctactagtttttatcttcatgatttccatgaggcttacataaaacatcttatatctataatagtctattttaagccgataacaagctttgattgaatttaaaaatctacatttttaacttctgttttccatattttatgttattgatattacaatttataacttttatgttgtatctctattaacaaattattgtagccatagttatttttactattttgtcttttcactttataccagaattaaaagtaatttatatgccaccattacaatattgggttattctgatttttgactatattcttaccattgttagtgagttttatactttaaaagttttcatattgctaattcgtgtctttttgtttcaacttggagaactctgtttggtatttcttgtaaggaagacctaattataatgaacttttgtttgggaaaatctctttgtcattgtaatttctgaaggacaattttagcagatatagtattcttggttgacagggttggttgtttgttcctttcggcactctgaatatatcctcactgtctcctcacctgcaaggtttctgccaagaaatccacttataatctcatggagtttcctttgtctatgaagagtcacttttctcttgttgcattgaaaattctctctttgtatttgacttttgacaatttggttataatgtgtctcagtgaagatctcttaaggttcagtctgttcggggttacttgggcatcatggacctggatgctgaatatccttcccagaattgtaaagtttcttgtcattatttctctaaacaagttttctgcctctttctctttctctgctccttctttgactctcataatgcatatattggttcacttgatggtgtcccataagtcctgtaggctttctttacacttgtttattctttttgtgtgtgtgtgtgcctcttaactagataatttcaaatgacttgtatctgagcttaccaattctttcttctgcgtgattgagtctgttgttgaagcactctattgatttttttcagttcagtcgttgtattacttagtgccaggattttttatagtttgtatttctttatcaaacttctaattttatgcatgtattatttttctgatttcatttagttatctaattcttttgtagctcattaactttaagatgattattttgaattctttgtcaagcagttcatggacctccatttctttagggttggttactgatgttctattagtttattttggcggtgtcatttttgcctgattcttcataattcatgtagccttggattgaaggggcagatacctcttctagtcttttccatctggttctggcagataaagactttctcttggctgatgggactatctctgggatcatattctactatcttgctgatgtcacacccctcaatataaatgttttatgtcacaatttctataggtcagaagtctgggcacagcatgactaggttttctgttcacggtctcactgggctgaaatcaaggcatttaccagggcaccaccctcatctagagcttggaatatttttctaagctcactggttgttgccagaattcatttccttgcatctggaagactgaagtagccatttccttgttggccctcagctgagggatgctttgagagtcctaaaggccacccacattccttgtcacatagctccctttgtcttcaatcagaaacagcatgctaaatccttctcatacttcaaacctgtgaccagaaagagaaaactatctgcttttaatcatgtgattaggtcaggccactctgataatttttctgaaggtcaactgtgccatttaacataacctaattgtgggagcaaactccaacacattcacagtcgtgggattatccagggtatgcagtacagcagaagcaggaaatctggggatcatcttagaattctgcctaccacactattctgtgtttccttcatgaagctgttgacattcgttaaaggaagctgcttatcacaaccaacaagcattatgcctagtcagtgctaggccctatggaagatataaaatgcacataggaataagcccatctctgaccctttacagttttcaaagcacttttatagctgtgatctcattttctcttttaaaaaccaaaaaacatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactcggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccgtaaaaaatgatgagttcatgtcctttgtagggacatggatgaaattggaaaccatcattctcagtaaactatcgcaagaacaaaaaaccaaacaccgcatattctcactcataggtgggaattgaacaatgagattacatggacacaggaaggggaatatcacactctggggactgtggtggggtcgggggagaggggagggatagcattgggagatatacctaaggctagatgacgagttagtgggtgcagcgcaccagcatggcacatgtatacatatgtaactaacctgcacaatgtgcacatgtaccctaaaacttagagtataataaaaaaaaaaaattaaaaaaaaaaaagaaaaaaaaaaaagaaaaaccaaaaaacagttttaccatgttttcattttataggtaaagaaaatggcagatagagaggttaaaacattaacttgaggtaacacacccagtggcttggaagctgggacttttgactcaagaatgagatcctctacctctaaaaccagtactctccctgtggcatagtttcattgtcaagaatctcattgtcaagaatcttgtcatggccgggcgcggtggctcacgcctgtaatcccagcactttgggaggccgaggtgggcggatcacgaggtcaggagatcgagaccatcctggctaacatggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaagaatcttgtcattgggaaaagtgagacacagctgaagattaggaggaaatatcatactggtgcttttatttattttttttaatttttaattttttttaatttatttatttatttttctgagacagggtctcactcctgtcacccagaatggagtacagtgatgcagtctctgcttaccacagcctcgacctcctaagctcaggtgatcctcctgcctcagcctccctagtagctggaactacaggcatgtgccaccacacccggctaatttttttgtattttttgtatttttagtagacatgggtttcaccacgttacccaggctggtctcgaattcctgggctcaaacaatccacccaccttggccttccaaagtgctaggattataggcgtgagccaccacacctggccagtgatgcttttaaatgaggcttatgttcaagggcagtatggggctggggtagcttggaatacatgtgggggagataggtatcagttatgcagagtgggagaaaaagagtgttgcagtcagggggcacagtttgagcaaagacaggaacaagcaatgtgtgttgtgggagcatggggagatctgtcaaagggttaatgactgagtgttgacaatttggtcagggaggtgggtgagtcatgggaagccttgtgagagagacccaggaatttgctgtgggatgttagacattagggaccttttgtgctttctttttttgctggagagtgatttaaaatagcagttttacaatggagagttggagattcacatagtcatgcattcactcagcaatttcaggtctgaatatatatccgaggttcattaatgccttatacagtgaatttagtggattttgaccagcatgtaaattatagaattaaatggacttgaatatattaaaggacataggatataagagtaataagtcctatttcataaaatagttccaatttgtgtgtgtttgtgtgtgtgcatacatattttgtgttttgtgtagtctggtgtgatataaattatttatttatttatttttttatttattggagacagagtctcactgtcattcaggctggagtgcaggagcacaataatggctcactgcatccttgccctcctgggttcaagggatcctcccacttcagccttccaagtagctggaaacacagtcatgcatcaccatgcccagctaactttttaactttttttggtagagatggggccccatgtgtcaccctgttgggtcatgatctcctggcctcaagcaattctccggcctcagcctcccaaagtgctgatattacaggcatgagccactacacttggcctaaaatgtatttcttactgttggtttcagtaaaaagtttgaaaaatactacccagaaaatcccttgtacatgtgtgcacagagacgagtacaataatgttgctagcagcactgtttattatcaccaataattggaaacattctcaatctccatccccacgagaatagataaataagttgtggctatgcatgtaatgaagtacagagtaacactttaaaaacaggaaaactagagccacatgtgtcatcatggacacaaataagaaatcaaatgtgaaagaaagatggtttctgaattataaatgtactatatcatttacagaaactttttaaaaatgtaaaacaataccatcaatcatttctagatctgtgcatatcagtaggaatataaatatgcatggaaattatgaatgccaaattgaagatagtggttacggctgatgaaggagagaggggaatggagttgagggaaggacgttcagtcatatctgttgggttaagacaaatctgggtgatggaaacccaagtgtttgtggtgtcattccctatctttgtctgaagacttgaaatattccgtaatacgtttgttcacagcagaatttcagaatggcatgagccagtgctggacgaagactgatttggcagcttgtaataatgtagttttgaggccgtgtggacctggactaggttgataggaataggccattctcattatgcagccataaaaaggaacatgatcatgtcctttgcaggaacacggatggagctggaagccattatcctcagcaaactaacgcaggaacagaaaaccaaatactgcatgttctcacttataagtgggacctgaatgatgagaacacatggacacatggtggggaacaactggggcctgtcagaacgggtgggtggggggagggagagcatcaggaagaatagctaatggatgctgggcttaatacctgggtgatgggatgatctgtgcagcaaaccaccatggaacatgtttacctatgtaacaaacatgcacatcctgcacatgcaccctgaacttaagagctgaagaagggacaggcacgatggctcacgcctgtaatcccagcactttgggaggccaaggcaggcggatcatgaggttaggagatcaagaccatcctggctaacacggtgaaaccctgtctctactaaaaatacaaaaaaaaattagccgggcatggtcgtgggcacctgtagtcccagctactcaggaggctgaggcaggagaatggcttgaacccgggaggcagagcttgcagtgagccaagatcacgccactgcattccagcctgggcgacagagcaagactccatctcaaaaaaaaaaaaaaaaaaaaaaaaaaaaaaaagttgaagaaaaaaaagaatagtccgttctcatatgacagtatgtatgataacagtaatgacaatatcttgtgttgtgaaagggcttttcaaaatagaaaagcacttctatagacttcctcttacctattgtcacaaaataggcaaggcaattgtttattatgaacctcagaaagctggaatttggagaaagtcagtgactgaaggtaagacagtagtgtgtggtggagttcggaattgcaattggctgtccatggcttttctagcctttcaaggctgccctgttgtgcctacctttggtctaagctcaagtgtcattctttacatctccttctgttttctgtttatgcatgtcacaaacatataactatgtgataagattttgatcgctcagacagcttcacttctcacacagcaagagcattgctataccgatcctcttggctgactcccatctgcaaggtagaggagcagatcatcccctgggcttccctgtcacacatgtgacatgctccatgtgtggcagatgacactgaaagggagagttcaaggacaaacacctggtgaattcatgctggtgaagctccaggagatgtcagagggcagctgttgggagtatgaggcccagtgtaaccttctgcaagaatgtttgcaaccagcctatttgtgggagagatgttcagactgcggccagatttttttttagaaaaaaaaaaaatcaataaatccagatatgttccatataccaaaaactgagaaacaaaaaagtgggtatataacaaaaaggcagcaggtaaataggtaaatgggaatggtattgttcagaagtggtttcattacagaaataaaggaagaaaagaagaaaacaaatgtttgtgggcctgatgggtgacaggcaccatgtcgtgttttcatgaacattatttcgtgtaattttcccatccctatgaggcagatgttaatgcccctcattttaaagacgaggaaaagagagctgggggattagcttgttggcccaaggtcactggctagcatgtgatgtagccaggatttgagctacggtttttctccatagcttgcaatgtttcctccatatcacacagcagtaacattgaaagagaaaagtacacacatttctaagccaacatgtggccaccatgggaagaagcagagaggaagtttggatcttttggcagggaaaccatttgaggttcttgacagttgttgaggtgaatgccctgttcccccatgttccaccagcagtgaagcccatgatgggcaggagctgcaggacgcagtggcagggagaaggctgttggcagcccccagagccatctgagcgtgtgcacagccacatggccctgccgccccaggaattgagctgttacttgtctgtagaggtgctaggagaagctgtttgcccggcatgacaagttggaattcagaacacattttcccacagaaaccatgccctcctgggtagttgggttctggtctccagaaaaacaacagaattgtgtcactgttctatacgtggtgatcgggttcccagacctgtctataaaagtgaatacactgtgggctggattcacttttatagataggtctgggaacccaatcaccatttacagaatgcattttgtgggaaaacacgttcatagttcagctttcaaatgtttggaacgtagcctgcctctaggttgagaacagcatgcattagaatattgagcatcgaggtgttacaagtcctgagtttcagtgctgactgagaggaggggtgaggagtaacatttagcaagcagccacacggaccccatgctgagctgactgtcctgcctgccctctctcatcgcgttccagcttagttctgtgaggtcagcaggagcatctttgttttaatgcagagcagttggaatgttggagagattcattaacttttccaagggtatgcacctagcgaaaatagagatttgaacctcaggttctttccagagagggtcagagccaaatctaaatcaagtggagaagtgagcagaggaagtgagcagaggtttctatcctgtccccagccttatctctttgtccattgtgataaaaagagcctgtaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatagcgtgaacccgggaggcggagcttgcagtgagccgagatcccgccactgcactccagcctgggcgacagagagagactccgtctcaaaaaaaaaaaaaaaaaaaaaaaaaaaaaaaaaaaaaaaaaaaaaaaaaaacctgtaagaaaccctcatgggtgaccttttaaaagcaccctaactcgctggagacagtgtgacaaggcaggatgacagtgccctcctacctgttcctgctcttctgtcctcggtgtttggatgcaaattcttactatcagctggggaatggtggctcacacctgtaatcccagcactttgggaggccgaggtgggtggattacaagagcccaggagtttgagaccaaccaacctgggcaacatggcaaaaccctgtctctatagaaaaaaaatgcaaaaattagccaggcatggtggcatgtgcctgtagtcccagctacttgggaggctgaggtgggaagattgcttgagcctgggaggtcgagactgcagtgagccatgattgcgccactgcactccagcctggacaacaacacaagatcctgacaccccttcccacccccccggcaaaaaaaaaatcttactacccaaattagtgactgtttgaaatcactaagaatgggggctgatgagaaagagggaagaggggaaaggtgcccaggaacaggagggacttgagagggtggtgaggtggggcagctggacatgagctgcacaatggtgctgaatgcagctcagcatgggggttgccttttcctgcccggtccctctctctgccccttctgcctcacagcctagggatccactggactcttatttcctttcactccagtctgttcccaagcctggatgaatccttttttttttttttcctgagataaagtgtcactgttgcccaagctggagtgcaatggcacgatctcagttcactgcaacctccaactcccgggttcaaactattctcctgcctcagcttccccagtagctgagattacaggcatttgccaccacgactggctaatttttgtatttttagtagagacagggtttcaccatgttggctgggctgttcttgaactcctgacctcatgatccacccacctcggcctcccctcttagtagctgggatttctgccctctgtgagccagcctctgcctgagctccagagtatccagcccgacccaggtgtgcccaaatgatccaggcttccaaaatcaaagaggctccccacattgccttaggtggagaccttaggcctcttccctggggtctcagctgcttcccaggcttcagcagcagacatgggaaagctgtgctccagatcgctggtgctcagacctccatgtatcgaacaagcattaacccatttcctaccccatatcagtattgtgtgatgtgcatgaggggaaataagatacagtcttggtctggaggacttcctagtcaagaaagagagatagaagttaacaaagtatattttatgcatgagggatatacaaggagctcgggagcggaaataagtgagcagctgagtctcctttgggagggagggattggggaaggcttctctgaagaggtgacatctgagctaggtgtcaaagaagaaggaagcatttaccagctatctagggggtcagtcaatcccagtggtgggaactaagtggtgatatggtataaacaggaaaagtttggaatagagaacaaagatgagctgagtttgaaaagtcagctagtttcttactaaactaaatgtatgagcttctctctttaatcagattgggattggaagctctcttctatacaagtaatgggtgattgctggaaaggtactatgagtggacaggcctggaagtcagacactgtgaatcctaaagatttgttttaacaaggtgataagctttggctgtgtccccatccaaatctcaacttgaattgtatctcccagaattcccatgtgttgtggagggacccggcaggaggtaatttaatgatgggggctggccttttccgtgctggtctcatgatagttaataagtctcatgagatctgatgggtttattagaggtttccgcttttgcttcttcctcatttttctcttgccaccaccatgtaagaagtgcctttcgcctcctgccatgattcggaggcctacccagccatgtggaactgtaagtccaattaaacctctttttgttcccagtttcaaatgtctttatcagcagctttaaaatgaactaatacacaagccatatgttcagaacttggaagctcagagggcctaaaattgcacatgtgtgtatgcaagtccaggggatgcagattgtatttccaaagagtcctgttaagtggagaacattctcccttgaattattgagcagaagactcccccaactccatcaccccaagatctgctagttcaacgccctccatttaaagacggtagctactgttatacccattctacagatgaggaaaccaagacccaaagaagctaagaaacttgcccaaggtctgcgaaagtgacagaaagggacttgtgtctgtgtttttgttaactatgcacatcgatttgactgagagacatagcacagtttttcgctggtgaccgtttcagcatctgctaaccatgaaagtcaggacatgcatcatccatcctacctcactgttgcttcttttccagcaaaagttcagttttgtttgttttgaatttttaaaatcacaaccagaatgtccttgaggtattccttgtttgtgcttttatcttgtgagtatttgtttcatcctttattaaaaacatgtctttagaggaatcactgtctgtggtggttgagtgaaatgttggggcgacttctattttgctgatgggtttgaggggagagtggccttccacaaatgacacagtgtgtgtcacccttctgtgggtaggaacgcagtcagattgtgacattgttgtggttttctctctttcttcttcttctccaagtacaaacacaagataattatccaaaggccttttttttatgaaagtcttccaccacattccagaagtggccatctgtttttctgatgcactaaatgcatcagtgcctcatcttccagaaggttctgtgaaagcttattgctaagagttttgtattttataaactgagttgccattcagattgtccatagtatcaacttaacactggctccatggggacagaataagatattagttctatctagttactccagattgagtcacttgtgggaactctttgaattctaaagtttcctggtgtggacagggtctaggttgatcctaaagacaaaaatctttaggctcaattgggccaaattgttaatgatagaaccaccttctgtttgtttccccttctacatggtagggttagaatcctgcgggcctcctggctggggagcgcagctctgttttggagacagcagaagcatgtagcagcagagggaggtggaagagtggcaatggtttgtcgggcccctaggtgaccctggttctcctggcttggaatgctgttgtttaagagcagcagccaaagagggcgtgtggggaagaaggaaagcagccaaggaacattgaagccacaagctttagggaacagggctgggtgaggcaaaggggagctcttgctaaaccaaaatatttaactagatttcacttttttctgtcagtccaaattctttgtttgaaagtttcactttgaagttgtttcttttcttattgttccaaaaaatactgttgttttaatcttgtttctgggtggggccattgaccatttagattatttctaaattatagcattaaatgtctcaaattcttggggacgttttctgtcacaggccttccttggtgctacccggaatctcctgtctcaagtaggcaagaatatgtgtaagaacagcctggctgaaactgacaattggactctttagcaattgatatgtattataccttgcaaattttcagagattcagaaagttgctaaataggtacaggcacgtgcacacacacacacccacagatatatgtgtgtatatataccaaaatacacatgtggtaacatatacatgcagctcttctagacttctttacagagtgtttatgccagctatttctatagacaacatacattataaaaggcataataacagaggtcattttaaggatcattagacttttaaagaaatagctttttaccaaaaatcgtgtatacaaagaaagcacttttaatactttgtttggaagaacaggaggagaagactcctggtcaaaccacctagttctgatgacttagtttctcctgcatatgtcccacccccaagtattggatgacactgacgaatttttaacaagctcgacgccttatgtgagaagtgtctcttccctctttggcctcctagggtgggaaagcagatcccttctcgtccccaggcgtggcttccaagatgccagggccctgcgatgtgtgtctcatcagggaacacctctgtgtcagccccaaaggaagtgagttcagacgctccctggaattgcttttcatttctccctcagatatttagtgagcgccagacatttagtgggctcttactatggtcccaatcctgtgctgggccctaggatcacccagatgaataagtcatggttcaggccttcaaggtgctcccaggctttcaggggaacaagaagtgttcctagtgcaggctaagctgagcaaagaggaccggtcaagagatggaagccaggctatcttggtgggcagagccctgggggttaggaaaggcttcgccgagccagttttaaagttagaccttgaaagactgctaagaattggtcaggaagatgagcaagaagacccttccaggccaaggtagcaagagcaagtactaagggcagaaggtatccagcccatgatacatttgaagagtgctagtttgactagagtggcgacatcatgacattttaaaagtcaaacgggacacatccctgaggccatgagtttgaccttttgactataggcattgatgggtactgagacaaggaaggccaggaggtatacgtgatatcaagtataaatatgctagaggactcattgtaaaggccaggagttgactgaagactggggagaagggtccaccgttttgcagacgtcatttctccattccctgctacactctctttgtgccccaccctgtgctttgggctggaatcttccacagttcttcctgtttctcttaggtgttttttgtttgtttgttttgtttttttgttttgagacagggtctcactctgtcacccagtgtgtagtgcgagatcatagctcaatgcagcctcaatctcctgggctcaggtgatcctcctgccacagcctccctactagctgggactacaggcacataccaccccacccagctaatttttgtattttttgtagagacagggtttcgccctgttgcccaggctggtctcgaactcctgggctcaagcaaccctcccacctccacctcccaaagtgctgggattacaagttgagccaccgcatctgaccggaacttattttttaaagattgacaaaggcatgtgtcacttatgttaggaacaccccagcttaagtcctgcccactttatgacaactttttcaactaatccgatttgctccgaccttttttccccctctgaactccacttgcactactgtcagtatttaaaggtaggaccacttgacaaaccttagtaaaaccataaatgttactgggtacaagaatttcatgtggcttagttctgtctccgaagctaaattgtaaatctttgagactatgttttatatttctttggaatccaatctgttgtctctagcatggtgtaatgctggttacacagtatatacaagataaatatttgattgatttgctgtattttttttccatccaagtagaaatatggatgcttgtcccctgcggagagtccaagtcctctgagctgacatcatacacagagcccacttcctgtctaactattttttcacattgtcacatactcatgagcccctgatatgccaggccctgttcatccacatcataatgctttctcttcactcctagatttaaggttcaaacccaggcaaactgttgttctggccagaccttaaccacctgtgaggtcatagaaatgctatggagtatctcaagggtagaaaggcccttaaaccaggaatgctgcccaaatactaacgcaggctaattacatgccatcaagcccgtggtatgtgctcccctggcaaggccctgctccattttcttcataaaacctgatgaggagcattttataaattaagagctgttcccttctgccgctcagccgctccagtggactctggcagtgggccaggaggaacgtgtgtgcattcaagggcaaatgtcatctctctgcattgtgtggagaggcccactttgagccgaaacactgggagccgcataaagccccaatgtcttccccacaatgccccccagtatgggaagctcctttccagctgcagagccacaaatcttctcaccaagagacactttggctctctgtttgaccataagctctcacatctcaaattctaaaacatccaggcgtggttagtgtcttctttctgttatgactccatctggtgaaagcctatttcactttccttccaaagtgactgattttgggcagccaaagtgtttcttttttaagactaaaacagcaattaagattctgcagcattccgtggggaaatgctactaattagctacagtcaatactgtggattagtgttctgtgcaagacttactcactcagaaagctctgtatttcaaagtcttgctctcctcctggagtacctgccttctagtctttgaatggtcaaatcttaccatctttactagctcaggtacatctcctccaggaaaccttctgtgatttctgctatactccccttctgaattcccgtaggttttgtttgctcttctcttggaattcttgtcattgtcttctttgtcttaatacatgacctttactcttctgtaagatccttgagggaagaatctgtgtctgaatcatcataagccccacagtacctggtataatgccttacacatatgaggcactttctaaatatctggagtagaaaaagaatgattgggaattattaatcacacccaaccattttcagtgacccccaaaactggttcatgttatgcagtgatgatgatgacaatgacaattaaagtagtaacaacagccatcattaactgaacactcattacattctagacactacattctgcatttcacctgcattatctcagttaataccctattatcatgcctgtctttttttttctttctttctttttttttttgagacagagtcttgctctgtcgcctaggctggactggagtgctgtggcgcaatctcagctcactgaaacctccacctcccgggttcaaacgattcacctgcctcagcctcctgagtagctgggattacaggcactcaccaccatgcctggctaatttttgtatttttagtagataggagatttcaccatgttggtcaggctggtctcaaactcctgaccccaggtgatccacccgtcttggcctcctgaagtgctggcattacaggcatgagccactgtacccaacctatcatgcctatcttaaagatgaggaaacttggttttggtgagaataaataacttgcccaacaaccagtgagataattaaatgataaaatgagtgcatgttggaagcgagatttgagtccaggctcatgtgatgacagagcaagagccattaccattctgttctactaaagactatcatttaacacttcctgctgtgtgtgagagcagatcctctccctttattgcctcaatgattggctgggggtagtggggagaattgatgcatttatgaaatcagcctagaatggaagcctttagcagctagagaaagcactccaggatagctactctcacaccactccaggggttgctcccttatggcctccatggagcttccaagacaagggggcagaaaactgggtgagcatgtccaggctgccggactttgcaaggcactgtcatgggcctgccaagactctgctcctgttggccgctttataaatgactgtaattgcaccagtctttggtgaaagactttgaacttaataaaaatgtcaaactcattaagagcgttttcaagaccaaataaactctgaagaggctgtaatctttgatgacttcagatttgtgaatcacaaggacgtggaaaaaatctagctgccctgtacagagctactgaaatgtcactatttattgcttcagcgtcatctggtaatggaagtttggttgcgagatcagaaatctctcctgaaaatatcatagcactctttttctttactgtgtcaaagcagctgtgtgcgtgagcagctctgtatgtgccacaaagcagtatctagaataaacacaagtttgattagcctggagtcatgtccagaatctcattatattggaaatgtttaaagttagactgaaagggctttttttctcttcagggtagcttaggaaaaccatgtgaaaagcagcattattctggagaagacttcacatgatgtaggaggtgggatttcagctggatcttaaatgttgggtttggagtggcagagttctaggagacagaaaatgagttgtgggtaagaacagacaggaggggtgaggacagtaataaagaacaggggtggtctggagctaaaggtctttgtacttgagacactgaaggagccaaaaaataattaatatactgttagcaacttattatagtcctcttagatgctaaattatgatgtagacattttgaaaaatggtctcggccaggcgcagtggctcatgcctctaatcccagcactttgggaggctgagatgggcagatcacctgaggtcgggagttcaagaccaacctgaccaacatggagaaaccccgtctctactaaaaatacaaaattagccaggtgtggtggcgcatgcctctaatcccagctactcaggaggctgaggcaggagaatctctcaaacccgggaggcagaggttgcagtgagccaagatcacatcgttgcactccagcctggacaataagagtgaaactctgtctcaaaaaaaaaaaaaaaaaaaaaaaaaaatgaaaaagaaaaacagtctctatccccacagcaatcctataaggtaaatgttacgttcagtttagagaccactaaaaccaaggctcctgcaagcctgtacaggcagaaggcagattggtggctgccaggggctgggagtagaagggaatgggcagtgactgctaatggttatggttatggggtttcttttttggggtgatgaggtattccagaattggatagttttgactgttgtaccactttgtgaatatactactgagttgtacattttaaaaggataacttgtctggtatatgaattatatctcaaataaggaggggaaaaaacataaggctcaaagagatcaagtgacattcccaagcttatgtagccactggtgagaaggcaaactggggtttgaacccagggctttctggctctaaagcttgtgctctttccccgctatgttgcctctgtcctttcaggacctgtgagggcttagcggtgaggttggctacaaacttttggtcaaagaataaaatgcatttttgctacaaatgcaatgatgtctgacaggtacaatgtagaactgatgtagagctttgctccttggttcagctaaaaccaggtttttgtcacaccaccaggaatgattaggaacacagacacattgaagggtgaggggaatggaatttactgggcaaaaagaaaaaaaactctctgcaaagcaagaggggatcctgctaatgggcccccaccgcacagattgaacaccaggtcaccacacaggaactaaagaagccaggctcctttccctgcacacagcacgaacttcccgtggctccaccccgttctcccagtgcagaggtgggtcagagattctccagggaccctcccctttatctgcctcctgcatctatcagaaccaagtgggtcatgagatgcgtagttaagttttgagtggaaggttactcccaagacactggctttgaagagagcaagaccaaatctgcaccccgccatggtcaggaggggaatcctaatatggaggctcccataggttcagggactggctgagcaagccgatgggatttttggtgcctgaagctggtgggctgtgacaggtagggtctttggaagggggccagattatgaatggcttgaaatgcctctccctctggtgggagaatttgaatttgacgcagtgggcatgggccatggtgcattaggaagacaattgctgttattggaaggttcttctggcagtatataaagggtgggttaggctgaagagagagtggtcagagaggctagctgtggtcatccaggcatgagttaaggagaattcagtccaaggttttagtaatggaaatggagagaagaactgaatatgggcaagaattagaagaaagaaaaaatagccttggccacagatgaaggagagaaaagaggtatagaacactcttaagttgctctcctttttaactttgggttttctaagactagaaacatgaaagtgctgaagatgggcatgaaaaataatggagaggaaaaccatggggatagtgaagataatgaaataagtttgggccctaatgagtttggggtggtgacatgaagatttattaaaagttttgctagtgttctgcccagaccctcagcccagacaggtgcagcctttttcttcctcccactttaggaaggcaaggtctgattgatgtgccaatgagaaatatgaaagtgtaagaacactagaaattcaatgcatttttataacactttgtaatttacagattgttttgccatcttttattctatttattgtcacacagttttatcgtaatccttccacaatggttactttaccctacatgaaaccatatagttggacttactatggcattttattcagcagtttgagaatttcagaccaaatgtatttaaatccaagagatgacctcagatgagtgacacagggaattcaagaggaagaattagaaaggcctaggatattctaatgcaaggtaagacacccacacaagtacctggtgaaatgtgtattatctatatcaaatcagcaaatgcctcatttaaacttagaggagcccaaggaaagttctagcaagcaagggctaggaaatgtatatgtatcattcaatgtcagttatttactgttttaagttatacaaaatgtcacttgtaatatgcaagccagaagactgtggagtgtcatctttgaagtgccaaaagtgaaaacaaaaacaaaaacaaaaaaaaaacctgtcaacatagaattctatatccagtgaaaatactctttatcaacaatggcagaagaaatgctatggagaaaaataaagcaataaaggtcagtaggaaatgaatggggagtgggttctcagttttaagtagaatggtagaggaagacctttttgggaaggcagtatttgctccgagacccaaaggaggtaaggtggttgccatgtaaacaaaggggagaacattccaggtagaggaaataacaagcagaaagacccaagaaaggtgcatctcttacatgtttaagaaacaacaaggtgaccagcgtcactggaacagaaggatcaaggaagagaagataaggagataatgtcctgaagttgacagggaccagaccgtgcagggcattataggaagaataagtatatattttgtttgcctgggaccatccacatttatacctactgtcctaatattattatcaaaacgtcctggtttggatgagaaacttcagagtcgttctaagtataggtcatgtaaagactttggcctctaggtggattgagatgggagcccctgaggggtttcacccagagctctggctctaatatgatcattctgactgccgtgtggggaacagacaataagtggacagaacagaagaagaagtgcccattactaactactgaacaaacccaagtgagggggaagatggcttggaccacatggcagcagtggcagtggtgggataacagcaaaccttcagcctgaacagggggaaggatgaagtagccagcagctgtgatggggaagactgggaagaacggctttgggaggaaagatcgagaactagattttagactgtaaagtttctagggccttttggacacctaagtaaagatgtcagagagccagtgagtgtaaaagtctgaggtttgggagagcttcaggttggagatgtaaatgtagtattcaatgccaagaggcaagatgagattaccaagtgtagacagaggagagatggaggtcaaagaactgagccctgggatgctccgatgcttgaagtctgagaaatggggaggaaggcacaggagactgagaagtagcaaccagagacagagagacaaaaccaacggagtgagctgtgcctgaggctacttgaagaaagtatttgaagcagggaggagtcatcacctgggccaagtgttctgttaggtcagggaaaataaggactcatcattggccatcagatttagtgatttggcatcactggtaaccttgacaaaggaaatgtcttcatgtagtgagggcagaagcttgactctgggtagttgaagagaaaatactgtctctgtttttgtttttgttttttggttacttttttgttgtttttctgctctccctcttcttggttcttgcgaagagcaaaagacaaaggtgattcctccaagaaacctcttctaaactactttgtgcagtggcagggcagagagaccacataagttgtattattttctgttgttggtgtctggctccttttgggggtaggagtattttgcagcagtgtgataattaattttatattccttgtcacttaggcttctatggcaaagtgaatgcagtttggaggcacaaactccagcaaggaggcaggataaactgctcagaggaataagacctcccagaaataacatttcaaatggcaattgtttatttatttatttatttatttattttttgagacggagtttcactcttgttgcccaggccagagtgcaatggcatgatctcggctcaccgcaacctccacctcccgggttcaagcaattctcctgcctcagcctcccgagtagctgggattacaggcatgtgccaccacgcctggctaattttgtatttttagtggagatgggttttctccttgttggttaggctggtttcaaactcccgacctcaggtgatccacctgcctcagcctcccagagtgctgggattacaggcgtgagccaccatgcccagcctcaaatggcaattgtattgtagctgtccttaaaattgggagatcaaatctgaaaacattttggaggaggggaaaaagcaggactggatgacagcttggctttagggatgcatgagtggaatactctgaagattttggagaaaccaaaagctcagcaatgctccaacagaagtgtattggtaggaaaagatgggccagctgggggccacatggtaagttccatttggggcctttgaaggagatacaaatggagatacagtatcagagatgctctgacactggctgacaccagagagccgttatgcctaaatatggatccaggagtctctgaccagaagtggtggaggaactcgtgtttcacaggagaggtggaattttaggagcttctccagaggttggggaaagacagcttggctgtcttgagaataagtggtaatgaggaagatcacaggcagatggtccagcttgcaaaaatgctcaaaggcaagaatggatggcatttgtaaatgacaaggagcctgagaggtgaccatggtaagttaagatgttaacataggaaagtctcctgtactcctttgacgaactgccaaggcccaagtatcatgcccaacacttgaggattcaaaggtgagaaaggtatgttgtccacacttgaagtagttccctgtcattccggtgaaacagacgtgtgtggtcatcacagcacaaagcatgataaggattataattggggaatgaggagggtgctcaggaaagcaccggtgtggcagagccttacccaacccccagtcacaacggaggtgtggccttagagccgtactgagtagggcttaatgaggcgtgggtatggggcacctatgatgttttccaggtggacaaacatgagggcatgtggaagggcatgagaggtcctgggaggtaggagttcagaattaaggaagtgcctagaatctggaggagagcaagaagtgagtagagtgtgctcagggagaggaggacaggactcatgtgttatgtgcctgctgtctaacagtctctttgccaaggttttcatattgtttcagtgtagttgtgatctttccattttaaaaaatatatacttagcctgggctgggtggcttacacctgtaatcccagcactttgggaggccaaggcgggcggatcacgaggtcaggagttcaagatgagcctggccaacgtggtgaaaccctgtctctactaaaaatacaaaaaattagcggggcgtggtggcaggcacctgtaatgccagctacttgtggggccgaggcaggagaattgtttgaacccgggaggcggtggttgcggtgagctgagatcgcgccactatactccagcctgggggacagagcaaaactctgtctcaaaaaaaaaaaaaaaatatatatatatacacacacacacacacacacacacacacacacactcattgtagaaaaatgataaaactcaaaaagtagaaagaagaaaatcctccattgttagcgtcctgatgtacttctttctggattatataaattctctaccatcctttcattacttaacattataaaagggatttcccacattattacaaattctctgtcaacatcattttaagcaatctcttacacacatgatatgagcatgcaataatttatttaatcatttccctaatgctgtgcatttgagttgtttccagttttctgtaaatataaattaagctattataaacatacttgtctttaaatctttggccttgtttcggattatgcctttaggattggtttccattattggagtgactgggtcagaggccatgagcattttaagtgtcttgatccctatcaaaggtaaatggctttccaaaaagtccttctaatctctgtttctactgccagcatctcacctcatactctccaaaaatgaatattataatttaaaatttgctatcacttaatcctcatgatacaatcatgcagtgagtattctaatgcaatgactattatccccaatatgtagataaggaaagtggggccggtggatgatttcacacgccccatttcacagagttagtaaggcggtcagaaccaaggcctggtttggctaactcaagaggacatcagtctctccctgggcaggtgatgagccccacagaaggattttaaatctggaaagtgacataaagtccaggatccccttggcttgctcttcttagtgctggcttatctattggtaatgatctaaagaacattaactaccagctgacgccagagaactctttcttaacacactgttgttcttcagagcatgtatgaactgaagactggtaatgtgaagacaggggaaaaaaagaatagaggatgtaatgtaggttattaatgcaataagtaacacatatatgaattcatacaaattagttaacaaatacaagccactgcaggactttctaaacagcactgtatagttcatcactgtggaaggggtcatttcactaggagtaaagtcaaatttctcttagctcagccctgtccctgattcctcagcatctcttcaggttttgttcagacctgaaggtcagaggtaacagacttccagggccagggtcacctcttgatttaacttgggctgtggccagattagccacattgatctgctctcttggaagcctgaagaagccagtaatctcacttgggcacacatggagggagagagtataagaaaaaaaacaacaggccgggcgcagtggctcacgcctataatcccagcactttgggaggccgaggcgggcagatcacgaggtcaggaaattgagaccatcctggctaacatggtgaaaccccgtctctactaaaaatacaaaaaattagccgggcatggtggcaggcgcctatagtcccagctactcgggaggctgaggcaggagaatggcgtgaacccaggaggcagagcttgcagtgagcggagatcatgccactgcactccagcctgggcgacagagcaagactccgtctcaaaaaaaaaaaaaaaagaaaaaaagaaaaagaaacaacaaccagaactaccatgtattgagggcttcctatatcccaggcactgaaagaaagtgaacttgctcgggcatgcttggggcccagtaagcaagccaaattaaatacaggcggcctggcatggaatccgagactgtcatcgacaataaagaggtgaaaactgtttgcagagagatttaaataaactgtttcaaagtacatccagtcatgcacagtccttcgctaacttcaagaagagcacattggtgttaagtaaggggaaagcatcagattgataagtaactgataatgatcagcactgatgtttcagaggaaatatgtgttgcagagaggcagagaaccatggtggcattttgcccagtgagatgtgtcatgcccactacaggcccctcctttagagagggcaccttctgccatcttcatctctccccttggtttttattcattgttccttccagtgcaagaggatgtcacatttcatagatatatgtgaaccacagagacccaccttcatccagggaactgcaattcttaggaaggcactggggcatactcaaggcaatgagaattttttcacaacagaactcctgtggcaacaggatggaacttaacaaaggggactgccctttcagaaacagtctgtcctgcaacagcatggagatgacaacagggacaggttctacttagtggtgacagggatacaggcatcctggctccagaaatttataacactgtctgtgctcatgtgtaaacatgggtgacttatgtacctgtatatacttatatacatacatacatatttactgcaatagacacatatatttaatagactctccttccccatgctgtataaagtgcccatctttatagctctttccttacataatgaaaggtaatgctctgataatcattctccagatataaattggagggaagcagagagcagtaggggcagttatgtcatgggatggggagtctagagaggtgcccctaggtgagttgagatgtatgtagatatccacatgtatgcctacatgcatatttatatgtgtgtagatgtgtgcatatgtgtatggaaagaagaagtgagaaggactggggtatggaaaagattgcatggataaacaacgtgttaccctagattcttagcatacaactatttacagagggcttagcaatttttaaagtgtttttagacgagttaaaataaaaatcactggacttacagccaatacacttggcctgagccgtgattatgccattttaccagttttgcagttgtgcaatcagtaagtatgccacaaatagcagagacagccagtttcagcgcatggactccatttcccttgtgtatcctctgccctttgggtttcctagtgttgctatgctggtcttctcttttctgcatcaggcatttggagggtcttgagtgtttcattggatgtaaaaataatgccattttccttctagaaagagatgaagggtgggaccaggccagccttttccatttgctgctgcctacttcctgctgccagcccctaccccggcaaaaacccctatgctaattctcactcagcaacccctgtgcccattcacagtgaaaacgctacagtgcttctctcttttcagtgaacatcctatgaacacctgctttgtgctaagcactggggacccccaaagagctcccagtctagacataggagacacagatcaataacaagcaaccattgtgtaatatgacaggtgggcgattaatgttatgtgcagagaacagagaaggattaacccggcctggggtggccaggaaaggtttcagagaacatgacatttcagttggaaattacaggaggctttttgtttgccaagcgaatgaggacaaataaggcagagcctacagcatgggtgaaagccctgagtcaagaatatgcaagacaggattaaggaacagagaatattctgaaatgcctggatccctggggttgctggatgaggatgtaatggtggggaggggaggatgggaaatggctgtaaattagtttggaaaattgggcagggatgaggtcttggaggctttgaactgagcagttgagtgagtactcttcgccaagaactgcatttaaatcagttgagtattgtgtaccagctgcagctaagacttgtggggtcccaggaaaactgggtcatttggaagatatcccctcttagccatttctctggaaatggacaactctcaaagacttgggaaacactagctgtgtggtcagggaggggccaggaggcctgggagacctttggaaaggggtcatgaatgacctgacatctttgtgcttttgtcagtgtgatcactaaaggggaattaaagccttttgtaaaagatgtaatgaggctctctgaggtcagtcggatgagctcacaatttcaacaatcaccccccggtgggattgaggccagatttcttctgcaaacctcttgtgtaagatggttccttgaaggatttctgaaaataaatatttcatagaaaaagtggttgcacaaagagggaggatctggaattcaaagggcaggtcccaggaagcccaactgctatcctaggctcagtgaggttgctcaggttgttaatgtgtgaacctaacactgttaggctgttttctgggctgacacccatgaaagggatgggttccgtgctgcagctgttgatggagacaagagggatatgcagctgcttaaacttttgacacattgctaggggactggaatgggaggccattcaacttcctctcatgtctgctatgccttctgaatttgacaactcaaagggtcacagtcagaaagaggccccagctgtgaaattatttcccaacagagagtcaatgcattgatatggctcaaaggtccaagccagggtactccaaaaagcttagaacaaaatggatgggtgttgctttgctgaagtttctggtgattgctaactatggctaaagacagaactctattgccatcagtaggaagaagtaaactcatagattagttttttggcagtaattctatcttgagtgttattgtttgtttaataagggcccttgtcacatggtcacatgtaaatggtcacaggtaaaggatttgtggagtctgcttccttaattgaaaagcattgtgaaattcaccttgacttatggaaaagcaaatgcattttcatttgttaatggccctagtcaagggtgtagtatttgtataagcagaggtggtgaaaagcagcctctcccaaagcatgtttcagaacctcaaaccctgtgagtcttgcatgggaagagttttatatggaagtaaattcaagaaatgccgtgtattatgtgcccctcttggagattcataaggctcgctggcatagtaaagcctctaggatatcttgcactaaggaaacttggttaatttggtatcatttaacatttcccaaacttgtccctggatccattgtttgttttttcaatttttaacatttttttaagtcctgcagattcagaaccactttacgaaaccctgatttgaagaattaagacataaataggaggaggatgtatgggtttatcaattgtctattacaacttaatctttagccagaagatacatatggagccacatatataaaataagtcacaatctattaaatttctcttccttatctagaccctctcattttcacagctttctacatccacccaagcaaaactaaactgactacatcttcatttttttcctctgcaacttatttatgaatccataccttcaccagctattgtgttctgaagggtttcttctgtgcacacacaggatcatatctcatctaaaccataggttccatgcagaactctgtactccaataaaccagtcctgattaggtggaaaatagtatcatattttggccaaattccctgctgagcaatatgcctccttttatgtggggtataggtatagctcatctgggctttgtatatctgtaactgatatctgtctatggtctgaatgggggtttgctgcatgtagactagaccataaactcaataaatagacccttttctctatcctcgtaatacaaggaatattcattaatgcaacttttaagcatggaagccatctccagacagccaatttctgtggttgaggcaggaacagaatataaatgcttgttctctaaagaaccctattcttatctttctataaaatgcagcaactctattttggccaaacatttttctgtctgtcccaggttaaacacttcttcccaaaagtagaagtaagtacagagaagagtacctttgtttgggaagaattcgacccacttcttgcatttcctcgccaccatttacttcattctgtatccattccagcctggattcggccaccattactcttgaggacactagaagttgcctaattaccaaaaccaattgtcattttcgcctgctttttccacctcagagccttctggagaattctagtctcctgactgagaggatgctaagttttcctggttctcacacctactcctaaagtcctccctgctagtctccatcttctgtgtgcaacgtttccattcatttatctcacctatccccgatgacctaacggatgttgttttcagaaggagagaagagtaaattttggttcctaccttgtggtgtgtcacctcactgaaaagaacatccctaaatgtgaaattttaaaataatagtttctgaaaataattaaatccagaaatgtttgggttataagacatagttcaagtataggaagagaatgagaggtcaatattggttatgatcatggtagaggattccaaagaaaaaatgagattctgagtggagatgaagcatatgtaatgttcaaagagagcagcaacggaatacaaggaaactaggggatgattacttccttcttttgaaggagagaggcagtcagctggacctgaaagggaaagaagcatccactagtataagcaaacatcccagaggttcaagttaactgaggccgactcctggctaggacctctgcggagcatgcttccctccacgagttcttagaagcctgtgcatgaggtgttgcgcggaataggaagatgccaccctctctatcaaactactgcccaattttcaaaaacaggacctgagaaagagctggcattcagaatggctctcagattacactactttctatgtaaattgatttgtgcagatttggttttgtaagggaaaacaattggccaatttttttatagctctctacttctgcccacagacttgttcacttttcccttttacatgtaaatggaaaaatggaaatgagatttctgtgatgcatggaatctctatttttagaaaagataaacagggtcccctggtcagagactccaaaggaaaatatggttcccaaaggatggaagattaaaaataaaatgtagataggtacgtaagtaaattaataagacaacaagcaaaaacctgtaaattcaatccactttactgtgctgaggaatgccactgaaagaaaatgagaaccagggtaagaagggaaatatgcatttataaatttatataaatatatgtaattatgtattttatactatataatgtaccttacacagaatgaatatttttttaaacagaagctacttcttttcccattatcttcatcatcatcatcctttagaataagtaggtacagagtagaggaccaggcttcttccttaggccccaagaataatgttaacaatgtcaaagggaaacaagagctgtttcctcttgtattctgtcttttcctggatggaaattgctcttcacatgagaaagggtgtaaacaacagcgaaaagaggcctctgcagccctggctaggtgagaagatgaaggacccaggcatttaagatgaagttgggcttcccaccaacactcattgtgtgcaggttgagcccagcaccccagggaacgatgcctctttagtgtggatgaatatgttctcagaggcatcttgtttctgagctcctgtaaccttctgtgcattcatgtgactctcctcactgaatagaggctccttgagagcagaaattgtgtcttattcactgacccacctcacagcacaacatctggcccaggatagacacacagtacaaatgtgccaattgattgaaaaactgtaagactaaagatggacaaatgtccatgttttcaaaatggaaggtgggtataatttggaaaccacatctaagcttgatggcagttccttaaaaaaaaatctgttgaacagacagacttgaatagctgatcttaatactctgaaattcacctaaaaatggtcagaaaattggaactgaccttcagtaaaaaccactagtatgaaaaaaggtttaaaaagtgaatctaattgtggaatgtcttagtagaaaggtagggttctgagcataatcctcttatgttttgctggtcagactacatcatgttccattcttaggtgcttattttaagaaaggccttcataaactagaacatacccaagggagggtgaccaggaccagtaatatagggttccaatccaaagaggacaattgagaaagagatggcatgatttaacctgaagaagaacaggtagaggcagacaagtggtggcaacagtgccatcttcaaaacttggaaaatagggttagaacttttctgtactactcacaatgcagaactgcgaccagtgggtagaagtagtaaggggcctgaattcaatccactgtgaggaagcatttcctagaaaatagaattgcacccagacgcaaagagctctcttcactggaaatgttctagcaatggctggatggaaagctgtagatgagattcctgcattgggcaagaggcttggattggactgggtggtcttcatctccaagcatctgtgactgtttcacttcattcatcatgaataggattaactctctacgagaaagctttctcgattagggccactgtgcagcaaatctcctcgaaagcttcatttacactgttttctagatcaactgctcacagtaacccatgcctgtaataggggctcagaagggtttagccattagtttaaagggacttccaacctgttaccagggagtggccaatctagaattacttctaattattagaagataatttataaattagagaattgattcatattgcatcatgtgatatcatggcaaatgtcctcagaagcttagagtgataaaccaactaacataaactccaatctgagatttcttaccctcctcaaatttcctatcctccagttgatgttagaacatttaatagtaattttctagttttgcaataaaatcagatacaagccagaaacgaattaatggaagtatgtgaaattaaactaaaatgattttttaaatattttaatttttaaatgattttagtttaaatttttttaattaatatcatcatttgatttaacttctgtttttgtcagtcatttctcattgccttctctttttcttcttctccctttctttcccttcatctcagtttcctctaaggatttcaattttttaaactttcccaggactcaattaacctcacttaaacaattttttggtgggaccagtgaagtcttggagctgctgcctttcatactcagccgaaccctggaaaccaaatccgtagccaaacatttggctttggtttagaggcagaagtcagaaaggggaattgatatgcaggtgtggtgcaaagctggtcttaaaaatacagatgttattacctctgggccctaggggcctggaacaaaatgcagtgagccacccccggaggtgaaacgatggtcataaaatggtttctccattcgtgaattttgctgagctgcctctgcaacatttagtgactatttaataacactaacagctctttgagctaaattactaacatttgggggagcaaggttatgtaaaacaaaattgaattatgaaaacaattttccagttagctccagcgtttcttgatttctgtttatcttttttctcaaaggggccatttaccaattcccccctggctggcatgagctgatgtccaaagactccaaacaatcagcacacacctctgaacaacaagggtccgtatttttccatctctgttcctagcccaaagcttggaaacactttcagtcatggaaagatctaaaaccaagaaatatccaaagtggtcttctgaagaaaagtatgatgctctttgaaccctggttaagttttcataaaaattctctgttaacctaatgctgttggaggtcaccttgtttagatacagaaactgcatgaattgacaagcaaaagttaaagacagaggcactttctagtaaaattgaaaatgcacactccataaaagtaagcaatcccacttccaggtatacactttagggcacctctcccacatgcgcacactttaacagcagttaaaacgactaaactatacgcatatgtgtcgacgtggatagatctcaaaaacaacagagcgcagaaagcaagctactaaagttatgttaccaatatgcaaattgctaaagacaacacaaaatataaaatataaaagcagggatataccccggcatcacaggctgcctcttgggagggggtggaaatggggatggtgcaacaaaaggttcttcaacattattttattattaagagacagggtctcactctgtcacccaggctggagtgcagtggcacaatcacggcttattgcagcctcagcctcctgggctcaggtgatcctccaaccgcagcctcctgagtagctgggaccacaggtgcgtgtcaccacaccaggctgacttttaaaaaaattatttgtagagacagggtctcgccatgttgcccaggctggtcttgaactcctggacctaagcgatccgcctgcctcagcctctcaaagtgctgggattacagacataagccaccgtgcacagcctcttcaacattattaataatgttttgttttctcaaaaaggaaggtactttaaacaaaagtaacaaaaacttaatttggtggatacttgaatattcttttttttttctttttttttgagtttcgctcttgttgcccaggctggagtgcagtggcacaatcttggctcactgcaacctctgcctcctgggttcaagcaattcttctgcctcaacttcctcagtagctaggattacaggtgcccaccaccacgcccggctaatttttgtatttttttagtggagatggggtttcaccatgttggccaggctggtcttgaactcctgacctcagatgatccacctacctcagcctcccaaagtgctgggattacaggaatgagccaccgcgcctggtcttggatattattttctatatctttctgcatctttacatatcttacagatttttaaagagccaaaccaggatttaaattaaaaagatgaaagcattgtcaaacacccagaaaggtttctctgcggacccaggagagccaggatagttagcatctggaaaacaaggcaggccccagtgttcggaaggggcagaggcaccgggagagttacgtttgagcaaatttgttattttctcattcagtagcctgctcctaagattccataaatccttgctggatgacttatgtcctggtcccattctacttgcctgaaacaaagttttacccccagttggtgataatatacattgaaatttctgttgctcctatctattctgtttctttgtggctcaagttttctcttctctccgtgcattatattcaaacatgtaactccaaacagaacatacaagcatagggcacagcacgctgtctgtttcagatagaactttatttggtaggtggaaataaatgcatacacatggagggaggtctgtctgacagtaacagttcatttttccaactaattcaactgatacctgattggtgatcctgaccaaggtttgacgttgtttaactatttcttaatatttcttctgttcagctagtatatattcgacatattctccatcaagtgtgaccagcctagaagactagagttacatatagctctttagaaattcaggtgtagtcctagaagtcagtgagaagaaaaatataggatgttctgcaagttgtaatgatgtgtggtttaaaggcctttgagagtcctaagaaggaggcatagaggaaacagcccagcatttgaagcagacaaactgggcttcagagcctagctcagccactttagtacctgtgaggctttgggaaagttacctaacatttctgatattctgttttctcatccaaaaaattgagttgttaagaatgaagtgagctaactaatgaaaaatgcttaatatggtgtctaacatattattggtatttaaaaacatagttgtctggctgggtgtgggggctcatgcctgtaatcccagagtttcaaggggacaaggtgagaggattgcttgagactaggagttagagatcagcttggggaacatagcaaaactctgtttttacaaaaaaaaataataataataacaaaattcgccgggcatggtggtgcatgcccggagtcccagctactcaggagactgagacaggaggatcacttgagcccaggaattcaaggccaactttttgtctgatgatatgtcattagcagggcaccaagagtagctcattattcttgctgattaactcagctgaagcaaccttattaatgatagtggtgacaaataacataattagatctatgtactctgtgtataaccttgcacaaggcttgagaaatgaagcctcagagtggatagattcaacctgcacatatctgatgccatccttccaactttgcccacccctccaacatagacttattgctctggtgaccactcttagtagtggagacatgtcttaactctcaggtggggtagagggttaaaaaggctaataagcagcagggtcagtttctggctgggagtccaacctatgttatggtctcctttctggctgcctcctattgtgttattttgggcagataatttctttggctgtaaatttattgatctttaaaataggatggtaggacgttggacaagatgatttctggggtcctttgccccatattctatgttcatgatttcttttcctttgtaagtataattatacacccaaagtaccatggattatcaattctaaaatgcacaattgtttcacatcttaacatctaagaacccaggatataacttacaattaatggtaatttagattgctgtgaaatacaatatataattaaatgtgtgagaggtactaataaaaatactacttaattacgagtttctacaggaaaaattgaaaattgctgtcaagatattgactgaaaacaagcgtacattttttgtaagttcaatggagatcattaacatggaaaagaacccatgagttgctaggacagttgtcccagatgagggattgatttgggtgttcctaaaggtccctttcaaccctgagatgctatgaaacactaactttattccagttatttgttgttttgcacactcattcagtaactgaagagcattttggagaaaaaaaaaggtagtttacggggatgacatagtaatattgtacctattaaataatcatgtgtacatttccattggagtgttaagttattgatattctgattaactgttactatagctatcattcaataatattttcaaaaattaatagctatgtttggacactaaaactgtggtgaaaataatttcatattcattgatggctgaaaacgccttttagattcttgtagaagttcaagtcatttgctatgaacacagtgccatataacaaaaatattcacttgtgctctagataaatggaacttccatgttaagtctcagtaatagaggagatattattttattacaattgctaatgatttgttgttgttgagtttataggtagaaaaagaagccattagttacttttgggtaacttgttgcttgatttatcaagacttctttgtaatcatgatatattatctatcattaatcttacttggctgttagcatgactgagaatcgaagtgattttgaacctgtctcaggaatgaggcccagaggtgtggttcaggtgatcttggaggagctgtttagaaagcaattcccgatgccaaaagttgggatcagttatccaaagggctgtatttgaaggctgggtttgatttctgggtttccctaatttacaatagaaatctcgatttatcacatgtgccatgaatttgttactctgaaggaattaatcaaaatgttctttctataaacatttttattgattcatcatttctgaaatcatgcaatttatgagttggtcctattttgggtaatagcaattacttatgaaagctgctagagagtttctgtcaagtttaattaaaccttttctactggagactttttcaagagtttgtgaactgttgactgttgataccatgtcccaaatattactcataaactggaatttttaccagcaaaaataactcagaggcatcagtctcccaaatctggaagccagttgactcctttttgacaaattccgtatgtctctttacttcattgcaacttagcatttggccttgtgtattatttacacgtgtgattcacttttctctaacatgttctaaatacttttttcaagatgttcaatctactttttattaccctctttttgtaaattttaatgatgtgaaaagcagctaaggaccaatggagaagctcagaatagcaatttttgtaggaagtcctgatgaagagtttatcaagggagatttttaagtcagttatgaagcctgagggaaagctagaagtttagggagacctttgatcatacagtattggaaatgcaggatactgttagggtaagtgaaggctcaggataggcagaggtagctatggacctagattgaggggagatttgttcaatgggatctacattgagctgggcaggatttggattgataaagaaaataagagcaagccagagtgagccatgttccaaggacaaggaagaggagtcttttctgttgcagtgctggttggatggctccagcagtgccagttgatggaggtctcggtaatcaggagtccctgaaaaatattgagcagaggaaaatgtaataaaagccatattttaagaaaattaatttggtgccactggaaagaattggagggaaggggtaatgaagaggaaaactgagtgttaggaacaccaatttctattataataatcaaggagcaaagtgatgattaagacaataactaaggttaccagagtggtgccagtgttatgccattaatgacaacaactaccatttattgaatgtttatgtgccaggcattgtgcgaaatgctttacatagattatactctttaatcatcacaatagccttatgaaagaagtactttaatcccgtcttacagaagagaaaactgagatttagcaacataaaagtatttcccgtaagtaaacagtagagccaagatcttgacctacgccatctgatacctgagcccatgctataaaagaggagcattagaaatatttgaaagatagaaatgagaactagtcaatatttattttgcttagcactgtattcagtattatggcatcttaaagtagttaagactcaatatttcatcaaaaaagtttaaaatctaatcagagaatcggccggaagcagtggctcacgcctgtaatcccagcacttgagaggccgaggtgggcgggatcacctgaggtcaggagctcaaaatcagcctggccaacgtggtgacaccccatctctactaaaaatacaaaaattagccaggcatggtggcgggcacctgtaatcccacctacctaggaggctgaggcaggacagtcacttgaacctgggaggtggaggttgcagtgagccgagatggcgccattgccctccagcttggatgccaagagcaaaactccctctcaagaaaaaaaaaaaaaaaaatctaatcagataatcaagtcttacaacagtgaattaattcatgaaccagacagatgtcatggattggcttccctgggaaacagactttgagatttgtctgcaggaggtctactagggagagtgatcgagaacaacacgtgaagggtaagggctgcaagaatgatcaggtccaacagataacttaacatatcctacagggagttctggagccacaatgacctttcagagttgtcccaatagaagcaatgggacagggcctttatgcccctccatcacccaatcagtggataccagctgcccccagtgagaacacttgagcaaagcagtcctatgtgggggattcagctctgagtctccagcctcagtcctgaaaggaatccggactgcataccacagcatccacaacaacaaaatagatgaacatgttatatatttgaattatttaatcttcaatttgtaaacactttaaatcacatttttggggaatactttcctgtaaaagtagtttttggtggggaggaaatgtccaataaatctgccagtatatttctttgccatggagtgacagccttagttcttgatgaaagtaatcaatatggaaggcattttgtgtgtggcttaattgaaaccctgtgttttggactcatttggtgttaatgtgtaaatccaatcctgttttcacacctgccctcttttttttatgatgccttgttcaagtggaagtctagtctggctttttgcttcagtctaaagaaggccatggactgttgtcattggccaggaatccaactcatatggtggcatgaagtcatccttcaagcccagcaaaaagaccctgtcagccttgcctgcagagaaagccatgtgaaagatgtcctgtgctaggatcatctggtgagcaatccattatactgtcattgatcttgacagatattgggcatacatgtacacctggacttcacctcctaaagaatctgattcctggtggctgggatgggatccaggcatacttatttttttctagtgggccagtgaagagcttgttttgttgttgttttgtttgtttgtttgtttgtttgtttgagatggagtcttgctctgtttcccaggctggagtacagtggtgccatcttagctcactgcaccctttgcctccaggttcaagtgattctcctgcctcagcctcccaagtagccaggactgcagatatgcactaccaccccccggctaatttttgtatttttagtagagatggggtttcaccatgttggcctggctagtcttgaactcctgacctcaggtgatccacccgccttggcctcccaaagtgctgggattacaggtgtgagccaccagccacagcctgggccagtgaagacctttgataaatccatctattctacagggttcttggagatgagattgcctgttgagtatattgggggctcttcaagagactaaatctcaaagaaagagcttcttgaggaactgaggagtaccatgtagaaatgagaaagaaggtgaggagaagtttgaaaaattctgcactcaaataaaagagaaaaacaggaggacaaaggacagagttgggtactagagactatgataaatctctaagattcttaggtcttcttggttactgtcattcccatatccattactcttagatgaaagtggtccttgtgtttatcttgacaaatagcaaataagtgggaccatgcaaacaagcattggtctcttttattcattcatgcaataagtattaattagcagtaactatattccaagcactgtgctcaatgctaggagtgcaggatgaggaaaatttagtctgctcagggagctcacaattccagggtggagggggtggagactaagaggtgatagattgctaaggtagagaggggcacagcagctgggatagcacagactggcagtccataatcctgtttagagagtcacggaagacttcctggaggactctgcaggattagaaatgggtaaatcaaatatggttttgtcattcaaaattgtggcacatctctccagttatttagatcttcttttacgtccttttagaggatttttatacatttttctacaaagatcttatacagtgtttgtgagcttaatttctaagtaattcataatgtttggtgctattgtgaagagtatgttattttgcattctttttgtggttggttattgttggttatagagacgtacaatttatggtatcttgtaacttgcaatcttttggtactctctaattctcagagttgttggattttattcggttttctaagtaagaaaaacaacatctgcaaacaatggcaaccttttctcatgttttccagcactaatacttcttatttccttcctgtgtgttattgcacttatatcttattgaacaacatggtgactgtgggcatctttgtcttcttccagaccctcagtggaatgtgtattaaattttctcttttgagagtggtggtttctgtggaggtaggttctggtagaaaccattttcagattcataatgtgcccttctgtgtctaagtttttctaagaatttttacactaaatatgcattgaactttaacagatttttaaagcatcaaaagatgctttatttaaattgcatcttttgagattcccatatgatttttcttctgtagtaccaatgatggaatgaattacatttagagattttatccgattttgtactatccttaccttctgtgataaaaatcatctgattataacgcattaccacattaacataccactggatttcattatctagtgttttactcaagatcatgacatttcaaaataggtagcattgacgtgttattttctctgctttcactgttcttatctagctctggaatcaaggacatactatgtcattaaatgagatgggcagctttccttctttttctgtactcagaaacaacttgtaaagtgggaattatctgctccttgaatgtttgatagaacttacccataaaactgtctacgtctaatatttgaggaagggaggtaggacataggaagattctctgttatatgaatttagtccatggagatttgtctgtatacattttctgtttcttttgtgttggttttgacactctttttttttaggtgttcatggaagaaaaggaacatgtcctgaggttacagaaagggaaaggagagctatcccattgctgggcagaggactgtcagaatagatgtctgtgtgaaggggagttaaatgttccttctctgatcagtgtgttctattcatccatcctaaggagggaacctcaagaggaagatgttcagctcatatgggtttgtgtagtatgtcacctctccgacatcttcatctgtgacagggccagtagggctgaatcatggcattggcttttgatcagtgacttgagccccaggcatcaaagggccagtgctactgaaatgactttcctcagagaatctgagcttgcacaagctcaggccgtaccacaacaccattggctgtaaatggcagccccttcactagatgagaagtaggtttagcttttagaaggacacatgggtatcaaataaccagttacttgccttcagaggagtttgaccaaggttataggggtccagaaatctcatatgaggaccgcctgttggatctgagctggaaatgacagtaggggaaaaatatttctcttcttataaattaagaatccccatggaatgagaattacagattattttcagggtattgtacaatagggcaggggagaggaagattttggttcagagtaaggagagattttttccagttgagctgtgagtcatttgtcactgaagagtttaattatatggtggtttcaagcagagcatctcctgggtcaaggcagaaatttggttttcacaatgaacaggaacttcatgtgggggttaccagcagactatgttttcaggaagacaaagctttagaaaggttcacatatggacaacctgataaacgttcgctgggcccttccatattccagctaagcattctcttacccttaggtaagtggcagagtttgggtgccccagagtcatgggcacacagtaggatcacctgggaaacattcaacaagttatcatggccaggcctgtgccagcccaagtcagtcagagtcctgtgggtaaggcctgggcatcggtagcttttcaaagccttcaaagtgattctaggatacactcagggttgaaaaggagagagctttgaaaggagggaggattccattgacagaggagcagaagccttggatcatcttaatttcattaacaagggggtaaaaaaggaaaggctgagaatgacacacagccttacttgaaaccttcttaactggatagttttatgttcacacttcctcatgtttcatagcaaccctatgcattatttattctcatattaaatatgaagacaccagagatcagagaaattaacttatccaaggtggcgcagcaatcaaggagcagaacgggaatttgaagcaaggtgcaccaggtctcagcccatttggcagagaccagggctgctcaccctttgggacgcatacacgagtccccttgggatctggttaaaatgcagattcctcttcaggaggtttagggtgaagcctgaggttctgcatttttaacaactcccaggcaatgttgatgctgttagtttgcaggtgacactttgcgtaacaagggtgtcaatacactttgagaatcgaatcttgatcttgatggagacgttcaagagtctttgattacagatgaatttggtgactcttccccaggtgagaaaacagaaaatccatgcaagtttgggaagcccccaccttgactcacaactgctgcttgtcctgctgaggcaccagccaggcatccccgggaaacaggcagaatgaggctggcagtgacagaaatatggttggtcatccagccatctaactaatatttattgagtgcctatggtgagctggagactgttctagacacttgcgatgcgaagataaacaaggcagttttataatctagtggtgtgtgtctaaagcaaaacagttatcacggggtttggttacgtttgtaacttaccagacccttgaaacaccctgacttttctcactctgtcagcctctacatccaatctgtcaccgggttggctcaatctgaataaacaatgtagtggaacggccagaaaactcatgggggctccctctgcatgaacagcagcatactgaactggcagtagagacccgcactgtctgcccagtaaggctgaagctggacaactgacagccttcaggtctcccagccttatctcaatgtggattgcaacaaactgggcctcatctagggggcagggcggccagacagtagaggagacccaaacccttttgcatcaagcactgttgagagacctggcagtgtggaccctgcttcaagacagaagagccagtgggaccctgagggcctttccgcagctgctgggcctccgtgttccctgtgtctttcaggccacactcagatatcacccgccctaactatcccagctaaagcgtcctcctcagtcactctccatcacattttccatttgtagtttcttgagaactcagctctagaggatgtgacacataaagagatgctcaggccccctggttgttcttttgtgatgttgggtagacttgcgtcttctacctccccacaccccactccacatcccatacctacattgttgcctcagcctccctgtaagcttctctttgtttatttacctcccttgcccccatcccaaatcaaatccatcctatatgtagctgatagccctgcttttctatacttttttctcatttgggatgcgtggtttgcaacctcagctctcaggagcctatttcctcgggttactctggctgtaaggtagtgatggcttggctctggaacccttggaggcgcctttgtacccgcaagccacgtggccaggcccttgtgtgctcagagaggggcctctgtctctcttggccggctttgctcctcctgtctctagttggaatctcttgacattttccactttccaagcatcaaacttatgtctttgtaagctggctctcaatcatgttctttcttttttaaaatttgttgctatctaactacactctaaagtcccccagtaaaaaaagaaaacaaacagacaaaaaacagaaaattctcctttaatcaatgcttgctgtcttaactggtgcttcagacaagcacttcttaggcaaatggatgaccacatggctattccagggaggggaaacggggatgctaaattggcacagagctctgctctgtctcgtcacggcactgcctttgatctttaatttgagccattctaggcagggctcagtatactctgaaaacacactttgtgattaaaaaatgtgcagtacatcagccaaaacatttgtttatattttacccccaattttggggtttcttgtcatgctttcctcaaaaactttctttatataattaaagaggtgtgagtgctctgagcatgactgtgcaatagaatacaaagcacagttcccttctctgaagacagagaaaggtttttccccatctattcaagcatgaagtctgtaaggatatggcacagcgaccttcactgcattgtttctggaatggtaatgacagtctgggctgtccaggaaagagcgagcttcacaaagactaaggcccttccaggagggtctctcccagctctggggatcccctcagagacacatgggtgtttgaatgcaccagtgtgtgtctctggttctgtgagagcagggtttttcaacagcagcactattcacatttcagaccaataattctacagtgcacaggatggctcctcacggcaaaggtttctccactccagctctatccacatttggccctgaaggttctttgcggtgggggctgtcctgtgcgttgtaggatgtttagcaatacctgtggcctctccccaccagatgccatcatgctctcctccccaaccaccaactggacaatcaaaaacacccgcagacatttcccagtgtctcctggggagggcaagatctccccgcagttgagtactctgcattggatggcttggaaaaggatccccctaggtaagaggcacagtctgggtgccccagagtcatgggcacacagtaggatcacctgggaaacattcaacaagttgtcatggccaggcctgtgccagcccaagtcatgcagagtcctgtgggtaaggcctgggcatcagtagcttttcaaagccttcaaagtgattctaggatacactcagggttgaaaaggagagagctttgaaaggagggaggatttcatgacctccattgacagaggagcagaggccttgaatcatcttaatttcattaacaagagggtgaaaaaggaaaggccgagaatgacaaacaccctcactaagtctctgtgtttgctctttttgtcgtctttagtggttagtagaactcttaaaatgaagaaggcctgtgctcttttcttctggggtagctggaagggaagagctggggagatcaggtagcacctcacagctaggcttgaaagaggaaccctaaatgagtaggatgtatcttagagattttgaaaaggaaaagtatgctgagtctttgaggcctcagagaaagaggccgaaatagcccaggagggcttagccatcagtccttggctacgcggttccagtcaactgagggtaagaaatttgcttctgcagtgttggctggggtcttgtgatgtcccaccattttcctctaggatacatgagtcccagaccaaaaggagaagaaaaacaatgggtgctgtagtgtcaggtgtctctgggtttcggttcagggaactatcattccgtccaatatcccaagctacaaaacctcctgtagcacggaaattaggagcatgggctttggagtcactacagttgtgtttagttctcagctttgtgtcttactagccgagatatcttaaagaactaagctacttgacctgcctgagcctcggttttcccatctgtaaaatgggaaatataataatcatacctatcttatagagctggcagaaaaagtgaatgagataatccatgaaaagcattgagtccagtgctcactaattattaactactatcattagttcttgttatttggcccaacattcaagaagtcctgtttccttctcttccttggaaatgtattttgaaaatctgaccccttcttcccatctctgttggcgttgcctgagttctgtaccaccagtcacccttggggttgaaaaggagagacctttaaaggagggatgattccgtgtcccctcctgatgactgtatgacccctccttgatctgccacccagttgacctctctccaggtgttaccgggtcatgtaactcttgattcaaatttccagggattgtttgcaaccaacaggctgaaagccaaaagccctatggccagaacctacttctttggccactctgtggtcctccagcatgttggaattgttagtttgggttcccatgaccagagagtgttgactggcttttcttgcttatgttttaaatgtctgtatgttttcaagtcactctaagtgttggtggagtgaactcccctaacccacagtttatatgtcttggactgaagtgttgcacatttttgtgtgtgatgttttaaatataaaattttgttttcccagcaactgctgtaagtgatttggaaacattgcctggtcctgattaacttcttttctgcatctcatttagggtcttgtttatttacattaataagaagactacacaaacagcttacatgtgaaattttctcttgaggacacagaggctgacgataaaggctaattcgtgagtgagaggaagttgaaatctaagttctttcagctcttgtctgagcctattgctgtaacaagtctcctaatcaacagaccttgttaaaggcagttattttattacaggcctcccaagtttggcagcttacccgacagcttgccttttttcaggaggcaggacatcaaggtgaggcaagaaagaaaagaggacaaaaaggaaggcatttaggcaaggcaaagttggtctcttcaggttcttgttgtaagtcaacccccatctattgtgtgtataaatgatcagccccacctgtgagaaagataccacagaggctgaagacaggtctaactgggggaatatagtgccttgaatcaaaagcagtatttcttcttttctttttctttctttctttctttttttttttttttttttttttggagacagggtctcactctgttgcccaggctgaagtgcagtggcgcaatcatagctcactgcagcctcgacctactgggttcaagccatcctcccatctcagcctccccattagctgagaccacaggcacatgccgccatgctggcttatttttgtatttttcgtagagatggagttttgccatgttgcttgggctggtctcgaacttctgggctcaaacgatccacctgccttggcctcccaaagcgttgggactacaggcataagccactgtgccctgctgaaagcagtatttcttttgaagggacaaatttggattccttgaaacatacagctcaaatggatatttgtataaattattaatatttgtctttcagttcatttagtttcctgctgggttatgattatcaaaaattgtaaacttgtctatttccctctgctagactggcagttaaataacaggaaagtcagagtagcagaatggatatgggcatgggatttaacaacagataagcctggtctagtccaatgtccactgcttaccagactcccagcttggtttatgcccttccacaaaaaactagctccatcatctgtgaaatgaaagaatctggctgggcacggtggctcatgcctgtaatcccagtactttgggaggccaaggcaggcggatcacctgagatcaggagttctagatcagcctggccaacatggtgaaaccccatctctactaaaaatacaaaaattagcagggcatggcagtggacgcctgtgattccagcgacttgggacactgaggcaggagaatggcttgaacccaggaggaggaggtttcagtgagccgagatcgcaccattgcactccagcctgggcaacaagagtgaaactccgtctcaaaaaaaaaaaaaaaagaaaaagaaaaagaaataatcctagtagccacctcactgggttgctgtgaggattaggtgggattgcataagtaaagcagttagcagagtacttggtatagtcaacccatggcagccactacagtgacagggaggatggttttttaagttccttgggaacaccagtcttgtatctgcatcaccagcttctagctcagtatctgggaatgagagtgtcggaaatgaatacatgaaagtcccagtctttgccatctttagaatgagtatttaggtaagcacaagcacatctgcgtcccaatgccatgtccactttggctgcagctggacaagtaatattcttaaatccccataagatttaggagaagggatcttccccagggcatcagtcacgcagggaatttgaacagagagcagtggctgggggactgtctcattgagggaatgggtgggaagaacaaggtaaagaaaggtcggtcagaaatgagagagtaagatctcctcggaagtcaagggaggaagttctcaagggagatatgctgctccacggtggcagcaagttcaaagagaaggtcattccatgtacgccttacgcatacctatgtggagtcactcatttggacacccagtcttattagagttgcatcgtgccatacattcatttttctctattttgattagcagctattgaagagcctttacccaccatgacaaatgaatactccatcttaatggctgtcagctgggctgtggtttgctgccattgtttgccattgtttgcacacaaaagcctgatcccattaagaccgtcagatatttcctgccatcgcatggcctcctgctcacaaacatttgatgctatttaaagcctcttctcagcaaatatgcatcggtcacatgtatgcactgcccattaattaaggccagatttgaagctctcacagctgtcacttctattaactgattgcagggaatgtaggacttcatttttctgggagataatgtgaacatcggagaaaagccaagagatcttcgaatccctgtggcacttaccttgacttccaggcttgtaatgaaaaagcttcttagacaaaaagggacaaaaagaccctttcacagaaatcataaacaatctctgccaagcaggagatttagtgggtgggaacacacacacacacacacacacacactctttatttgaggcaccctggaaaatgaaaagctatctggggaaagtaatcatgtgagaagatggccttgaagatagcagcttgattttctttgaaagaaaaaagtggaccaatttacagtagtgactttgctaaaaggctgaaaagagttgagtgtattttctcttcagtctctctttttctaaaggaaacacgtcatggattgattggaaaacatgatcttctagttatcaaatgctttaattaatggcaaatcaaaaacataccagacaaaggttgccagttatcaaaaaatcaaatactaattttctcccagctgcatgattgggagcaagggtgtggagctggaggtgagactggaaatagtcacaatcatgatattaatggaattaacgtttattgggtgcccacaacatggcactttaaaagaatgcattttcataaattatcttatttgactcttgaaaacttagatgttatcatatgcccattttatagatgaggaaactgaggcttggcaagcttaagcaattttcccaaggtcacccagctggtagatggcagggtcaggactcagatctcagtgaagtctgtctgccatgaagttcctgttcataaccctttgttatcctggtacagtggaaagcacgtgggctttggagacagactagagtttcatccagattctgtcatgggaccttcaacaaattgtttaccttctcctcaactgaagtaaaatgaggaaaatagaccaggcgcagtggctcacacctataatcccagaactttgggaggccgaggcgggtggatcacttggggtcaggcgttggagaccagtctgaccaacatggtgaaaccccatctctactaaaaatacaaaaaattagctgggcatggtggcaggtgcctgtaatcccagcaactcgggaggctgaggcatgagaatcgcttgaacctgggaggcagaggttgcagtgagccgagatggtgccactgcactccagcctgggcaacagagccagactctgtctcaaaaaaaagaaaaaggaaaagaaaaataatagctgcctcatgggctactacacagattcaatgaaataagggtaaacaaaaatcagagatactcaaagtgttagtttaggggtattctgcaccccacctcccatttcatttcattccagttatttctttctcctgtcactggactgaagctcccaccaccttccgctatgttgttcctgcattctccacttcctcttggctctttgtcttggggaccaacacagagaaatctttttttgcccagttcttcccagcagtgcctgcagctgtgcctttgacaatcctgaccccagctggtccccgaggacctcccagcctcccacctctctcctcagactcccatgccatgactgaaaaacaggaggacctgcgaggcatgtgagaaatctacaggcttgacatctgtgggccaggcgctctctctcaatatttttttctttttttttttttgagacaaggtctcactctgtcacccaggctggagtgcagtggtgtgatctcggctcactacagcctccacctcccgagttcaagtgatttccccacctcagcctcccaagtagctgggactacaggcacacgccaccatacccagctgatttttttgtatttttggtagagacggggtttcaccatgttggccaggctggtcttgaactcctgacctcaagtgatccacccgcctcagtctgccaaagtgctgggaatacaggcgtgagccacagtgcccagcctcaagtccaattaactatttttcaccgttgtttacagagctttaacttctcatttgctttcaaagcacctgcatttagaattttagatgataactaagatggtttgcattacaaattcttaaaacatttggctttcagaaaccatcttgggctgtatacatggagaaaatgcagtcaagccctgaagcccagggctaggagacagcaaaggaaagaaaaaaagggaaacatggggagccatgatctcagtgtcgtggaaggcagtggcagagaatagctcaagagatgagggatgagaactgagaagaccccacgtgcagggaaagtgaagctactggcatcctcagggaagaaatgccagtaacctggtgagggtagcagtctatggcagaaggttaaaggaacaatgattatgtggaagtgggaccagcactgtggttgcactgtggtcgccaggggctgggggaggtggcaatggggagttgttgtttcatgggtacagagtagaggtggatggtagagtgatggttgcacattatgaattttttttttttttgagacggagtttagctcttattgtccaggctggagtgcaatggtgtgacctcagctcagtgcaacctctgcctcctgggttcaagcaattctcctgcctcagcctcccaagtagctgggattacaggcacccgccaccacacctggctaagtttttgtatttttagtagagacggagtttcaccatgttggccaggctggtctccaactcctgacctcaggtgatccacctgcctcagcctcccaaagtgctgggattacaggtgtgagccgctgtgcccagccaagagtatattttaataccactgaactataccttaaaaggggctaagatggtaaattttatattatgtttattttaccacgtttttgttttaaaaagtgcaggaagcatcaagcttggagccacagtgaaagtcaagaatgtcagtgattccacatttaatatctacatttttgcagggcagttactcttttgtagtataacattgagctgatagcacatagtgtagacaagtgaatacaggattctctgggttatatttccagaagtctggaggtcatttggatatttgtgggcccttggcttcactctgacttgtgtgacacataaaaattgtgatgaaatgtcctatagatgtcctgcaggtcttaaaagaacctttccaaactatgaaacagcccagcagcactgagttagaggtaaattctgaacccttgaacactaaaactattctaactgcacatagaattggcaagtagcattctatgtctatgaacagtatgtcttttctatataacagagaaaatctttttaagcaaactactcagtttaaaacctaattcttctcataatctcagtacttttgaatgaagacatatcagtgcaacagtacactcttattcaggcatttgaaagaaagaattcgagatctagtttgtatcagatattataaattagtatggtttagtctttgtcatgaaattctacttaatttttggactataggtttaagaatgtaagcagaagttctgcaccaatcagaataagctacattatgcttgagtgacaactactgtaatgacaaaatatcagtggcttaatacaatggtttttctctcatacttgttcataaagagtcagcaaggaccctgctcattatggtccctcagggacccaggttgttggaagctccaccattttagatagctcccttcaaagtcagccatctttgcagtcatgtcccccaacagctgcaaaatttgctctgatgctcaagaattgagcatcggcagttaaatgcttcaacatgaaagtgacacctgccactcccactcacatcccattggccagaactagtcacatggccagacctaacttcagaaggttggagaattgtaatcctccatgtacccaaaaagtagagaagccagatactgagaaacatcaataatggctaacagaaatccattctaccattccctttgcctaaagtgaaaagatgagtactttcatcaatttgtaaactgtacttttgaagtaaatcctggtagcttgcatgggggctggatttccagaaagccatatgtaatttgggaatgacattcacttaagctcatagaatatcattatttgatgtaaaatgcccccatttgcaatacaggaccaaaatgcactaaccacaaaattccactccacaagggtctgggttctaatttcttcattctttaaatgaggcattctatgatttggaatggaagcccagttgtagtcgtaagaattttacttaattcaagaattattctcactgaatatgtgccagttctgaaaggaatgcaaagtcaaattttgcatcttctttgctcaagggcctttagatgtaacaacacagacatgatacaaggctgacaatgacattatgatttaaatatgttaaacaacttattaaattgtgaatcaacaaaaaattatgttctttattttatggttttgcatagtcctgactcactgcctacatatccctcttgttcctcagctcttatccctgatttcttacaggatggcctaagacagctgtagatgtttttatttagcaaaaaaaaaaaaaagaaaagaaaagaaaagccaagccagaaaaatatgttactcctgttaatgttttttccttattcaaaataaaacttactttagcttcatgagaaataatacatcttacaatatatattactgacttttttcagtaaagataggtcaagaaagaaattgtactgctcattagccaccaaaatactagtattgggggcttattggaaaagtggtaacaacggcaacttttttttgcaactttctttttcttttattggacagtctcactctgtcacctaggctggagtggagtggcatgatcatagctcactgtagcctcgacctcttgggctcaagcgatcctcctacctcagcctccctagtagctgggactacaggtacacactgctatgctcagctaattttttttttttgtagaaatagggtttcaccatgttgcccagggaggtcccaaacctctgggctcaagcgatcccccaacctcagcctcccaaagtgctgggactataggtgtgagccactgcacctggcctaggcaaatttctaatcctaaatagtgaaattagagggccaactgtggcaaatctaggggataatttatggcaagagagccagggggttgccaggactggtctcaaattctcccgtattggattaatttcagtgatgtaagttgaggccactgacccacatgactccttcagaaccgagagcaggaaggacagcatgacatagataaagtcccaagccatgctgattattgtttaaaaacttcaggctttccccaaattgcatgatatcttaatctttgatttcttcttattttaagtgtaaaaatccatccctttattttataaatcctgattttgccatgaagcggtctctgaactcctcagctgttactgcccagtttatcccttaattccaattccacctaccatgtggttcatctcttgtttatctccccagctagatattaagcccattgagagcagggatgtaacatatgccacttttgatttctctaaaggaccaggtcagtgctaggcacacggtcgatgtttaattaatccttcattaatataacaagtcacctgatgatttagatctttccttcaaaacccacctacagacacacacacacacacacacacacacacacacacttacacactctgatcatttagtctttccctgaatgactccggtggtgaagagctcacttcctcccaaaacagcccttccatcttcagtcaactgctaatgtaatgagctaagatttactgagtgcctactatgttccaggcatggtgctaagccctttacagagattataacattaatccttacagcaatcttttgagggaggcattccctaaggctttgtttcccaatcactacgtgggatcagtccttctataccattcctctgtaagccccagtccaatgtcttgggaccacagataggaaatctaatctttcttccaagtgacgaagtttccaatgtgggggctatctagcaatgcctgtcttcttttcttcttgttaaaccccccaggtctttacaccattgttaacaacaatcactgagtctcattgaacactcactgtagtccaggtactgtgaggaaggctttctttttgtgctttaaattattttttcccatttatgattgacagaaaggttatgcgtcttgcctgaggtcacacagctagtgtatggccaacagaactgcaatcctggaggggtgtgattccaaagacagagtttctcattactgtttggcatcatttctacttatggtgattttcactgttttaacagtttagaatcccttatgtcactttcataataaaagggagaaaagggcaaatactttgtcacagaaagaagattcattaaagggatatttttaagccactgttttcacaagaaaaccaaatgctagaaaaggtacaatgctaaaaagaaactgtaaaaaaaaaaaattgatacctataccacagtaaagttattccaggtaatttaacttttgagctagaaaccgagggttctccttgcatcagggtgctctcaccctgtagtcctgagaagacgacctgttttaggcaaatacataaaaccaaatggaatatattagaaaggaagtgtcacagaccagtgtccaaaggtttttggagggcagaacgtggagcaatggaccgtacacagagagaagaggatttattacaagtcaggatcattcagggatgaactggcttccttaatgggtggaaggctgcctgtcaccggagaaagtcaaacaaaatcagatagacagggctcttgcaaggacagaaatggcttagaaagttaccaggcacccaggagatcatctgaaggtgtgttaaaagttaacattaagagtctaggttcttttagaatggcaatcattaaaaagtctggaaacaacaggtgctggagaggatgcagagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggctctattcacaatagcaaagacttggaaccaacccaaatgtccaacaatgatagactggattaagaaagtgtggcacatatacaccatggaatactatgcagccgtaaaaaatgatgagttcacgtcctttgtagggacacggatgaagttggaaatcatcattctcagtaaactatcgcaagaacaaaaaaccaaacaccgcatgttctcactcataggtgggaattgaacaatgagatcacatggacacaggaaggggaacatcacactctggggactgttgtggggtggggggagtggggagggatagcattaagagatatacctaatgctaaatgacgagttaatgggtgcagcacaccagcatggcacatgtatacatatgtaactaacctgcacattgtgcacatgtgccctaaaacttaaagtataataataataaaaaaataaaaaagagtctaggttctgggactggaatgcctgggttacattcctgctcaacatcttactcatcttagacaatttactcaactgcctcagttttctcatctctaaaattgaaataatagtatgactttcctcttggggtactgggaggagtcagtgagttaatttaaatagtaaaacatttttaaagtgcccatgcatatgctaaatcatctggtccggtggtcctaacactttttcatgaaaatgatcttgtttccaaagaaaagagatataagtaatcccaacacataaaacaaattttttaaaaccactaatgtgttttgttagcataaattaatttcttttttgagacaatttttaggttcaagagtacatgtgcaggtttgttgtataggtaaactcatgtcacaggggcttgttgtacagattgtttcatcaccccagtacgaagcctagtacccaatagttattttttctgctcctctcctttctcccaccctccatcctcaagtaggccccagtgtgtgttgttcccctctatgtgtccatgtgttctcatcatttagttcccacttgtaagtgagaacatgtggtgtttggttttctgttcctgcattagtttgctaaggttgacggcctccagcttcatccatgttcctgcaaaggacatgatcttgttctttagtataaattaatttctaattaaaacattaacatctaactcttatacaggcatttagtgaacatgtggctattttgtccattagaaaatttagcacaagtaatatggaaaatgatttggatgccttagcgtttactttatttctgaattgtgtttcaatttacaacctttgaagagttcttaattaacataggcaggaaattacagacagtctctttggttgaataaaaatgggagcagtttgttccaaaggctgcataaaaatgagttaatgcagagatgtctggtgtgttacacgtaggcgtatactgtggttgagtatatatgatgtttatcacagttcttcacattttgaaaatatatcttaaagattatgaaaatactgaagtagagccttggaatagcttgaaagccactgacctgtctcatttagcagacatgatttataggttaaattagccccagtgactgtccaaggtctcaacagaaaacagtaggactcaggctaacaccagggtctaactgattgtggttaaaccagatgatctctatgttttcttctgttctaagagtctatgattctagcattctatgtttagtgggaatacttgccaataagcctgattttctatgataagcctcttcttccttcaattggttaggccattttgttcttctctatactacaaatctgttacgaaatgaaatttcagagctatattttctgaaaaggataaatgtcctttgctccaaattcattttatttttattcctatccacttcagtttgtataaaatacagaattctaatcttcaccagcaagaatttgtggtttttcctaatacaaactggtaactgtaagctccagatttacaaaaaaaaattcaaatttgactttcacggccagctaggtcaatactctatgccacctttgtattctgttcctctgacattttagcttttattttttaaaaactggttcaatatgttgctgactttgagtcacagcaaggaggaagatggatatcttcatctatgctgctgacatggttttccagccatcctaagaagtgaataaatcacttttactggttactaatctgaatggctttgtatcaatcatgtcaccattaccaacttatttgaggcagggatttctctagtattcaagtagacacttccaacaacttcctctagcagtccatttcacccctcagctcaggggtaatgccttggttagttcatggaatccttaggcggcaataacggttcaaaatgaacattatactgcagctcctagtaagttatggatttatagcctgcccctgctcaagagctccagaagttccttcagcttaaaggtaataggctgtttttctatcattatttaaaaacacaagtcgaacagtgatttccttgcagccctcaatcatatacagaatacagtctcaaagctggtacctcagggctcaaaatggggagccccagggtcactagggtgactcaaacccagaggaaagatggtcttggggtgtattagcctgttttcatgctgctatgaaggcctgcccaagattctgcaatttataaaggaaagaggcttaattgactcacaattccacaaggctgaggaggcctcaggaaacttacaattctggtagaaggggaagcaaacatgtccttcttcacatgatggcaggaaggagaagaatgagagccgtgcaaagagggaagcctcatataaagccatcagatctcatgagaacttaccatcatgagaatagcatgggggaaactgcccccatgatttaattacctcccaccaggtttctcccaccacacatgagatttgggtggggacatagccaaaccatatcatgaggaaatcctggcttgtcatcgaaatcataccatggttttagattccctttctgataatcgaagaacattctggaggcctgaggcagagtgagccaccagaagaaataggagctgtccaaaataatttaaagtcccaggcccttgggtttgctttggggaaaaaagcttttatcacagccttttggtgcaacagaaaacaaaatgtttgggagaggttttagtaccagcacttcaggcagtgcatgtaggcaatggataagagagaactcaaagcttctgggaaattggaggtgtcccatgtttataaaggggaaattcaagatgcaattaagacgactcctttccaagaaataccaggacaaagcaagtactccaaagccacccagtgccactttccctcatccctccacctgtccaacacgtgcacctttcagtgggtgctctgcacttgctggcatctgctattcactaccatattccctgtttcaatcactccattaatctccttgcctttgtggcttccaccttaaaactctgcttttgagtttttgaactagatagatacgagcacagatcctagcacttggctgtgtgacctcaggcaagttacttaatctccctctttcctccattattaaaatggtagtaaatacattcatcctatcagataagcaacaaataccagtttcttttctttatattgcttttcttggtgctcaggagcacctctgcacacctctctgaatagagggagcacacttttcttatggaacctaaagtcaccagagtccataagttgtcaaaatggaatccttgattctttttgactttggctctttctctcttttaaccagagtttgttctctgctggagaaatgcttttcattttacttccatatttgctgccgtttcacatttttaaaagtatattcaggccattctctagctaaataacattccaatcagctactgtttaagctgggaattgatatcatttatttgtgtttctttgaatttgccctctatgttatctttaacttgactttaaataaaacataatatgcattgagttccttccatgtgtcagatgctttttacaaacataaactggcttcatcatcataaaaccaacccagtaaattaggagatataattaataaatagtgtcactaattattacgtattttcactttatgacagcaaagtatttttgctgtcaaagcataaggacactggatcattgtcaaaatccctaccttcactcagttgtccacacctgggttaaggcttattcttgagcggctgcagccctgggcactcccttccacctggaatcagagaatcacatataggcataatgcctaggaggaagtaatcagctcgtttaagtgatggctgacatcaggaggccttttgagccagaagaatgacatgatgatagctgtgtctttggaagataaatgtcacaaccacgtgcagtatagattacctgaaaccacaacatttagcctttatgcttacacatctggggggcatgatttaaaagctcataaatacaatctggattttaaagaagggactggtgaaaattaagaatttcaaggttctaccaaagaaggtgaaggatcggtgtttttccaactggtttatgtgtcctaaatatttatgtatacaagtgcatattgttagtgcagtctcttggaagccatgtgtgggcagcagatctgctattgccctacctttcagtttaaagttgcaagagaacggaaattctctgccagcatgagaatcattcatctggcagccacctgaattactgttaagcaacacattgagtttgacagataaccctgttcttagccatccttcaagaaaagcatgaaggagccttcatgtttaaacatttcagccaaatttcttccttctgacaatgcatggaacacaatgtctttatttcctaatgaaatattcatattggatgtatctatggttagaagagagaataataaggaattatctttatttaatttcttagtcattctggtctcagagagcaagctctcgggttgggtaatgacgtcgcccaaggaacctgatgtttttcattgagttataaatatctctcaacttggcaaaccaatagttcccattcccaggatgacaaatgagaaaaatcgttactatttcagtggatagttttggatctaggaatttgttgtgagaggaagggtggtgttatagatgtcccttcatggggggtaaatcagcacaatatgggacttcagaggacttcaatatgggattgcaagggaatcaagagacgctataggagatgctgaagcagtgtggccaggcctcgtgggaggggaggcctcggattgggagtaaagcctgtgtgtaagcatgttggggaaagcccgagagcagcctgagagatataagcgtataggtggcccttggtcagtcatctaccaggccctgttcttacaagaagggtttctgttgtcccaagagacaatacaactagcagaggaaaaagatcctagacttcggggccagaaggcacttatttcaaacccgccaccatcacttctgtgtgagctttgacctattacttaccttctcagagctttggcaaaatagggatagtaattcttacctcctggtgttgttgagagaattaggcaggataacatattaggtaaggtgccaagcacatggtgagtggtccagccgtaacagctgtcacatatatccatggggcttcctactgcctaaatccctaccagatgcttgaatgccctgattgcatctgttttccacctacaactcatctaagaccatgaccctacatgcccaacccataggctccatccagcagtctcccttgctctgtttctaaaatgaaaataatccctttccagttttttaggctttccatagctggtctccaagacaaaccgggaaagactaccaaaagaaagcattttctttaagttttttgttgttgttgttaatgagaaaagttacaaagataaaagaaatctctggaagccttgatcaccattgtcccagagcattattgaaatgcaaatagattgtgacagtttacctgttacagctctgtcttcaaacaccacttgagaatcatgtgaaaagaaaggggggttttggtggacagtgcaaatacacaagcctcccctgttggtagagaagtatatgtagcttgtgtgaaaaaggggatcccatggccagactgccaagggacgcgtctcgaggagaaggagaggcacaacattttaccagcccctacttcatgccagttctgaattaggtaccttcatttacacatttcatttaagcctcacaagagatttgtgaattatactttgatccctcattttacaggtaacaaaactagggctcagaaaatgatgtcacctgcgggtgtaatgtgcattattaggaaggctcttaggtgaacattcatgtgtctagaagaaaagacgttttgaacatatggaacgtagaaaagaaatttttgttaaattctttaaatcccagcaagtgcacttcagattcaaagtccttaggagtccccccatcactcagagcttctctttggctcttctccaccatctcctagtttctcctctccctttcctctctgtccctttcctctctctccagcactggaagcaaaactaggcttttctatttagccagatctcagggcttttttgtttgttttttgtttttttgagacagagtttcattcttgttgcccaggctggagtgcagtggtgtgatctcaactcactgcaatctctgcctcctggggtcaagccattctcctgcctccagcctctcgagtagctgggattacaggtgcccaccaacatgcctggctaatttttgtatttttttagtagagatggggtttcaccatgttggccaggctggtcttgaactcctgacctcaggtgatctgcctacctcagcctcccaaattgctaggattacaggcatgagccgtgcaccagcctgatagcttcttttgctatgcagaagctcttaagtggatcccatttgccaatttttgcttttgttttgattgcttttggcatctttgtcatgaaatctttgccagttcctatgtccagaatggtgttacataggttgtcttccagggttttggcagtttggggttttacatttaagtctttaatccatcttgagttgattttttatatggtataaggaaggagttcagtttcaatctttgcatatggctagccagttatggcagcaacatttattgactagggagttctttcagttctgtgatagttcatttgctcttcaaccatttcctggtgaaaacagccaataaggaagtcagaaaaggactgccagctgcaagaagtgacttctgacatccagaggagggacggcagagaccttctggtagttggaactacttaatatagagggtggcaatctctcacacctcagaatgtctctgagtcatctagagcaagagtcagcaagttatagcccatgggccaaatctagcaagtaaaccaaatctagcatgtgagcctaatccacctgccgtctgtttgtgtaaataaagttttattagaacatagccataagtcatccatggctgttctcacgctgcaacaatccagcagagtggctgcaacagagaccatatgactgcaatgcctgaggtatttactctctggctctttacaaaagaagcttgctgacccacaatgtagagcagcacctttcaaacctgaatgtgcataggaatcacctgagaatgctgttaaactgcagattctgattcagtagccctgggaagcggtgcaagacttctaaaatgccccagacgatgcctgcactgctggtccatggaccacactttgagtaacagggggccagagaaaataaactaaggcttattgtaagattctccccgggggcctgaaagcttaaggagatgaataactcctcccttctcaggcccagtcccaaggcacaaggctacttgcaccagcagtgtgctccagcaaaatagcagaagcaggaagagagccagccggaagacacgtacccctgaaaatcaagaaagaggccatccgggtacaacatagcagtaatgtcagactaggacacttcctgtttacaggagactataaaactttcgccctgtcctcacttggggctgacgccattttaggcctcagcccgcctgcaccctggtgctcattaaaacagcatgttgctccacaccgcctcctgttgtctgttggcacgctctcagggttcgaaccagtacaagaaccttacacttactagtcttgatttttttaaaaactgagaattataaaatatactttagaaggattcctatccaaaaagctaaaataaaaatgcatagggttttagaggaaaattctgatgaaagaatgggagagagagaattattataactaaattcgatgaatgaattaatgagtatcaagatctatgctcagacccttgctgtaagatggctccatcaaaggcctgccccccagtggagtttctgcctcaagaacactagtattctttcaggttgtcaggccaggaaccttggtcttccttactccacctttggtagaacatccatcttcagtccagttggccattccttcagcgtgatgttggtgggcccttgccctccattctaatttcatctctctggtccaggcctccatcactttgtgcccatcttaatgcagttgtctgtgtgtgtcccagtctccagtctcttccatctccagtccattgcccgtgtttgccagacatcttctgaaaagagctcttcagcctgccatttcccactcaagagtcttcggatttaagatcccacactttcgttgccagccttttctctcatcatctcgtcccactcacccagtcagtcctctcagccgtccctggagatggcccaatgatagctaagaagcctatatattccccaatgttgtaactcatttacacagattttaaagcatttttcttgaacattttggaaatacaagatttgaatatttcacccacctttttttttttgatgttccaaaaaaattttaagaaatgaaatcatgccttaacaacatggcagaaacttgcacataagagcacagtaaatatgcagtcagcctgcatctctgggtccacccttcttgtgtttctcaacagtcattgtttttgttaatgttggatcactgcttcttgtacttaaactagttgtttaggtaagtaccctcttgcaaaggcttagaggtgccatcttgtggagaaaaatgcaaacaggcacatttggctgtgtgttaaggaaatgacaaagatgccggcgtgaatctccatcattgccttctggccatggggacggtcccgtgagagccttctggggacctgcattggtagacacaggccatctgcgctcaggaggccctgtaaatcaggccagtgtgcaagcaacctccatcctggatcagagttcatcaacccaactcactattgcctttttgctgataatctagcctccagaactctgccttatagggtgtaggcagtgtctctctgctccattctgcaaggaacttcctagtcttgaccccttatcagccccaaaccacagcttctaacagacccatcccacgtggttttttcctgctgccagcccctcctgagacactaaaaaattacaataaaatctggccagacatattatgatctctttaaacacaattcaccatacggctctacacattaaaagtaaagtgaaagtctagaggtttctagtattctatacaaaaatatggttaccttacttttataatagagcaattatcactgtcaaaagctatttcaggcctctctcctccttcccccatttcaatccatggaggaggaaaattatgaaagtaaagcattagaattttagagtttgggatatccccaccctccagagaacgatgacccttgttggaattgggggaggtggtaattatcttacagaatatgatatgtttacctctcgggactcctttcttcagatttgtaaacatagctgcagttgattcttacccagttttatcctacaagagcgccaacattttcttccagttgagtcccttgataagatgctatcctattatgaactaggatgaggtactgaaaagtgacagccataagcttgattaaaaccagatcgctcgttttacaattgctttcatttaggaagccaaaataccttttatgccatggaccatttcttctcttcaaatgaatggcatcgtcaatttgatcttcattgattcctgtttccaatttaattttgtgtatatacagcaaatttccctccctttaaacatggcaggattcttcatatcagggctgtatctctttttaaaagaaaaattttggcaccagaagggaccttagagatgagccagttcgaagagcaggttggtcctgtaactttgatcttttgattcttcaaccagctgctctttcattcaacaaacgcttattaaacacctaccaagtcgcaggtactgtgctctttgcaatacataatgatactcctgctgaagctaagccaagaggcaatcttaaagaactcgagaaggtttgatagcagtaaggaactatttttggaaactggataattaagtgttctttgcttattagcttctctgacatttacaaaggctgtttgtgcacttctgtggaactaccatcattttaaagctttctggggaatctgtcatgtgctcctcggtgtcccatgagctttggaataaagagcagtgattctcaactgagggtgattttgctcccatggggaacatttggcaatgtctggagacatttttgtttgtcacactgagagggatgctcctggcatctggtgggtagaagccaaggatgctgctaaacatcctacaatgcataaggcaacccccataagaaagacctttcaggaccaaaacatcagtagagctggagttgagaagccctcaccttgaggaagaagagcaggcaggaggatgagaagctaggtttctaaaccctgacagtccttcaaccaaagcagttctgctcttctcattttgcatagtggagctttggatttccacatgagattttatttttgaagtatatttttttctacttaaaaaagttgaagactactgtggtagaagacaactctctgccttctgttttacaattgagtcactttggaacaaatcaagtgggtgtatatgatacaggatgagggcagtcaggggtagatttggaagcatctacctgagccttggttttggctgcacaggactcgacatttacaaacaatattgaagtgatttgattgtgtctgactttcaatttagaccagggattggcaatttttttctgtaaagggccagatctaaatattttaggctttgtcgactttcctgtttgtgttgcaactacttaatctgctgttgcagcacaaaagcagccatagacaataactaaacaaatgggagtgtttgtgttctaataaatctttatttataaaaacaggttgtgagccagatttggcctactagctacagtttgctgacccctgatttagactgtaaataggaaccttgtttgttttaccttcatgtctccgctgcctaccactgaattggcacgtagttgaagttggctcaggaaacatttactgaactatatcgaaggtcagttttacaggcataagtgttagaagattttaatgagaataacaactggaaaaagatccacccagaatagattaactgtttccttatgttgaacatttaggatgtttccaattttttattaacaatactgtgatgagcccttcatacagaaactgttggcctgatttcttatttcctggcataaattcctagaagaagaatttactggatcaaacggtctatattgctaaattgctttccaggaaggtggtattgatctacatgcctaacagtaataacaggaagatatttatcatatacaaaggatttctttcaacagaatgtcatgaataaacgttttggcatccatatgcatttccacgaattagctcaccgtaaatataagtaaattggtgtcagctactaatcattttaatattctcccatactgttctaccagcatgattattaaggcacgctgttttacctgtgggggtcatctagccaaacagttgaggttaccctatctcatgtgtttactgagcacacacagacacatctgcttcccattagggaatcaggacctccactatctgaatgcctggcaccagcctaccctgctgtgaaggacagaggcctcctccctgtgaaattcacctccaaatatgtcatccagattgctcatttccctcaggaaatttcattcaggttaattttggcacacaattgggggtaattcttgagcaatttctcctgtgatggcttgcgatgtgtaaaattttcctacaacgtgttgcagaaatcactggaaaaaatacaaaggacatctgatggttatccactggtctttgtaacagcaagaaatatctattctgaacagcagtacacgatgagcaagaaacataaaataaaggtagatcagagagtagatgttctttctggcctttttcgacaggtaccgtttgagcagtgagaatgtagaagctgtatgaggtgtcttgactttatggtgaaccttggccgattttgttttgttttgttttttgcacttcaaagttttctgaatttcaccaaatgaagaagaaaatatttctgactaagaagtagtagaaagtgttacagaagtacgggtgggtccgggtggttgtatgatgatgagatttacttaaaagtgaatagacttcagacaaaataaaatacataaagacaaagatgacaaaacccagcattttctgagaagccaccatattgcagaattctgctaattacattctatgtttgcctcatttgattttcccaacagtcctaaggggtagctgctccatccccatccaggcagaaaaaaaatcccagggctcagaacagctcatcaaaatgtccaaagatacagcactcgtcagcagcagagacagcacaagaacgcatattctcctgcccacccaaagcagtggtgcctcggaaagagtctagacataggtcagcactaagtcgtccctatcagcgaccaattgatcagcctcctgatacacaaaccagaattcaagccagattcgtttctgaacactgtccttgggaagaagatctggatggtggtggaaatgttttcagcacctacctcaaagagaagtgaccaatccagcatcacacaacaagccagggactgggccaggactgcaccccaggttttctggtttgcagcccaacattctttccattattccaaactgtttttcctgataaatgacatcagctagtgattatacctaatgattatacagctgtgttttggaggagactatcggctgctttaaagaaagtcatagcacgtaatctatacatgtgataatagttcatgaaacatcaaaaaaagtgcatctaaaagataacaaatacaaacaaggcctattcttaagttaatagtagtatactgctgtcaatggcatacatggttttgacaaagtgctttggttatgtaagatattatcgttagggaaagctgggtgaaagaccaccgaaactctctgcgctcattttaaacttcttatgagtcttacactatttcaaaataaaacattataacaataagaaagtaatgcaacaggaagatgggctagaatatgtattcacacactgtgtataaagtataatgttaaaagagccagtgtaagagagatacataatggggttggtccctcttaatcctgcaagaggagaaagccagagtcacttctaggccaggccctctccaggcttcatggtaactatgctttgaacttgttcctctgcacctaggtcactgtcacgatctactccttcaacaaagctagaaccctcaacacgacctccgatcctttgacctccgacttttacctaatggttaaaaacatggactttgatttggggccttgctttaaatccaagctctatctattattagcattttagccttgggcaaattaacctgtcttctaagtcttagtttcctataaatttcagcaatctcacagatggctttttaggattaaatggaaaaacatatatgtttccgaggacctagaagatagtaaagactgtaaatgttagacatgataatgttgaggaagatggcaaggaggaggatgaggacagtcagaaaggcctgttcattttgcatcctaagcatctctcaaatcccttcacgccatccccagtcccctcattcaggctgggatattgcaacatcctccagactttatgtacccaattgttaattatcgactttctaaaggagatttgatcctgtccagcacgacatagagcatgcaagcgttcctcatggcctgatagcttgtgattctctatgtgtatgtctgattgctcctgttagactcagattcccaaagtcaggacctgtgtctgattcagcttgggattttccaggcagccttttcagtgtagtcactcaacaatatcagtgatgaaatgcatctttacgtgtttcgatcttgtcatggcaggtccttcatgtcattcagatcctagtccagaggtcattccccagccatgccctcctagacatctagtccaattcttccctcattacatcatctgatcttcacaacagccctgtgcaggagaagggacagttgtcatgtgtgtaatttgcccttggcctcagctaaatattaaggtcttgaatatgtgttgtctgcctagttctcattctggagttgtccctcttgctttgtgaagtaaaggagagatatttggtaactccatgggaactcagtctcttagaggcctgggtagccactagaacactgaagagtgctcctagtatgttctaaggaagctattgatcatggctcccggtagacaggctgtcacctttagttcttggcatccttgtgcagccgcatgcttcactgaaaccaacctccaggctacttcgacatctaccaggaaaaactcttgcagcctttccttcccatgtctagattgatccagagcaaccatgctctgcaggaaatctggtgggggtgtgtccatcaaactgtgcagagcattttcatataatgtctgattcacaagatcaaataacattttgtctgtgtctgtggttatctgaagctatccatgctagtgtaatttccttgtgatagttccattctaactgggctggggctgaggattaatgtgattaatgtgacgtctgtcccatctttggcgactctcattcattcttgaaatatctctgacaccctagttacaggagagggactcactggacggttcattgtctccactctaggtaaggcccgctccacactgcagtcattgttaccaccgaaaagcaagtctgagcatggctctccccttctccagacatctgggggttgctgatgccataggatgaaaatctaattcttcaatctggcaaacaagattcttgacaagttccgctgaactctccagcctcgtattatccctcccagcaggcttgcacttcagccgtgtcattctgtgttctttcctacctgtgtacacattgttccctttaacagaaggacccctatgagaatgagctcagtctggacaagtcgagtccaggggtagcagcaacagactggaggttgggaagggagggagtgtgagatgtcactagacagggcaggcaatgggtgttgaccacctctcctgtctaccttcccccttgatgacagtcagaggcatctccttgattcagttggaatcttgccttgataacatgggttctactattcaaaacccctgttgatggtgacatttttgttgttgttgtttcaaagcaagggagaattcaaggggggtggggctatggaaatcacacatggaaaacatattccttattttttctgctaaaatgtgcgtggggcagattgagaaggatttgagggaggagaaatacatagcaaacatggcatttggaaaggctaattggatgtggatgagcatattgagatgatgttctattactgtcagagataatgttttacagagatgctatttgtgaagagagaccagtcattattgatgggtcaatgtgcgcttgggaatatggaagcaataatgcccaagggcagtgcctgcagaaaggtttcaatcaggcatgcaactagaggggaaggaatgggcaccttttgatttgactctgcccacaggatttgacctataggacctacctgaagagacccagggttgcataacaaaatcaaaagtggactttgactggtttgctgctcactttgtcctagagatgtggtctgattattgcacttagaattcaagaaagaggacaagcctgtgatttggagaatatgtgtctcaagaattagaataccattctgatttcaagtatctttccatatcctcatgacccagtgaataatcctgtactcacaatatttcattgtccaaaccataatctacccacttccatctgctcatggaaaagtgacagaattctttgttcagaacatgagtcccaattttagattcaggaaacatgatcctgagccctgtgaggtcaggagtggaaagcttcagaagtagaaaaagattttgtgaagatcattccattttgttccaaagtttaatttttggtttttttaaaatagggcctgctctgttgcccaggctggagtacaatgatgcaatcactgtagcctcatactcctgacctcaagtgatcctcccaccttagcctccctgagtagctgggactacaggtgtgtgccctcgcacctggttaattttttactttttgtaaagactggatcacactgagttgcccaggctggtctcaaagtcctaagctcaagcagtcctcctgcctcagcctcctaaagtgctgagactacagacatgagccaccatgtctggcccaaagtttaatttgtgtgtgcgacataaaatggtcccaacggaaacatgaatgaggagggagagataaagcaaaaagatcttagaatgagtaatgggaagattccttttgtcgggggagggaattcaggaaagtcagaattcctttatacactgatgagaccagctctacagacagcactctgtggtttagcaggttatgatctcgtttgttgatgattctggctcttgcttaccttcatccttctgctctgggaaaagtgctctggggtaaccaaggaaaagtcctgcttctgaggcctctagagccacagttaccagttagaggttcagctcccaaaccatttaatttcctaagaaactggtccagggaacactacttttggaggtactttgctaagagtagcatctataagaagacatgagggcaaacttcagtttcagatgtggcacttgtcatgattccagagagattctttatataaaaatcccagcacagaccatcctctccccttccagagtccaacggggattttcagaacaacttcactgtacaacctgtttaagtaaatttctagcaccctacatcttccctagtctttttcccagtgttatttttctcctgatcatttaccaccaccaaacaaactctgttttatttacttgtctggtttaccgtctgtggctcccaccccactcctagaatatacatttcgtaaatagctagaaaagaaatttcttgcccagggatcttctcccttccttcctctgcatgctcctgatacatactatgagtcttttgttttctgtctttttgcagagcattggctgtgatgactacttaggctccgacaaagtcgtggacaaatgtggggtgtgtggaggagacaacacgggctgtcaggttgtgtcgggcgtgtttaagcatgccctcaccagcctgggctaccaccgcgtcgtggagattcccgagggagccacgaaaatcaacatcacggagatgtacaagagcaacaactatttgggtaagcttggtctttttccagagaaaaccgtctgtccctgccagatgatgtattccttcagaactgtgagatagacacagcagtgtccgagagtcccggggcatgcaggcagtgcccctggggaatgtcaaagtaccacctggcctgcgccttgaaatgagaagcttgagtggagaacgttaaaaaaaaagtccttcttgcagataaatacttaatatctatacatttaaaccagcctttgcttttcccaagagaaacatggttataaagtggataacagcccaaattattgctctgagatgggagaagctctttgcaaagcgcggagaccagccagtgtttgttctgttgggatttgaggtggccagggacaattgatcctatctataccttcactccctggaggtctaaagcgaagccatttttctcttctttctgcctcatctgcctggggcagcagacctatacatagtagtgtgcatgtcttctgaaaagctgtggaatcctccagcaatcattttgggcaacatcatcaatactgagaggccaattttaacccatttttctacaaaagatctttgttgatacttccttctggactttggagctatttgcattccatctgataaaaaccacaagccaatcgaacacattatttatttatttattttttttttttgagacagaatcttgccctgtcacccaggttcgagtgcagtggtgcgatttttgctcactgcagcctccgcctcccaggttcaaatgattctcctgcctcagcctcccgagtagctgggaccacaggcgtgcaccaacacacccagttaatttttgtatttttagtagagatggggtttcaccatgttggccaagctggtcttgaactcctggcctcaagtggtctgcccacctcgacctcccaaagtgctgagattacaggcatgagccaccacgcctggccttgaacaaattactttttatgaatttctaatagatgtaagcatgtttaaatcagttaacaatataagggagccatttgtttaatgaatagctatattcatttttatcttttaattatttattgaacaggaacttacctaaaacaaactatgtgtcaggcactattcttaatgtgttgcaagcattcaatctttgaattctctcaacagggaaaagaagctattcccatccccactttacatgtaagaaagcaggcacagagagattatgtaccttgccaagctcaccataccataacgaggtggagctggggttcagaccaggcagtctagctccaggtgtagtagcctgtcaagagatgatacccatgggcagtctcagaacctaagttcctctggtgtgccactggccgtgcagcagtcaatggctgcagcacttgaaagactattaagtctgcaactttcaaatatcaggatcacccacaagttaactccagactcgggaactccatattctacagctcttccatccccatctagtcaaatgcagccaaaactaagtggttttacggggggggaggaggaagggatggcagatgggactcagagacaaacccaatcaaagaaaaactgttcaatttgctttgacaaaacccaggagccaccagagtgtcagaaaacctagtttcccagtgagtgctttgtatattctttttaatactgaaaaatagtgtttgtgtgtttcctcctttcttttgtactgctatgagatcacatctccataaacatcctgcctcctagaatgggaaatgttcttctggggattatttgaattgtgattgtgttcagatgtaccggcaaacaatgccactttttattagctttgtgttgcttttagtacattttccctggctatagttagttgtattcagtaagcagttttcaagctgtgccccctgaataaaaaatagacattctgggtgaatatctactggatgtctgaatggaggaagctctcggaggcttgttgttttcatctggagtatgggaataagaatcttcaccttataagtagtcatgcgattcaataggatacagatatttcagactcggcagagcccctgacacctattaggcagttgacaaatgttcattgcctttcttttgtctcagagagattgtcagttttgattccatcaaaattgtggaataaacatttcctctttccttaaaaaagatgaagggaaggcagagggaaaatggagtcagtgaggggcgggcagggaggttcatgtctgtaagcccagcgctgtgggaggccaaggcaggaggactgcttgaagtcaagagttcacgaccagcctgcgcaacatcaagtgagaccccatctctacaaaaaaatttaaaaatcagccagatgcggtgacacatgcctatagtcttagctacttgggaggcttaggcatgaggatcacttgggcccaagaggtcagggctgcagtgagttgtaatcgtgccactgcactccagcctgggcaataaagcaagacactatatcaaaaaaaaaagaaaaagaaaaaagtcaatggagaggtgattcaaaaagtcaagttcaacttcctatgcccaaagatcagtggggtgcacatgaaatcggtagcgtccatgaaaatattacataaggtcccgtgtgtgaaggagagagagcagaaacaaaagagcaggctctaatgaaagcagattccagagatgacgaacagagattccttctagagcacttacgtcacctggggtgctttgtgtattctctttttaaaaaattgatctataattcacatgccataaaattcatccttttgaagtgtacgttggttacggcccttttctcttcacaggtgttctctttaccaaacccactattcctgctctgtgaagtctgtatattttaaaagtaaatatacatgagattgcttgagatcatgtagaaaccactaccaggtgtatctagctattttgaactcttcgacggctattttttacattgtacattgtcaaacactgaaacctttttcaaagagatatgtggtaggtttctccataattctctaggtaacaatgagggttctggttttcttaccttgtgagttctggctatgaaaactgtattttctgtaaaatttgacttgatacacaaaatttactcagctatttgcataagtttgatctgcagaataagcaatataaaggaaatgaatacttcacatttgtatcattgctttcaagattccagaacttttttttttttccgagacagagtctcactctgtcgcccaggctggagtgcagtggcgccgtctcagctcactgcaagctctacctcccgggttcacgccattctcctgcctcagcctcccgagtagctgggactacaggcgctcaccaccatacccggctaattttttgtatttttagtagagatggggtttcaccgtgttagccaggatggtctcgatctcctgacctcgtgatccgcccgcctcagcctcccaaagtgctgggattacaggcatgagccaccatgcccagccaaagattccagaacttttacaactttatttttttttagtttcctgttgtttccagaattacctttagttatttgtcatgcaaataaaactttccctgtgaaatatttggtatttttttaaataactgattccccagtaacaatagaaaatagatttctatgaaaaaggcagacttgtatttattaatgctgaagctgatgatttaatcacctcatttaatcttattttttacttttattttagcttcaggtgtacatgtgcaggtttttatataggtaaaatcacgtcactggggttttttgtacagattgtgtcacccaggtactaagcctagtatccaatagttattttttctgatcctttccctcctcccaccctcaagtaggccctagtgtctgttgtttctctgtgtgtgtccatgtcttccatcatttagctcccacttgtaagtgatagcatgtggtatttggttttctgttcctgcgtggttttctaagtataatgatctccagcttcacccatgttcctgcaaaggacattgtcttattctttttatggctgcatactattccatggtgtatatgtaccacattttctttctctcatctgtcattgttgggcatttaggttgattccatgtctttgctataatgaatagtgctgcagtgaacatatgcatgcatgtgtctttatggtaggatgatttacattcctttgggtatatacccagtaagggattgctgggtcgaatggtagttctgtttttagctcttggaggaatcaccacactgctttccaccatagttggaaaatatttacatttccagcaacagtgtataagtgtttccttttctccataacctcgccagcatctgttcttttttgactttttattaatagccattctgactggtgtaagatggtatctcattgtggttttgatttgcatttctctaatgattagtgatattgagcttttttgcatatgcttgttggccatacatacgtcatcttttgaaaagtatgtcttctgttcatgtcttttgcccactttttaatggggttgtttttttttccgtaaacttgtgaaagttccttatagatgctggatatgagacctttgtctgatgtatagtttgcaaatattttctcccattctgtagggtatctgtttactctgttgacagtttcttttgctgtgcagatgctcttaagtttaattacatcccatctgtcaattttagcttttgtttcaattgcttttagcatcttcatcatgaaatccttgctagttcctgtgtccagaatggtgttacctaggttgtcctctagggttttatagttttgggttttacatttaagtctttaatctatcttgagttgatttttatatatggtgtaagcaaggggtccagtttcaatcttctccatatggctagccagttctcccaggaccacttattgaatagggagtcctttcccaattgcttgtttttgtcagctttgtcgaagatcagatagtggtaggtgtgtggccttatttctgggccttatttctctattctgtttcactggtctatgtgtctgtttttgtaccagtaccactctgttttgattaccgtagccctgtagtatagtttaaagtcaggtaacgtgatgcttccagccttgttctttttgcttaggattgccttggcctttggggctctttttttgatccatatgcattttaaaatagttttttctagttctgtgaagaatttcattggtagtttggtaggaataacattgaatctgtaaattgctttgggcagtatagccattttaatgatattggttcttcctatccatgagcatggaatgtttttccatttgtttatgtcatctctgatttccttgagtggtgttttgaattaaaatttcagagatctttcacctccctggttagctgtattcctaagtattttgttctttttgaattacctcattttaaatgattttttaagccctcaatatttaaatgagcatccctaggattctctttttttaacttttaagttaaaggtacaagtgcaggtttgttacatagttaaacttgtattatgggggtttgttgtacagattatttcatcacccaggtattaaacctagtacccctaagttatttttcctgatcttctccctcctcccaccctaggcttctcagttaataacagtagtcataccacacatatataatacttcagtctccaaagcattttcacatacatggccttctgatctttaacactggacattatttattaatactttgcttattccaaaaagctttagacgtactaaaacttactattaatactttgcttatttcaaaatgctttagacttactaaaacttactgaaggtataattatagagttaagatatgaaaattaaaatttaaaacttaaaaactaaatagaaaacggaggcatgtattccagaaaccttggctgatatatttatagtgatggtacattaaagttaactctgagtttctggcttaatttagtttgaccatcaaggcctagcctactagactcagattctgaaggctttgggtctggccccttcccagccataactcctaggaggagtggcctatgtagagctgggggaagaggccaactcaccacaatgcttactcttgtctccaagcaaagctagagaaatcataacatttaatggtgcacatatttcaggagataagatgtttattcatctcatttggggttatacaccaatgaaactctgcagacttgagctccaaatttctgtttatttgaatttgtttacatgctccaaaatatagactgtttcatgagttctagagtcctaaatttttttaaatgggaaagactttagaactcctgtatctattgtaagctatgaattctccttttgtatgtgaattattctgaactctgccatttggggaaaaaaaagtttatttaaatgattgacattttgtattacttgcctttttcttaataaaagatattgtaaaattattttagctgaaatatcaaagtttggcatagttcagtcagttcagtttactaatgtcattatgcaacagttaagaaatcagacataaaagcataccaagcacaaattgattatacaagacatgtaccacctgccaacatgttagattgtcatagagttttagacttggaaggaatttttaaagatctgtaaactttcaaaaataaactggcagtattcttacttttaagcatgttctcctaaaagttttaaacaacagtaatggtcagcattgaaaaaagtcaagtatcatggatcatctataatttgcaagctttaatttattctttgaacagctttctttacaggaaacattggatgtttaaatactatgatgtcttacattcgtatgactattaatccctaatattttttgcatgttcactgtaaaaatttcaaggaagacaaatgaaatagagcaaaaaggtaaaattccctcttcatacaaactccacacttgatccactgccttcaagtgtaaagactacttgaaggtaaataaccactgttcacagttcattgtgtattctccagccctttctgtaagtaccaataaatagctattttctaaaattgatattactatacatactttttgcaatttgtgtccttattttaatatcatatcatgggtatcttttcatattaatacatataagcctatgttattgatttttttttagtgcagagtattctgtacagtggatgtaccattatttatttaggtacttccctactgagggatgtttagattgcctctagttttctaacattacaaataatactttagaattttggttcaagatggcagactgagcacatgagcttttcttccctttctccaaagattccttcaaaatgatactaaagcgatttaactaaaagatgtgacctaaaaccactaagactggagtgggggcatcagtgagcaaatatcttaacagatttttggaagacagaaagcagatgggaggatgttcactagcagagcagaggaaatcacagcccaggtgtgcagagggggtctgggatgagaaggggctgacctgtgagatgaagccccaagaggctctgagcctggaagacagcaggtaaaagggaggggagaaggggagaatgtggctgaaaatggggaaagaagtgaaaaaacctgtctgtggaacagacacccccactcccagcacacacacacattcagaatgctggcattgcctcctcgtccaaatacggaaaggaactaggacatggatgagaggtgggtgctgcaagacttctgtcttcattgtggaattggagaaagggcagcttgctgactggtaccccactctctgactctgtagaacttagccttttaacaaactctcacaacgtgcacagggttctcaggaaaccttcacattgcttttgtcttgaatgccaatggataactgaagataacatgaatgggtgaccaaggatcactagacattttcttaagcctatagcatgaaagataaggcccaagataaataactggaaaagttatttctggaagaaactgagcaaattcttggagaagaaaacttaaaggttctctaacaagtactgcttccatgaatatcctaatatgtatatcttttcatacttatataaataattctgtaggatagactcttggcagaagaatttgtaggtcaaatggaatgcacacttaaaattctggaaaataaagcaaaatttctctccaaagtcgtgccaatttacactcccaccagaagcacatgaaataattctttcttcacaccgttaccaaaactaaatattataagtgtacttaattcttactagatcttttttatttgcattttcctgaccactaatttttattgttctttatactctatgactttgacatttttaaattgcacttgtagttttcttattgattttaagaactcatatacataatcagtaataaccatttttggtgatgtctatctaaaatattagcctttatcttacatttcaactctgcttaaattatctattactctgtggtgaaaaattttcatctttttttattatactttaagtcctggggtacatgtgcagaaagtgcaggtttgttacacaggtatacacaattctgtcctttttttttgtggctgttggttttctgacagatacctttcaccaaaataaggatttttctttctataactagcttttaagaatttttattaaaacttgcccgttttgtttagttttcttctgaatgtctgatgatcaatccttagttgtcagtttatatttataaagataatggatagttgcttattctaggtacgttcagttgctttcctccacaattactttcatctgtttttgcaacagtccttttctccaaatggagcagagcccagtatgctgccaggctgcagtcaggcaggtttcctctgagtgtgcgtgggcaggggtcagacaggcagacagatacaaatcatcctctcttagaggcatatgaggattcagtaggataaacacgaattgcctagcatgataatgaatttaatacatattttccctgctttatctcaagactccaatatgtatcagtgactgcttaacaaacctgtttagtttgccttgcaatttccttgcaatgacaagaaacaggcttctcttcagctccactgccaaggaagcctccaggattatgccacttcgggtgtacctttttttttattattatactttaagttctagggtacatgtgcacagtgtgcaggtttgttacatatgtatacctgtgccatgttggtttgctgcacccattaactcgtcatttacattaggtatttctcctaatgctatccctcccctatcccccaccccatgacaggccccggtgtgtgatgttccctgccctgtgtccaagtgttctcattgttcaattcccacctatgagtaagaacatgcggtgtttggttttctgtcctggcaatagtttgctcagaatgatggtttccagcttcatccatgtccctacaaaggacatgaactcatccttttttatggctgcatagtattccatggtgtatatgtgccacattttctttttttgtttgtttttttttagatttaaattttacatatatgtatatatatactttaagttctagggtacatgtgcacaacgtgcaggtttgttacatatgtatacatgtgccatgttggtgtgctgcacccattaacttgtcatttacattaggtatatctcctaatgctatccctcccccatccccctgccacacaacacgccccggtgtgatgttccccatcctgtgtccaagtgttctcattgttcatttcccccctatgagtgagaacatgcggtgtttggttttctgtccttgcaatagtttgctcagaatgctggtttccagcttcatccatgtccctacaaaggacatgaactcatcctttttttatggctgcatagtattccatggtgtatatgtgccacattttcttaatccagtctatcagtgatggacatttgggttggttggtaccaagtctttgctattgtgaatagtgccgcaataaacatacgtgtgcatgtgtctttatagcagcatgatttataatcttttgggtatatacccagtaatggaatggctgggtctctagatccttgaggaattgccacactgtcttccacaatggttgaactaatttacagtcccaccaacagtgtaaaagtgttcctatttctccacatcctctccagcacctgtagttcctgactttttaatgattgccattctaactggtgtgagatggtatctcattgtggttttgatttgcatttctctgatggccagtgatggtgagcattttttcatgtgtctgttggctgcataaatgttttcttttgagaagtgtctgttcatatccttcgcccactttttgatggagttgtttgattttttcttggaaatttgtttaagttctttgtagattctggatattagccctttgtcagatggatagattggaaaaattttttcccattctgtaggttgcctgttcactctgatggtagtttgttttgctgtgcagaagctcttgagttcaattagatcccatttgtcaattttggcttttgttgccattgcttttggtgttttagactgaagcccttgcccatgcctgtgtcctgaattgtattgcctaggttttcttctagggtttttatggttttaggtctaacatttaagtcttgaatccatcttgaattaatttttgtataaggtgtaaggaagggatccagtttcagctttctacatatggctagccagttttcccagcaccatttattaaatagggaatcctttccccacttcttgtttttgttaggtttgtcagagatcagatggttgtagatatgtggtgttatttctgagggctctgttctgatccattggtttatatctctgttttggtaccagtaccatgcttgttttggttactgtagccttgtagtatagtttgaagtcaggtggcttgatgcctccagctttgttcttttggcttaggattgtcttggcaatgcgggctcttttttggttccatatgaactttaaagtagttttttccaattctgtgaagaaagtcattggtagcttaatggggatggcattgaatctataaattaccttgggcagtatggccattttcacaatattgattcttcctatccatgagcatggaatgtttttccatttgtttgtgtcttcttttatttttgttgagcagtggtttgtagttcttcttgaagaggtccttcacatcccttgtaagttggattcctaggtattttattctctttgaagcaattgtgaatgggagttcactcatgatttggctctctgtttgtctgttgctggtgtataggaatgcttgtgatttttgcaccttgattttgtatcctaagactttgctgaagttgtttatcagcttaaggagatttggggctgagacgatggggttttctaaatatgcaatcatgtcatctgcaaacagggacaatttgacttcctcttttcctaattgaatacccttttatttctttctctggcctgattgccctggccagaacttccaacactatgttgaataggagtggtgagagagggcatccctgtcttgtgccagttttcgaaggaaatgcttccagtttttgcccattcagtatgatattggctgtgggtttgtcatgaatagctcttattattttgagatacattccatcagtacctagtttattgagagtttttagcatgaagtgctgttgaattttgtcaaaggccttttctgcatctattgagataatcatgtggtttttgtctttggttctgtttatgtgacggattatgtttattgatttgcgtatgttgaaccagccttggatcccagggatgaagccaacttgatcttagaggataagctttttgatgtgttgctggattcggtttgcaagtattttattgaggatttttgcatcaatgttcatcagggatattggtctaaaattctctttttttgttgtgtctctgccaggctttggtatcagaatgatgctggcctcataaaatgagttaaggaatattccctctctttctattgattggaatagtttcagaaggaatggtaccagctcctctttgtacctctggtagaattcggctgtgaatccgcctggtctgggactttttctggttggcaggctattaattattgcctcaatttcagagcctgttattggtctattcagggattcaacttcttcctggtttagtcttgggagggtgtatgtgtccaggaatttatccatttcttctagattttctagtttatttgcatagaggtgtttatagtattctctgatggtagtttgtatttctgtgggatcggtggtgatatcccctctatcattttttattgcgtctatttgattcttctctcttttcttctttattagtcttgctaacgatctaacaattttatcagtcttttcagaaaaccagctcctggattcattgatttttttgaagggttttttgtgtctctatctccttcagttctgctttgatcttagttatttcttgccttctgttagcttttgaatttgtttgctcttgcttctctagttcttttaattgtgatgttagggtgtcaattttagatctttcctgctttctcttgtgggcatttagtgctataaatttccttctgcacactgctttaaatgtgtcccagagattctggtacattgtgtctttgttctcattggtttcaaagaacatctttatttctgtcttcatttcgttatgtacccagtagtcatttcaggagcaggttgttcagagagtctcgctctgtcgcccaggctagagtgcagtggcaagatctcggctcactgcaaggtccgcctcccaggttcacaccattctcctgcctcagcctcccgagtagctgggactacaggcgcccaccaccacggctggccatatacttttcttcttagacatcaaaagcctacctgatttaactggcacagttgtgtgttcttatggcttttgcacccaactgtctgtcggagtagttgcctcttcccagaagaacaaaaagagaaagaaaagtagacatgcttcttctgtgcgtctcctgtgctgacctcattctattcagagaatggtttctctaggggtataaatgtgtgatgatgtgtttatgcctctccaccttactcccccagccctaggctgcatccagtggtctaagtggcattcctctgctcttgctcttatgtggtctccagttcttggccttgtcttccatttacagtccagctctgcccattgaaattggtctttgcagagctcttatttccagctgggatgctcttggacaagttccttaacttttctgagattcggtttccccataggcaaaataggaaaacaattacaatgtcatagaactattacctttaaatgagaaaatgtaggtaaaataccctgcatgtcaaccctattagttcccatatctccctggatcagtgcttttcaccctggctgcacattgcactcatgggaggcatgctgtgtgaggcatgtttgaactatgctgatgcctgagtcccacctgcatgtttaattggtcaggggcacagcctgacagcctggacttcaggatttttttttaaactttaaaggtgattgcaatgtcctttcaggataaaaggccttttccctatgtcagtaggtgtcaactagggactattctgcacccgctccccatacatttggcaatggctggaggcatttcgattgttacagtgagggcagagaaggggggaggcgggtgctgctggcatctgtcgatagaggccagggatgctgctgaaccttccacagtgcacagggcggctcccacagtgaagaattattcagctctaaacctcagtggtgctgaagtaagaaaccctggcctgtttgatcactaagatccctttcagtgctgaagttttgtaggccacttatttcagaatgatatttttaaaataacaataaatatctaaggttttctttgaatgaccgttttatgtaccattaagttcacattcatcagctcactctgaatccttagcttccaatccaatccccctcctttggtttactttccagatttcactcagttcttggtagtgggcccctagattgcttatctctgaacagctgtgaggcagccccaacaacagaagtaccatcttaaaatgcccttttatagccagccctgtggtgtttggagtcctttcttgctttcttaatacatggcagaagaataaaggacagaaaaaaaagaaaagcaaagaaagtcagtttttctttggattctcatagaactctgatcatctctccagctcggtacttaaatatattttactgtagtttatctgtttacatgtctgtgctcttcccggtgaggccgtgcaatccttgaagacaaacaggccagccttagacagtcttctctggagtacacaccatgagccaggaactgtgctcagtggtgtggatacagaaataaaggtcgtgctggctctcctgaggcccatgcatggtgtgcagcccgtgtgggggttctgtgctcagacatcttagcccctcttgatcatgagacctcgctcgtggtactggagtcatattactactcactagatgcttggaatcctgggtctcccacctccttcatctaaccctcacaacactcacacaaggtgggaactaatgtcatcatctgcattttatagttgagggacctgcctgtggtaaacaatttgtgaggggtggagtcaggacttgaacctgggcacaggcctcacttatgaccttccctgcatgtttatgaccatggccatttgcaagaaaaatatggcagggtggggtggtatttgtgtcttctcacttcccagccactggaagaaagacatgttccactgaattccttgcagccatcttgcaccctcctcactgttccatccctgtccccactgctacctcaaacttgattacaatcatgcatcccatgctctctttgggaatccttgggctaaatctccatagttattatcttagtcactagacttgcaccatcttgcctcagcagaccttctggaactagcttttaaaagagtatccagctcttaaaaagagtagaacattttagagaaataaaacatcaagtgtgtgttttttctttttttattgtggtaaaatatatataaacataacatttatcattttaatgatgttaagtgtataattcagtggcattaagtacattcactgctatcaccacgatccattttcagaatttttttttgagacggagtctcgctgtgtcgcccaggttggagtgcggtggcacgatctcagctcactgcaacctctgcctcccgggttcaagcgattctcctgcctcagcctcttaagtagatgggactacaggcatgcaccaccatgcctggctaatttttgtatttttagtagagacagggttttaccatgttggccaggatggtctcaatctcttgacctcgtgatctgcccacctcggcctcccaaagtgctgggattacaggtgtgagctactgcgcccagcctcagaatattttcttatcccaaaagctgtactcagtaaacaatagcccccttctttccccgtcctccaagcccctggtaacttcaactctctgcctcatgcactgacctattctaggaacctcatacaagtagaatcacacagtatctgtccttttgtgtctggcttatttcacttagcataatgttttcaagattcatccctgtggtaatatgcaccagaatttcatttcttttttatgtatatgccacattttgtttatccattcatctgttgatgggcacctgggctgtttctctcttttggttattgtgaataatgcgctatgaacattggcatacaactacctgtttgagtcactacttccaattcttttgggtatatacctaggagtggaattgatgagtcatatggtaactctatatttaactttttgagaaactgccaaactgctgtctacagcaactgccccattttatcttccaaccagagtttcaatgtctccacattctcgccaacacttcaagtgtgtttttgaaagagtatttaagcatgtgatataataggcaccaatggtcagctctgaggcatcaggacaagatgctgcgctgggctttgttacctgctgcaggtcatggcagcccctggagacgattaagtcacaaacaactcaaagtgatatcctgactcttggctgaatgttcctcgtcaatgctggtagatgaggaaagtgatcattgagtatttgttttttatttggactcagttcttgccttttcttcaccaaaagcttttatgactcttgtccagaaccaaatattcacaaaacaaagattccatgccaaagagactgtgccctcttgctgtgatttggaaagatgctgttgtttgttttagcactcctggacttacttttggattacatactttccacatggtgtctgacagcgcacctccctttgatttaggacagctctgatgtccttgcatctgtttacagggactttcttttcactttcagagtcctttgccttgaaaagctttcagatatgctggaacgaaaggaaatcaactctgccccacccccttctgctgattgtttcacattttctgctttgtattgatagttagcacctagctaccctggaaatgtgagactgagttttcctgtttgtacatggatttgtctttcattttctggggaaatagttaagctgtggtttgtttttgcttttaattgtatcgtctgtctcagaaatatgcaaaatgcccacacctgttttcctacacttaatgtgatactttcctcaaatgcaggaaacagttgctgagctggctgagtcttgaatttttatggaagtgatttgacaccgctatccttgcatgaggaataacattgtctcctagcccactctaggcagcagcgcctaaggacagcatcttcagcagggctgttaatcgctcccaggtctcctatctggattaggataatagctgagaatccattatctgcaagtccaatgtggttaacactgtccctagatccgcctattccctaacccacttggaagtgcatttaaatcttccctgtttgaatcaaagtcttgcttttttgtgatatgttagatcactgagctaccacattagggaactaatacaagctaagccccaagaagagatatctaaggtttaaacaacgtttaataaatatagttgacttaatgaaagagaagtgactcctgagaaaaacagtaatcttgaagatttcttaaccaacagctggggatgacccaccctttgcttctccatggttactgctctcactgggagcctctcttccttcctcgtgagcatcagagcttcagaaatgtgaaacctgccttctaagattgccctcttctctcttcaggccttactttcccatggaagaagttgagcaccctttccccttttttattaagcagaactctaggcacattgtgctcttcttctaaaccttgaagtcttgcagataagtcactgaaggggtggtctttgaagataagcctcctttctccctctcatcatgaaccgcctttattagctttgctctggctgttttagcatcaacagctttaagaataacttttggcatctcctgactctaccctactctgtccccaagccagacactattctctgaattagaaaccatataaatgtcagcatgggaaagactcactccttctgtctgaattctgaatcaatattcatgttcttccttggaaaatgtactttcacatagccccaccctttaactttctttgtggccttatagtcacgcctatatttgttatgctttgggggcagaatttgtctcattgatcaatatttatttttccctttattatctagtgtttagtgtgaatcaggactgattttctttctttgattaaagaaaacattgctctttgtctgaattgatattcctgcaagataattaaacatttcaatggatatctgtaagcacctactgtgtacaatatattatgaagagaaagagttgaacgatacatggccccttccctgaaaggcatttactgtccatttggaaatcctttgatgactttgaaaagagacccagtgctatgggagtgcaaaggatggagaaattaactctaataggataatcagaggaggcacctgggggaggtggtatttaaactgggcttgtagagcaggggctggcaaccttttttttggaaagaccatatagtaaatatcttgggctttgcaggccatttggcctctgttacagctactcagctgcacagtgagaaagcagcatagacaatatgtgaatgaatgggggtgcctatgctccaataaaatacgatataccaaaaaagccagccgccaagtttagccctcatgctgtggtttgcccacccttgttttggtggatggataggcttttctcagaagaaatagggaaagagcatttcaatctgaagaagcagcacaagctaaggtacagagaaggaagaatgtgaggcatgttctggacttagtcacttatgaaataagtgagggtgaccttgacatttgagactgcaaatacagggtatagctaggcctgtttcatcctgaaccacatcctttgtattaaatctgaagatgctcggctggagaagagttgtgacagggtcctgcctctgctctgcagacagtttggggcagttgtagaggaggagggggagcggctgctgtaaaaaggcctggcctataggaagagtctgaggcaggggaagtgactaataacaaggatactgctatgtcagtgggctctgtgattccaaacagtaaatttgaccgtgttagaaaaccagagtttttgcgtgtgtttttaatcagtgactgtaggttgagcaccttatgatagaagaacgtaatacacaccacagtattgctacatcagggagtgataaactgcacttggaaacttgagatgatctggagcaaatcagagtagaaaagacggataaataattttgggagttggaaatttaggtaatcagtcctctttaaaaagaggggagtggttgcatttgagataagctaaatcccttcccttgtctctaaagcagtacttttgaaacctagtccagcctttcctgtctttcctgttttgttggtaagttctgggaacaccaaggttctctaagccttctcccatacaaaggtcccaatccaaacagcaggttctcagcaggcagcatagatcctgtcctacatgaatgctttcagttgaattccttgatttttaattatccctaacaaatcacatatttgccaagtttttagaattgctgcgagaagaccaatattaacctgtaagataatttctgttggtagggtaaaaatttgttgatcagagaaaaaggatttaatcaactgcattaagatttcttgtaaataaatactccacatcattgctaggtcctccttaacttacaaaatcgtgcatggctaggactcacttggaattttaagaaaaatttgaattatcagtttcactggccaaaggacccaaagtactgtctcaaacatttcagtatgagcagaattgtgcaagttaagagttctactctcagccacgcagctttctggctctatagccttcagtcagttacctgacctctccgtatgtcattttctttacctgtaagatgaattgacaataatatttatctcatagggttattgggaaggttaaataaggtaaaacaggtaaagcatctagcacaatgactggcacaaaatacttattcaataaacatcagatgtcattactagtaattttttttttttttttttttgagatggaatctcactctgttgctcaggctggagtgcagtgccatgatctcagctcactgcaacctcttcctcccaggttcaagcaattctcctgtcccagcctcctgagtagctggattacaggcatgtgccaccatgcccagttaatttttgtattttagtagagacagtgtcaccatgtgggctagggtggtcttgaacccctgacctcaagtgatccacctgccttggcctcccaaagtgctgggattacaggcatgagccactgctcccggccctactatggtattttaattgttgctactgttatacaaattagtccaggattatatggttagagatccacataattgtgctttgagactttgtctagacaataaatacctttccaaaagcaaaagacaatttttttctagacttatcaagccaacaatcagtatcaaaagtttacgtggcacactgggcgtggtggctcatgcctgtaattccagcactttgggaggccaaggcaggtggatcacctgaggtcaggcgttccagaccagcctggccaacatggggaaatcctatctccactaaaaatacaaaaattatcagagtgtggtggcgagcctataatcccagctactcgggaggctggggcggcagaatcgattgaaccgggggggtggaggttgcagtgagccaagatggttccacttaactctagcctgggcaaaagagtgaaacttcgtctcaaaaaaaaaaaaaaaaaagttttacatggcacatgcctttataactaactgatagtgaactaagatcaagcaccgtttgagttgtatccagtaaatatggtgtcccctaactcagctcattggcttgaggtggtaccaagatgttcatgggggcaaacggaagttgatcaacacttgtatttcagacctaggcaagtatgaggattgggctattagatgttcctcttttaatatgaatactgacttactattctctgatgtgttggtctttaaaatgttcagctgtgcctcagagaacagtgaaatttctgctgtcagcatgtgagggtcatgggcacggtctctcagtaccattcagcatggggacccttggagcccctgtgaaatccgaccccccctggaaaggatgaagacatagttcaacccaaggtctttatggacctgctgaattcattacaattaagtaagttaaactttcatcacagactttatcccctcttctcaaagcacaagtgaaaaagagatacctgtttaagtgccaaaagcctattgtctggccagagccattggctggcttagcacttacttatttgttggataagctttttattgaaatgctaagtataaatacacaggaaaagttctctattcaaaactataagtacagcttgatgaattttcacaaagtgaacacagtcacgtcactagtactcagatgaagaaatagaacttgatcagctcccagaagccccttccagtgtcccctctctgtcactaacctccccaccgcagaaagaaccactaccgtgattgttcacaccatacattagtttttgtctgtttttagaaaaaccttatataaatggaataatacagcatatactgttttgtatctggctttttttttttttttctcaacatttttaacatttaccttggagtagagtataaaatgagaaggtagatttcttcctaatgtttagccaattttacaaaccaatttgttgagtggttcatttatttaacattggaatgtgtagaatgtgctaagtcacatacttaccatttattgtattccatttatctgtcaaataatttctgtaccacacagagtattttggttatcatagctttaaaatgtgatttagtatctggcatggcaattcttccctcttttgctactttctttctttctttctttctttctttctttctttctttctttctttctttcttcttcttcttctttttttttttttttttttgagtcgaggtctcactctttgcccagtctggagtgcagtggtgcaatcatggctcactgcagcctcaacccccctgggctcaagagatcctcctacctcagcctcccaagtagcgggaactacagactcacaccaccatgcctggccgatttttgtattttttgtagagacagggtttcaccatattggccaggctggcctcgaactcctggactatagtaatctgcctaccttgacctcccaaagtgctaggattacaggtgtgagccatcgcacccagccttgcttcttttcaataacaattttcagacagtctagcattattccaggtgaatttttgaaaccattttgtcatatgtaaggaaaaaaaaaatcctatgggtgtttgcacgcaattatgttaaattcattcaataaacatgtactgagtccttactgtgtgccgggtggaattctgggtactgggaatactcagaaaagggcacaccagccctgatggcatttacaaaattctaccggggaaactggagacgaaagaacaaaaaggtaatttcagatgatgagacatgctataaaaaataaaacaggggaagaggagaatgagtgctggctggaagagcaggctgctatttgagttaggttgtcaatgtcttaaggaatgtgatccttgaattccaacctgattcatgcccagagtgtattagatctataaattcatttgggaggagtagacatggttaaaatgttcagtctggccaggctcagtggcttacacctgtaatcccagcactttgggaggccgagccgaacggcctacttgaggtcaggagtttgagaacaacctggccaacaggtgaaaccccatctgtactaaaaatacaaaaatttagctgggcatggtgggaggtgcccatagtcccagctactcaggaggttgaggcatgagaatcacttgaacccaggaggcaaggttgcagtgagccaagatcacaccactgcactctagcctggacgacagagcaagactccatctcaaaacagcaacaaaaccattcagtctaagaacatagcatttattaccgtttattcaaatagcttacatctgccagtgaagttttgttattttccatataaattctctgcattccttgtaaagattcatcataggtatttaattgcattttgctgtggtatgatgatgatgacaaagaatggaatctgttcctttttatctctaaaattcttatcaatatacagaaaagttatgggtttttttatatttacctctatctggtaatttcgttgcgcttttataaattctgagtaatttgagttgattctcatcgttttctagtgatataatcataccatatagaaataattataatattgcctcctcctttccaatagtaattactctgaatagcagacatccttaacctatctctgattttaatgtgaatgctcctaatttttactagcaaggaaaatggatgtatgctcaataaatattttaattgaatatatgattacatgctcatcattggggtaagaaagtctatttctaatcttgtaatctttttttttttttaccaggatgagttttaaatgacattttggcacctacttacgttattttttctttaaagttttctatattatccttgaattcctggattataccctgtttcatcttgctgaatggtttttttaatgttctgttgaattcaatttgctaggaccttatttgggatttttaaaatctgtattccgaagtgagattggcctattgttttcattttgtgctacctctctgaggtggaggttaggttagtgttccaatttttatgtgctctggaaaagcttatataataatctgttccttcagatttttataaaaactcaccaataaaaaacatctggcactagaatatttttggaagaaattactgctaacttgtaacaattcttctatggctgtgagtctactatgttttcttgttcatcttaaatcaagctggtaattttttaatgtatctttttcatggagaatttcaaatgtagtatagaattacatatcaaattcacttttaatttcagcatcatctgatatattctcttatttgggctttattgcttttttattaaatttgcttattttcaaaaatgtcttggagaccagctctcaggttcttatgtgtgtttttctttcttgaattcacatacttctgttttatgatttctaccttggtttcctctttttaaaaaaaaaagaaataagagtatttaaattgcataaattcaatgtgtgacacttctgtttttgctgttttctcagtggttcttaaatgttttcatctcaggacccttttctcctctttaaaactgaagaccccagagagcttttgttcatatgaatttattcgttaatatttacagtattcacattttaaactgaaatttgagaattttatattactttgctttcaaataacaataataaactcactatataatacagtaacagtttttttaaagtaactatttcccagagcaaaaacattttgagaagagtggcatcattttacaatttgcaaatactgtatcttttaatgtctggcctaatagaagacagctggattctcatatctgcttctccaatctattgtgatagattatttggctaaagtatatgaagaaaatctggtttcacataaatatgtagttggaaaatagagaggtagtttagtggtcttttcagatcattgtgaatcttctcctttgatactataccaaactagaaaagtggtagtttcttaaaggttagttgcaatgggaaatctgaaaccacatcaataaacttgtcatgttctttatactcatgagtaagagaaaaaaaggcaaatagcatcttagagttgttatggaaataggtttaatctcaaagatcccctgagaggatcttaaggaccatactttcagatatacttttccaagtaaatggaaatatatccatttttttaaactttttattttcaagtaatgttaaatttacagaagagttgcagagagaatgcagagttcccatgtactcttaacccagcttcccctaataagaaatttttaaaactttatggtaaaatatatataacataaaatttaccattttaaccattttaaatgtacagttcagtggcattaagcacattcacattattgtacaaccatcaacagcacccatccatagaactttcttcatcttccaaaactgaaactctatacccatgatgtgtaagttggattcacttattaacccaaactacttgaggcatctgttgagatttacatgcttaactggttgcatttgtgctgttaatacctgattgtattgctttggagagtgtagtctgcatgattttgagggctgaggtgagaaagaaactgtttctctctctgtctactgaatcagggctatacagtttataccagacaaaaaaggacagctgttccctccacataggagcacctttgttttgagatggccagagcactgcctcttcatcacttcatcagtctctgtcagttgatataaaccatgaaatcagaacacatgggatagtgagagtaatgacatgacgtttcacccacaaacaccatattgctaagcttgggttataaggacaaaggaagaggaggagtccctagacccattcttgggggaaggggaagtcagtagtgatggaggacatggtgcactctgttgttccaatctctgtggggggaagcagtagcaagaaaactgaagatttacagccagataggaaatattttaggctttgcagtccctatggacactgtcacaactactcaactctcctatgcaaaagcagtgactgattccaataaaactttatttacaaaagcaggtggcaggccatatttggctcagagactgtgttttggtgaccgccacactaaatgaattcctggcaggggtccgaaaactggttaagacttaggaatatctcagtcaacactagttgaccatcttaaaggagagttctaccagcacgcagatgaacagtaaccaaggcaatggacagtcacatatcctgcctgttggctggtaccaaagcaggatatcacgcttccttccaacatttagttgataaaagtttcatagtcaactctgagcatgaggcaggtggcatctattaacccctagagaataaaaattaaactacagacttctcactagatgtccaccttctttaactgcttgttctttaaggactattgagtccacctcttaatgttgttaggttttgctgttttaaattttattctatatgaaaaattatgctataatttttagaagttatgggatatttgctgttaggaccaggaagctataaccagagcattattgcttcctcctgacagcactttctgtttttagaaaacaggcataagagaccgtgaaaaaccactaaaacggctgaactcacaagctaaccttaaaagccagcaccttggccaggcgccattgctcacaccggtaatcccagcactttggggggccaaggcgagtggatcacctgagccaggagtttgagaccagcctggccaacatggtgaaaccctgtctctactaaaaatacaaaaattagccaggagtggtggtgggcacctgtaatcccagttactcggaaggctgaggcaggagaattgcttgaacccgggagacggaggctgcagtgagctgagatcgtgccattacactccagtctgggcaacaagagtgaaactctgtctcaaaaaaaaaaaaaaaaacaaaccagcacctcagaaattcatctgtatcaaccattcatcaatcaaaaatatttgaatgcaaatatttggaaattactaatgcaaagtatgccaatatgcaaattaacctgtttgttcattttttctcatttattcattcattcacttattgagagtctgttatgagctaagtctgttattagccaagtctgttttaggctgcagttgtggcttcagttataatctcctgtaaatgtttgttttgttcacatgtgttcagatgtattctatgtaacagttgcctctaccttctattttaatgaaaaagctccttgagcacaaatctgtattttcccgtctcttcataattctccacagttcccaactgcatgctctgcatgcaataaagcatttagcacatgattttgatttattgactggtgggaagcctttacaagccagtcttctgtcttgagccccatccagaattcttctgttaatttttctatagttcccaaaggttacaaagaacattttcctttcagcctttaagagcttgtgtagaattagtcatcactgggacccagacttcaccctaaacatgagtgcatttacatgctccagtgaattaatcctgatgtcatattgtgaattgtgtcctaattttttaagagactccgtattccatttgattcataaaaatgaaaagtaaaatgctaatgtgtaaaactgttgttactccagttaatgaaatattttcccaacctttcataatcagttccagcctagatgagaagcttatttgcaaaaataatagatgaaaaagggaaattaaatcctctgtaattaaaaatagtaacattcttctattaggttccctgtttaatcatcttcattgttttgttttgtttttttcttttttgttgttgaggtttttttttgttttgtatctctgtgtgtgtgtgtgtgtgtgtgtgtgtgtgtgtgtctgtgacagagcaagagagagaagagagagaggtgcctgtaattttctaaaacctgtgtttgagggcaaaatgttaacatcttggaataatcaccccctgccagtgtttttttctttttcaattatttgcttactttgacattttcattccccactatgacagatgttccagaaccacgtgcatatggttctcctcctgggcaaggccatttccctgcctcctctccatcccggcccatgagataaagctcaggaacgccttttgtccatctttggctggcaggcaagagccagggatccccacactctgcaactgtatccataaggccctgtagagctcttcagtttacttcctcctcaatgagattctgaaagatggtttatctaaaatgtgaccaagatatactaataattctactggaaatttctacgaagtgtttttaaccctcaaaaagtcagaccaaggatggattttgaacctggtgtggcctctctgctctgggagccaccacctggttcctcggatgctcagtagctctgggcttccggaagcagcgtctgtgaaggggcaggggagagagtcccagacatggagcctcaagtcaggctctgaattctgtgtctgccactgagcagctctgatcttgagcattgttatttgaactctgtgactctcctttctcctcacatataaagtgaggataagaggaaggtagagaggatgaaaggagatcatgttgtataaagctgcctccatatacagaataagccttccccctcagtgctgtcataaaatcagtaacccacaaaggagagccaagttcctccaggcttcacgcctaaccagagaggtgtgtgggatagaaaaagacctacaccatcctcctagctctgtgctggatgagatttgtcacttggggcaagactgcgtgcatcacctcagtttctgcatccataaaatggaactgataccatcaccctcattgagatcatggggattgagaagatgtacacatgaaagtgccagcacctcttctggacaatggaagagattcctcgggtgttatttccctccagtttgggttctgagtccagaatcctttctggagcaacctgtttgggtgttcttccccgtccctgaacgtgagtggaggcttagagctgactttttcatgaggcaacctcttcaaccctgaacaggtcttgctcttcaaaagtccttgatatttaaccaaaatatgccgcttcaaacttcccactggtgatgcatgaaatagagtaaatgcccccaaactcttctccaattaagattttttatcccagtggaatcagattcaattaagcatcaaagtcaatctttggtggaaaaataagtcaaatttcagccagagtgatctttgcagaagggccatccttgcctttggctctggccctggagttgtattgaggttttgtgattaatgggtaattgcctgagccttacattttttaagatcttttggtggaactgtcctctttggtgttgctggctctttcttcggaatcacaaaagcccagaatccttgctgagaatctggggtccttgtggcatgcagctgcagctgccactccccacctcctgggatggtgcctgagtctgtacttctagatagtcacaaggtcgtctagcagagtaggagccaagagtcagtatacatgcctgactggggcgtggggacctgagatggcaaggaggaccgagtcttactgatactcactatggtagacagaataatggccccccaaagttgtccacagcctactcccgagaacctgtgaacatgttaagttacatggtgtattagtccatttcacactgctgataaagacatctcctagactgggcaatttacaaaagaaagaagtttaatgacttacagtttcatgtggttggggaggcctcacaatcatggcagaaggcaaggaggagcaagtcacatcttacatggatggcagcaggcaaaaaaaggttgtgcagggaaactcctccttataaaaccatcagatcttgtgagacttattcactgtcatgagaacagcatggcaaagacctgcccccatgattcaattacctcccacaaggtcccttccacaacatgtgagaattcaagatgagatttggatgggaatacagccaaaccatatcacatggcaaaggggaattaatgttacagatggaattaaggtcctaatgaagacccttgtgatggaaagattaccctggattatccaggtgagtccagtgtaaccacaagggtccttctaggtagaaggggcaggacgaagagttgagtcaggaagagatttgaagaggctgaactgcgggctttgcagatgaaggaaggggccacaaactaaggagtgcaagaaatacaactctagcagctggaaaggcaaggaaacaatttttcccctaaagcttccgtaaaggaacacagccctgccaactccttgattttagcccagcaaaatccatttcagacttctgacctccagaactgcaagataatacatttatgttgctttaagccactaagtgaatggtgatttgttacaacagcaaataggaaaagaatacactcaccttcctttatcatcaacacatcctgctactcaaggcagggacttcacctggctggagaccatgcctgttcaggtgttagctgatcgttaaggagcagcttgtctggacgggaaggagcacagacgttggatcgaggcagagctgagtgaggcagtgccatcactttctggcttcacagccttgctcagattgtttcatttctctgacctttatgctctaaagcaggaatcattacaggattaaactacagaatgtactcctggttgattacctggcatgcagtcagctctcaacacatggtctcttttagtaatgatgagttgaactgtgccttttcttccctcccctgggaagtgtttctctttttttagggtgtgagagagattgacattctctcccttgtctagcacaggactgccttgccctggggatccctagtgaaccattgctgggaggctcagatggactccaggcagctggacatggcgaatacatgagagattggcatagcgtatccccaggggaatgagaatgaaactagaatcaagattcccgaagatcaagccgtccaggtggaaacctcaagtagccaaacacagcagtgtggttgggctggaatgtttaacctctctgggagggataacaacattccagctgggacgttcaccaaaagtaacaagtaatcacatgggtgtgttctctatccaaatgaccagagcctccatctggctagcttcccatgtaattagtttaagagtaacaaaataccaggacattaatatatacaaaggagtgttccagaacatctaggcacagactgataaaggagacgtgggtgtatgtgcacgtgtacgttaaagatgagttaatttcaatgtttctattattctaaactgaactgctgctatgggtttcaagaattacatagcttatgaggtcatctggctggaactatgattccagagcatccctcaaaacacgagaggacttttttccccacttttatgttgttagatgccaaggtgatttagccagagtcaaagctgtactttatggcaggacatatattcttccactgtagattttttgtttttgttttgttttgttttttgttttgtttcattcaccgagttggaagatttagctctgcagtgtacagggagctaccagtaaactgtaggtcaggagctggccagggtgacctcagcttagccaccagagcccaactctcaagttgttcaactctgtgtctcctcctctgtgcttgatggagttaactaggagatctctgagttggagtgtcgctctgacctctgagggtacttaaagggaagcagcaggagaaagtggggaggcagagagtggcaccaaggtgctgcagatgacgtctgctggctgtgttcctggtaataagaagcgctgtcctctgaagggactcatgttccagggaagacaatttggggaaatgctgaccgaggtcatattttaatgtttaaagctagcttttaagtatttaaagaaacgatttacaagtcagtctcctgaaattacaattccataaaacttccaagtgggcaaagaataataacttaaggaagagcagtttcctaaacagatgagagtgaagtccaaattgcttttaaagggagataaaaaggtctcaaatttcttgctatggttctgaatgtttagtgataggttcgtttgaagatgaaatcaaccctgatgttagctcaataatttcaggatgtggggagggtggggggaaacctagcctatgggaaaggaaaatcaggaaaaccttttagtagacagacatttttcattgctatcaaaggatgtgtaaggccacaaaaacctcttagcaggaagcatcctggggtgatccatacattctttctggtgaggcagaaggaaaaggaggtccaagtctcatgatctgtctctttagatccagtagcagcaaggatcctaaattggtggataaagaaacaaagccaactgggcttggtggctcacacctgtaatcccagcactttgggaggccaaggtgggcagattgcttgagcccaggagttcaagaccagcttggtccacatgatgaaacctggtctgtacaaaaaatacaaaaattagccaggtgttgtagtgcacaccggtagtcccagctacttggaggctgaggtgagaggatggctttgagcccaggaggttgcagtgagccatgatctcaccacttgatatggtttggctgtgtctccacccaaatctcaccttgaattgtagctcccataattcccatgggttgtaggagagacccagtgggagataattgaatcatggaggcggtttcccctatgctgttctcatggtaatgaacaagtctcccgagatttgatgattttctaaggggtttcgcctttcacttggctcctactctctcgcctgccaccatgtaagacatccctttgctcttccttcatctcctgccatgattgtgaggcttccccagctatgtggaactatgagtccattaagcctgtttcctttataaattacccagtctcacatctgtctttattagcagcatgagaacagaatcatataccactgcactcaggcctggatgacagagtgagaccctgtctcaaaaaaaaaaaagaaagaaagaaagaaagaaaagccagtgtcaaggttggaggttgagcagaggtgagcataaagatctcctctcagatgaaggtggaccctttggtggaaaccatgtgagaaatggtcttggtcagatcctctatttggaaaaaccatgagagatggaatggatttccatctatgttctggtggctttatccttcttgtaatgtcatggttggttcatctgattcagaatacttggatttctcttctttcagtttctttctctttataatctattttatcccaaaatatagatttggacctggttagcatttttcacttgcctctaagatctgctgtctctgatgacttttaataaaggtctggcatctttcaagtatgactctgggtcaacatattttcttttaacatggttaagcttttgcaaggattatacattttccttccagttgtgcagcaagttgcctggcaatttaacttttcatttctgtgtatagtttaattgaaatttttattgaaataattgggaattcatatgcaattgtaagaaataatgtgttatttcagattttaactgagtgaaaaattctgcttccaaacaaaagaactgttaaaaacaagaaatccagcgattgctgcccatattatgatgtcccaagaaaaagtacagataccaggaactgaactgaaattttcaggacatgctgttataactctgtgtagctttgtcaggagaagcctgaagtacaactctgagacagtccatagccccttgatagcactgaagaccaccacactagaccccacaggaccacagcaaaccacccagaacactcccctgtatccacctggagtcgtgtgcacctggccaccaggatggtcctaagtgcagcagcccacaggagatggagaggtgtgccgaggaaccagcagtgcatgtgatggccctggctctctcttaatttgaagtttgccttctgtgccccttgaattcacatctcattctgtctcctcacggccctctttccaaaacctcccacggaatacgcatatagcttaatgagctattacaaggggaagaactagaactctgctagtccccagaggcccttccacaggctgtgtcccaatctttgctccctctcttcctctcttgacttttagagaaatcatttccttgcatttctttataattgtataacccaagtgtgcatccctaggcattctggtttaacctggcccattttaaattaggtcctttaagcctctctaatctacagattctcccttctatccttttattgtatgtgtatgtgtgtgtgtgtttgtgtatgtatgagtgtgtgtgtatgtatgtgtgtgtgcaagttcagttcctgatacctataattttcttgagacgctgtaatatgggcagcaggcattagattttttgttaataatgtgtgtatatacacataaaatatttgtgtgtgtgcatgtgtgtgtgtgtgtgtgtgtgtgtgtgtgttacagcccagggtatttgactgtaacatttctcatagtggtgagttttgctgattgcagagccattctcccttagtgaagggacagatgatggtgaccactacagagacaggtaagaaggtagcctgagtcccaaccaacccagggagccacagcccctgcacactcaggaggcaggacggatgttgctttcttcttccttcacaagggagaagaataccttcagaatcagattcaaatcttgactcttcctcattgttagctctgtgaccttgggcaagttacttagcctgtctgagcctctgcttcccatctatacaatgaagctaataatgcccacccagagactttgtgaagattatataagacaataagtgtgtgttgggcaagttacttaatttatctgtaaaatgtaaatagcagaggtaaaatgattgtgataactaaatgagttaatacagataaagcatgcaggatgtgcctggggcacagagaggcctcaataaatgttagctagttttactagtattatataaagtatctaatttgttgaaaattcctgtttatggtaccttttcttaggccattttgtgttgctgttttaaaaatacctgagactgggtaatttataaagaaaagaggtttatttagctcatagttctgcaggccgagaagttcaagagcatggccgtggttttggtgagggctttcgtgctatgtcacaacatggtggagaagatcagaggagaagcagacccatgtgcagagagggaccaaacaggaggaggaacctcactttataacaacccactcttttgggaactaacccctttacactaggactaatacaatctcatcagaacaagaattcactcactacagctaaaaggaaacaaagccattcctgagggatccacccccaatgacccaaacacctcccactaggcgccacctcccaacacattcaggatcacatttcaatatgaaatgcatattgaaactatagcatagctattatcagttaaaaggagaaaatgggggcttccaattagctgaagataatggtggcagccagatgcccatatcccaatatttcctccccaaatgatatagatcaaaaaagggagaaaggaaaagacacaaaaatcacacccttggcataccttgaggacagagagttaaaaataactttaactaaagagagaaagaataccaaatccaagcacaggaaaactcatgcttccttccagcccaccccactacagggctttgaggcaggcagagagaaagggagctgatctataaggaagagtgaaggagagaactagtatagaggcctataggtgatctaaaaccactcccagccacaagtccacccaaagcctgaaaatacaacacgaggtgtccaggtcgatcatggtgcagtgtacaggacagtcacaagcccatgcgacttgagaggcagccttcagaatgcacagcttctcaggtgaggagaacaggagaaaggaaggagggagtgccctttggcaactgggtgataagacggtgaaggagcaaaaggggatgattcaagtggccactgttaagagcccacagatacaagttattgtatagaatggggaagcatgagggaaaatgtgccagagagaataccggaaggaatattaaatcagagagcttagaaagaaacaaatcagaaaacgaggcagaggagccatgcggaagggtgagatgatgtaatggaaagggggatggaggacagcagcatgaacaagatctatgagaggtgcatgaaattggggagtgaaggagccggctgggggtgggacttgctgggacacagcagcttcagtggtcaaacttggtgttcatttcaggacaactcttgctcaggggaagtaggtgcataggcacatcgacatagacacacacctgtctcccagcaagcctctgccagaggatcccagggccggcaggcaggcaaagaagtagggcacatccaaggggctctgctgtaaagaaagagtatgcactgggatccagacgacagaagaggaggggacatgtggtgattatggacatcatagaaaagaaatgctgtagaattcagatcagtccaaaacgcaccatgtaaaacaaaagaagagagggcaactttggtaacactgattaacatttaggattttgaaaatttatggtgtttgcaaaacctgcatttgagttaagtattttgcaggggagatgttattggttatttgtagaacatcatatctttccagttacaaaatataaattcattttgcagcacaagatatgatgtctcatctttgaagttcttttttctctatgtatgcatggaaagggaacatggtagaaataatcctttttttttttatgggggtagataatagatgaaatatggcacagaacccccacttcagcacgtgaatgagacacagaaggcagttctctcactgaagaaggggccaagggcctccccctcatcagctcagccccttctcacactgcagagtccctcgggaccgccccaggacctgggggctatgtggcacactccttgaaaatcatttggtacttgtcacttcctgatgcctattgcagtagatgttggagccacacagataaataagtaccattccctgcccttggataactcagtctagaggagagacagaaggttaaacaaccatctggaatgtagtcagctgggtgctaaggtagaatctgagggagaagaataaactctattagagtggccgttatcaaacaaaagataagtgttgacaaggatacagagaaaagggcccccttacacactggtagtgggaatataaatgagtgcagccactatgaaaaacagtatggaggttcctcaaagaatgaaaaataaaactaccatctgatccagcaatccctgggttgctgggtatatatatcaggatcaggagatcctgatttcaattgagatcagtgaactcccttatttcttgcagcattatttacaatggccaaaacatggaagcaacctaaatgtgtatttatagacgaatggatgaagaacttgtgaaatatatacatgcatgtatatatacatgaaatatatacatgcatgtatatatttcacaagttcttcatccattcgtctatacacacacacacacccaatggaatattattaagccttaaaaagaaaaattctgacatttgtgacaacatgggtgaacctgaaggacattatgccaagtgaaataagccaggcacagaaagatgaatattacatgataccacttatatgaggaatctaaaatagccaaactcataaaagcaaagagtagagtggtggttgctagagcttggcaggaagggggaaatgggaggtgttattcaaagggtacaaagtttcagttataaaagattaataagtcctagagctctacgatacagtatagggcttacagttaacaatactgtattgcatacttaaaaatgtgttaaaagagtagaccttatttttaagtattcttatcataaaatggtaataataaagaggatgggaggaaacttttggaggtgagtaatgtgtttatggcatagattgtggtgatgtcacagtctctaaaacttatcaaggtgtatacattaaatagctacagcttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatccagcttttttaatgtcaattatacctcaataaagtggctttctttaaagccaattattccatttgtttctctgcattagacatttcacattttacttgacagggacagcccagagtttgccaaagccacatccaaacctgagtccatgctgagatcatacagctttctataccatactttcatcaagagcttccatgcctggaagtgccaagcaacaggaactggttgagagatggcaggtccagaattctgttcttgatggaatgggttttctatattaatatgacggtctttgttgtttcgtggccagtctcatcagaagggctttgtggggggcaaattgtagtcagttttaaaaattcaaataattccaggagtaaaaaggtcggttcattttaggatatctattacgcaccaagatgttaagagaaaaatatcatcttaattgatactgaaaaattacttgataatatttactacccaatctgtacaaattaataaaaagctatgaatagaagtaaaattccttaatttgataaggaaagtctactggaattcagtagtattcatcatacctaaaggtgaaacaagagagccaatcctatttcgaggaaaagataaggatactcaatatcactatgaaggttccagccaatgaaatgagacaagaaaaataaatgaggtataaagattgtagaaaaaggataaaacccaccttatttatatatgacatcatttcttaccaacaaaattattgccaacttatgaaaaactattagacctaatcatatattcatgacactgtccagatcaagtaaacatttaaaactcaatagctttcctatatataagcaagaaccatatagatcaggtagttttaacaagatgccattcactatagcaagaaaaatattaaatatttaaaataaatgaaacaataaatgtacaagaaccataggaaagaaaaacaaactttactaaagggcataaaatttaaataaatgacaaaacaacatatttcagtcgaagacaactccttactaaaaagccatcaatttcccccaaattaatccataaattcaatttttaaactcctcaatattccaatggaattttcatgagaatcacctgattttaaaattcatctagaagagcaaatgttcaagagtagccaaaagcttttgaataaagatgaagtgaaaatatgtcctacaagatatgaaaattttataagcccacagcaattaaaacacgtggggaaggaacagggataccaaagagatggtaatgaaatgaaataatctagaaatagacccctgtttgtagtatatgataaaagcacatttaaataattgaggaaacaactcaataatcagcattaggataataattattattaaaaaataatgttagatctctgtgtcacagtatataccaagataaaaactataaatataccaaaagaaaatatagaaaaataaaatctataaaaatatcccagaaaaatatttttaaattttgtggtgaggagagactttctgacaagaactaaactcttttggcctctataagcattaaaaaggtttacaaatctgatttaataagaattgggggcttctctatgtcaaaagacactattaaagtcaaatggcagactgagaaataatatttctgaacaaagtgctaatagctaatatccttaatattttttaaagctcctgaagttcactaagaaaagataaaacaacccaatgtaaaaaaggcaaaggatgtatgtaagtaattcccaggggaaaaagtaccaatgatttttaaatatatgaaaagatatttattacccactagtaatcaggacaattcagattgttacagtggggtacaattttacctggcagattacagaaatttaaaatgatggtaaaatataatatggggtagggagctgggggagaagtttgtgactcactaagtattgagtgtataatgtaccacagtaagcaaacccttgatttagcaaaatagtcattaagagcacaaagacctttataagaatgtccattgcagccagttttataagctgaaaaaattaaatgcaacctaactattcaacaatagaaaaatgattaaatgttacattatttccatcctatgaaacactctttagccattaaaaataatggactagctctatatttaataacacaaaatgaaggtccttaaaatgatggtgggctaaaaaaattatagtagggtcccattttgtattaaaaaatacatgtgaacttttatataattttgtttatgcctgtccgcacatgcacagaaagatctggaaggattctcactaattgttaaaagtggttatccttgtggagtgaagcgagattggggccaagcagaagaagtgagaccttccacttcttttaggaggcttaaattgtttttaatgatcatgcattgcttctgtgatttaaaaaaaattaaaattgtgctgatgaaaaacatatggaaaataaaactgccagaggtaacactgctgcacagcctataaatcaaatctgaaaagtgtctttggaccagatgccccctgccaggcctcctctccatctgaggtattctgaactgacagtcttcagaaatttgactgtctgcaaatccatccgtgacttcctccttatgggtcaggtgctcccatctgcttgctcttcctgctgctcagaattcttccttgagggcaggcctcgtccaggggccccccagaaccactggaccctgcagcctggaatgttgtaacgggaccagggaaagacaggaggaagttgccatcaagcctctgaagctcatagtcatatttaaactcttagttaattgattcatttcatcattttgaactcattgttttaattacattgaatcttttaaaagaatttttcacttaaagagtccttggagatatccttttgttcaatcctaacattttatgtgtaaggaaggggaggcccagagaaggatggttaataaattgtattagatttaagaccctgaatttgggggctcaagcctcattaaatttcttgattcttatgtgagccaacttctgcccctcctatgcagaatgttacttgagaatgctattgccaccctgtaacccacacacctccagaagagccaacatgattatgtctcttcatgaggacaaaagtcatcaactgggctttctgtcatgtcttcataccaagttcttctgaccacggggcctttgcacagacagttctttctttctgcaatgcacttccctgctcttcacaaggctggctctttccacacactcaggcacctccttggagaggcctttcctgaccactgcactcccttcccaccattctccctttcagcaacctgtttccctcaaaggaggcagagtccgtgcctctctgtccactattgtatgcatccagcacatggcacattagtgggtgctcaaaaaagagtttgagtgaatgagcaaatctgacacctagttttgaaaggtttctgacccctgctcttttttttttttttaaatggagtctcactctgttgctcaggctgtagtgcagtggtgccctctcagctcactgcaacctccgcctcctgggttcgaaggattctcctgccttctgagtagctggaattacaggcatgtaccaccatgcccagctaatttttctatttttagtagagacagagatttgccatgttggccaggctggtctcgaacccccaacctcaggtgatctagctgcctgggcttcccaaagtgctggggttataggcgtgagccaccacactcggccaggctcctgttcttatgtgattatctcatcatgtagacccagaaatctctattattatttaatttttctgttattattatatggcaggtgaaaatgatagttttattattttaatttgtgttagattacaagggagatttaacatatttccattagcttatgtcatttgctcagctgtccattggcatcttaatgtttcactcaatcattcctggttagtggcctgattaagcaagggaggaacctatgagtggttataacctgagatacagcaaagagaggggacagggtcttacatcgcactggggacaggtcttacatagcactggggacagggcctcaagggcttggtgctctgacacacaggcactgagtccagctgcagggctcagctgcaggcctaaggttctaccacagcctggggtggatggagatgggtctaattcctagggagcctcctcaatttcttccttgtcagcactgtattctgcgcctgtctctggtgaggggcaaggatcttggcaaattttagccaatatttaatgaaaaactctacaaagattggggttttttgttagtttgtttttgtttttgagacagagtcttgctctgtcgcccaggctggagtgcagtggcgcgatctctgctcaccgcaggctctgcctcccgggttcacgccattcttctgcctcagcctcccgagtagctgggattacaggcgcccaccaccacgcccggctaatttttgtgtttttagtagagacggggtttcaccatgttagccagaatggtctcaatctcctgacctcgtgatccgcccaccttggcctcccaaagtgctgggattacaggtgtgagccactgcgcctggcctgaaaaactctacaaagtttttaacagaacttaaagtgatttctccccaagaaaccagttttcttagagttagcaccctaacatgaagattgctaagtgacaagatagcacattacattaatccttgatatggtttggctatgtccccacccaaatctcaaattgtagctcccataattcccacatgtcgtgggagggtccgggtgggaggtaattgaatcatggggacaggtcttcccttgctgttgtgacagtgaataagtttcatgagatctgatggttttataaaggggaattcccctgcacatgctctcttgcctgccaccatgtgagacatgactttgctcctccttcaccttccaccatgatggtgacacctccccagccatgtggaactgtgagtcaattaaacctcttttcccttataaattacccagtctcaggcatgtctttattagcagcatgagaacagactaatacaaccctgtattatataattcagagctaagtatttattcagttattatgcatgtatccagcaatcaccatgaaccaggcacttggtcctggacatacaggggccggttggctacaacccctagctacaatgatttgtatgacagaccagggagaagcatgatggcagtgaaaacagcaagtgtgttgcagcctaaatccaagtttgaatccagactgtgacgtgcagacacggcaagccttagcctctgtgaacgagaagtacatagtgataccatcttcacggactctgatgtaaagtgtttggcctagggaaggaataaaaagtccactttgggccttcaaatcagagagaaaccagtgctatatgaagtgatcaagggtggaggaggtgtagaggaggtagaatgtgggcccagccctgaagaatgggtagaatttggaagggaaaatgcagaagccaaagaatgaagataatcctaatccactgaagggcagtcaaggagctggaagaatggaagggtagctggaattcttctacccttgcagggaaggagcagggccagagggatgggcacccggagccagcccacagcaggtgtccctcaaactgagtcttcaaatacttactgaactttcattttgaggacaggctgagccctgtgtgtggagaggaagagcaaggcgggcggcacctaatttgcacaccgcaactaacaaaactaaaaccccacagataaccagacccacattcctcagacgccattggactgacttctattgttaatgaagtattgccttgttggggagggaagtgtctcctctaaccccgagcagcttatccaggacattcttcttgccatgcacaggagttccatcatctccttgcatatctggtcagatgttgctgtcctggaggtgttttagagccccttatagaccaacactctcagcagctgccaggctggcccaccccttattctagttctcagaagagacaagctattccagccctgtgtcaggacagcagccaggaggaaatgagaagctcctgcagctttttcatcagtggggaagattttgcagtcattcagtcattcaatgactacatcatggtcacctactacatacaaggagaatctaaaggagaaaaagcgcaagacatgaactcttccctccaagagtttgtggcagttcatataatgagggagataagtaaaatgccctatatgccctgaaagaaatacagaaactgtgacggtaatccagagtggggagacattacttctagttggggtggcagggagagaggcagagaatgctttgagaggagaaggatcttgaaggatacacaggctttgggacatgcagacatggtgaggaattgcatctagagaatcataaagcctcagagattgtgtaaccccttatttcacatgtgaggaaactgaggtcgaggctggtaaatggcagattttgaaatggagcttttttctattcagcactctcctcacctggggctggccttccgaacagaagacagtgtgggcaccaacctggggtgtggaagttttgactgctcatggtggaatgaggatgcagcttgcttgtaaaataggattttgtagttgattcgctgctaggggtaaaagaagagccaggggaacccagaggtctccagcctgatgactgggaggacacctgagccagtgaacaggaggaggcagggatgggagaaaaaaatggtgtgtttggtttgggacatgttgaactggaggtttttataaaatatacaggggaaatctctaacaggttggggaaacctggtgctggagttcaggacaaaagatataaattgtggatagttgggattgtccaagggatagaatgcagagaaaaacagaaattgaccagagaaggttggtggacagtggtgagcatagccaccttctaaagactgtagcaccagctcccttcggagaggagaaccaggaactggacccgaggtagacagaggttggagaatgcaatgccctggaggtgaagatgagagatttggggagaagcagtctacattctagcaaaaagggttaacatgctaccaacgtgacatctgagaaaagagacagctgcatctagcagctacaacatctcgcatgacctttgcaggtgcgaggcagccagagtgaatgttatctaggaagtttgacactgaagaggaggaggaggattaaggggtgccagaactgaggcaagacgtggtttgtcttttcctttttaaggctaggataattggaatatgtttcctggaggatggagaggagttggcagagtgggagataagagatgggagggagaagggatgcgtgacagaggataatcctgaaggaggcaggaggggttaaggtcaagggtgtggcctactgacagttggagttagggtctctgagctgagatgggagggtggttctgaagggtgaaacagaggggagcctagaagtcccagcaatcaggtcagtctcacgcagcacgaaaaccacaagctgagactccaaccttgggagaaacccaaagttaagggtcaaaaaggcatcaaggatgggacaactgaaaaacagccgtgatgtccagaagcccacacgagttggtcagtagtacccagcccagaagacagggctgactgaagatgaccaacaaggataaagtttgcttttgaagacagattagaataagctatagtccattaaagccacataccaaatgcatgatttccctgcttgttctgcactttagagtccaaatattttaattaaaccaacatgtgaatatcagagatatcaaaagaacaagaacattattaatttgggaaccaaggcaactaaccactttattcttttaagtcatttcctcatttagctccaatctcggtaacaaacatttcgatatctctacgataattttcctggatttaaaaccacagttttgatttttaccccttggggatttatttcttatctcttgggcccttttgaacaaggcagttatcagattaacttttagctcactggcctggggttgaataggtcatttccctcctgaatcataggctcctaagaattcaagccaaaattccaggctggctttaagtaatgaatactgtaattaacttctaaccaagcaagctaacattttgcttggagaaagcatccttttcccaaacaaatgcctttcaaataaaaacaatttcatgccctctttttccagcctgatactttccagggcttgggaataaccactgtgttgtgcaagagtatattcttggagcctcttaaaatccagtttgctctggtttttggttctgccatagaagctgcaccatcttttaggactatattgtttttaagagagttaactgagttcccttccatctgtactgtctgggaagttttgtggaagtcctgccaagcctggttagatgtgacttctgtctgcccaactcactggacacaggacaaaaacagatcccagaccttagcagattgggactgcagtctgtgattgaacgtcatcaatgacctgccaaggctggggaggagggagagtaggagtgctctgacccagcaggggagagtattttacacgatgataataaaaagcaccacttctagacagttttatgactgtttttcatcctctgtagacaatgcacctccttattgcctgcatctgggacctaccacgcccagtgcctggccaagggctatcggccttgtctttagcccaacccatgaaataagtgaaatgaagacctgtagtagggtcagtaatgggagtttgaatgagacagtcttgagaaaataccaaacgtgcagccagaaaaacaaactatatagaaactaactgaaagggtatatcatttaagtgtcagctgtgagattttttttcagtcctagggcaaagccatgtcaggaaccaaaaggagaataaggcatcacatatatatatgcagcaaggaattcatcttgagctgggttaggaatttttgccaaacggattttcattctgacctggagtgtcttttggtgttttgtttagtttggtttggtttggtttttggctgagccatgcatgtggcagtctttctctgaggaagtttttaagtcaccacctaatttctgtcagcacttaaagtgaggggcaaatagcgttgccctgaaacctggcctattttctcagcactgtggcaaagacccctgtcctgctgttatggtgctgcacacagctgtgcacagagcgtgggtggccctggaacactgccacacgaagcagcgctaagccgaggtttccctgctgtgaggtcccgtccctggactaccgtggactgtgcagttacgtgggaggtagagtcgcgtggtgtacagatcacaaaatggattacatcccctactctgctacatactaaccatgtggtttgggggcacgcctattctttgctctaaaactagctttctcacctggaaaacgggattggaataaggacagccagggggaggagtaattaaaataaggtgtgtgaatttactctgcgaactataaaatgctacagggatgtaagggtgaattgcctacaggttctgctgatttggttttctggttgtcgttaggccttagccagtaattagtgaccaaatgtaagatgggggaaaaaagggtttagcagcagcacctgtgtgaaaaaaaatcaaagcgtttttatcatgtaggtggggttccatggaaagctgagctgcagcaattgaagtggactgtggagaagaaggggcatcacggttctgctctcctgtgccatgatcagacccgtcctagttattaccttccaggggggctcctcactggtctatagatgacgtagatcagccggataacatgtggcaggaggaggcatctaggaagcaccaggaccttaactggaaacgctgggaagaaagtgaagctgtcttcgtattttcttaagggtcttatgtagaagttggatttgacttgttatcccagctttccagggaagagtaagagcactgggtggacacatgcagggtgtagatattagcttatctaaggcatggttcccaaactttgctacaaatcagaatcaccaggaaactttcaaatctcccattgcccaggccatacctgaacccattaaatcagaatttctgggagtgaggcccaggcatcagtttaaaaaaaaaaacttttcaggtgcttgccatgggcagccaagtttgagaagcagtgatgcatgcagtagtaaaagcatcaggactagtcaagacggggtgagcggctagggatgtggggaatcccctgcctctgaagctgctcagatccaggctggatgtcacttggtgatgatgaattcaagccttccgcatagaggtagactaagatagataaacttcaagctctttcccatcctgagggggctgagtcaatgctccaaagtggaagttttccagtttatttaattccaaggaactatttgttcaaataacataaaatatttaaaacaaagcaacagggaggtgcccccctccattccattccaccctctgttccaggatgacctctgaggacactttgtagaaatctggaaacttaatgaaaatctcttggactccaaggaacacagttttaaaaaccaccaatttaagggaagggaaataggatttccacagaaattattttcttactcagccatctgtagttggaatcttgattattttgatgaatagaagtagcaaatcccaaatggaggagggccaagataaatgaccatggacctaatctgtttattagttgggaacatgaacagcatcagccagaatgtggttgacccagtgcctcagaaactagacccaggtcaattttggcttattatcttggtgccacatagaggatgtaagacccacctcatctggctcatacggtatcttcaaggggaaaaatactttattattatttgtgaaagttcccaagctctgcattcacaagttgagtgttaagcctggattgagctctttccttatgacctgcagtgagcagagcaggtcttgaacctaggtattctcagtgccaatatatttttacaatttcatggtacgttctgttccacacagactctagttctgtatcaaagctgtaacttacaaatgaggaacaaaatgcagcctggtacaggggaaagaagtagcatataggtttgagtcctggttcaactcttcaccagctgtgtcagagcagacaagtatctaacttagtttgcttgcctcttaaatggaattcattatatctgtttacctatttaccaagattattgtgaggttaaaagaaaaagccaaagtcatatcctcttaagttctataaaatatgcatgattattgaaagcaaaatatatatatgtatatatatatacatatatatatataacattgggagaatttcaatatatgtagatgaaatacacatggcaaatataacataaataggggagacttgaaggacctttattttgtgtttgtttggtttcagattttttttgaaaataggctttattttttacatcagttttaggttcacggaaaaaccgaaggtacagaaaattcccctatattcctagcctccacacatgcagagcttttcccattgttgcttttaaaatttctacattttgtttgaaatggtaaatattaactcaaagtagactatgacaaattaggtttgtatgttttaacacctggacaacaactaaaaaatagttcaaagagatatgaccaacatgcaaatagataaattatacagaatactgaaaattatgcaagtacaaaaaaagaaaggaaaaagaacagaggaataaaaaaggtgacaaagaagagcaataaaatagagcgaaatctagtcatgactcgttgtaaatacagatggtcagattagattgaaaaagaaagacccagtgatatgctgtctataagaaatccactctaaaggtaatgatatatataaatagatttaaaggaaacacatttttgaaaagatatttcggggaaatactaatcaaaagcaggagtggctatattaatattacacaaagtagacttcaaaacaaggaaacattaccaagaatgaagaggcagattacatgataataaaggggaaattaaccaagaaaacataacagccataaaggtatatgcatctaaacagcaaaactctaaaacacatgaagcaaaaactgatagcgttgaaaggagacatagacagatccccaacaatgcttggacactttagtcttcttcttaaaataattgatagaacaagtagagaacttgacctaattgacatttatacaacactccaaccaacagcagcagaacacatattcttttcaagtgtacatggaacagtcactaaaataaactatattctgggccataaaacagactttaaaatttttaatatagctataatataaacatcgcttttctcatcataatggaatttaactggaaatcagtaacagaaagagatctagaaatttcccaaatattaaaaaataacataggaatgaaacaacacacttctaaacaatcactgaattaaagtggaattctcacatgaacttagaaaatattttcagctgaatgaaagtgaaagtacaacatgtcaaaatgtgtgggatgcagctaaagcagtgcttagcagaaatctgtggcattaaatgcttatcctggaaaagaagaaagagctcaaatcaataatgtgatgttcaaccttgagaaactaggaaaagaagagcaagttaatcccaaatcatatttctttggattttgctttgcagaagggagaattgcagaagggaggaaacaataaaaacaagagcagaaatcagtgaaatttaagacagaaaaacaatagagaaaattaagaaacaaaatacttgttctttgaaaatatcaatacaattgataagcctctattcacagccctttaccctagtacaacccaactattcctcaactaaggaatgaatgacctagggtacatcgatgaaatggaatactactccagcaataaaaagaataaaccactgatacacacaacatggattaatctcaaatgcattatgctaagtggaggaagccagactcaaaagactacataccctatgcttccgtttgttatgacattctggaaaaggaaaacccataggtgtggagaacagagcagtggttaccagggacgaacgactggggaaggggaatttttcaaggaggtgaaactaataaattttaaaacatcaagtttacatctgtaaaagttgaattaattgttgaatcaacatactgctatgataattgttaatattatgatcaataacgaggtagcccaggctcctcaagccaaggaaacctgggaagtttagtttaaaaggcttttgggtaatggtagaaaacagtgactggaatcgtcttaatccaatatgccatcattgtaatcttagaaccccatatgctctggtccctcccattgggcaggacagctaccacagtgtccttgccaagcattaaattccccctgttccagggctgtgtggctaccctctggcctttgggaactgccctcaggaactgtcttggtccttcctgctgttttcctaatgagctcctagtatcctctgcagggccccagaggctgttgtatggaggtcactgtgcccacatggccctccgcccacacctatgttgctgattctttcagcagctgttgccccttggggttctgaaaaagagatatagtggggtttacacaatcttacagcatcttacgttttattgatgtcatgctcgaatgtcttccatctagcttgaaaatagatttatataaagcttcattgtgatatttcacaatcccctcccatcgccatgacaaccagggtatcattagggaggaatcagatgactactgtgagctttgccaccaaatcggacatcaaagtagaatttagatattaagtctctcatcctgcctctaccccagataaattcatttccaacttctaccaagttacaggggtcatttgagccatcttaaataatagattagaaatgattaagatagtacactaaagggaaagcattgatgttttaacaggcctaactagttaaaaggatttgtggatggatgtgaaacctaaaaaaaattgtactggacaatgtttcagaacctgtgagaagctgactgtccagttgcccccacacctactatcttatttccttgttccaatgtggagtagaaggtgagccatagaacaagacaagcagatatggggtcaagtcatagctccaatagttacttactgtgtgactttggacaaagtacaggttggtgcaatagttattgtggtttttgacattatttttaattgcaaaaaccgtgattacttttgcaccaaccttaatacttaaccttcctgaacctattcttctcatccacaaaaccctgtcccagaggattatgagatgaagatagtttatataagcactgaaatgtaagctttatgagggcaaagatgtgcggtgggtgttgtgtgttggggggggaggggttctgttttgctcactgctgctatccccagcacctaaaacagtgcctgacacatagtaggtgctaaactactctttgttgaatggcggaaaatgcctggcagggtggtgcaggcatggggtggacttttaggataggttaggataggttaatggataagctttaggagtgtctattgtacatgacttctaaaatttaaaagcagaattaataaaattaaatatagctaaaaggatgctgaagttttgccttggcattttcttttcttaagataatgctggccaggagcagtggttcactcctgtaatcccaatactttgggaggccgagtgggggtggatcacttgagatcaggagttcgagaccagcctgaccaacatggtgaaaccctgtctctcctaaaaatataaaattagccgagcgtggtgacgcatgcctgtaatcctagctacttgggaggctgaggcaggagaatcgcttgtggaggttgcagtgagccaagatcatgccattgcactccagcctgggcaacaaaaccgctgcaacacacaatttacccacataacaatcctgcacgtgtacccccaatcctaaaataaatagatgaaaactaaataaatacaaataaaaataatgtcttaaattgttactgtgacagaaatgtctcctacctgttcaactagtgagtgggtggacaagctgccatcattagatacataacccttataactccagagacataagtgggtcagtcttgcaggagtatggcatgcgagaatcacaactcgacactcaaaataattaaacaggaatttgtttatgtacatctgttcccaaaggacattaaaattgatattcagttatcgcttggagttctaatactcaaaaacaccaaagtttgggttcatttgtgtctctacaaaacccttgtattaaattagcatctatgtacatcctgtgttttttaggttaactacttctgccattagcagtccgtttggtagtcaggaatgaattcctgccatcatcttggaacccatggcgacagtgccttgttggttacaactctgaatggatcatttgaaattcccctcacaatcctgcatcttttcattggattcaagcttatacttcaaatttcctatgtttagtcctaacttttggaatttttgtttaattacccgaattcccagcattgaatgggctttggattctacagtgcttagaacagaaatggaatttagttgtgtgtttatattttttttaatgagaccaggtaattagaacagaatgtggaagccactgtgtgtgtatgtgtttgtgtgtgtgttgtaaaatcaaagaaagaactatcctatgttggttcatagtatagtaaaatttaaaacatcagctgtccatgacattgagaacaacccttccacttattccccgacgtcatcgcaatttagtcgcagatttggggctcaaaatttggaattaggctctgggttttttttttttttcctctatttaggataggtctatttaacactggcttcaaatattggtgttttagtcttttgcaagccaaccaaaacacccaccactccacaaccaccaaacatgccaaccctgaagcaagcacacacatgaattagataatagggatgtgtattagttacctgtggctgccataacaagataccacaaactgggtggattaaaacaacagaaattcattctctcacagttctggagaccagaattctgaaatcaaggtgtcagcaggattggttccttcctgagggcttagagcaagaatctgttccgtgaccctctatcagcttccagtgcttgctggcaatccttggccttccttggcttgtggcttcctaactccagttccagcctttgttttcacatggcattctcactgtgtgtctgtgtctgcctgtccaaattgccttcttttctaaggacaccagtcatactggatttagggcccaccctaatgcagcatgagctcatctaaataacatcttcaaagatcctatttctaaataaggtaacatttacaggttccaggtggatatgaattttgggaggacactattcaacccagtataggatatgtttggccatgcaattaccacataaatgaaagaagtaaatccacactacagtgcaatcgtgctgtaggattgcactgtagtactacgctagaatcgcactggagtattgatttaattctttttgttcatagagcactttcctgtttgttttatagagtgtggggtgtgtgtgtgtgtgtgtgttggtttttgtttttttttttgtagtctaatgaccagtgctttagatcatagctgactgtacttgtggggtgatgccaggccagcgagtgggctgttatcctgcccagccacggtgcacacctgaccgcacactatcatcctcctacccgacttccagggcctttttccctcaaaccaagcaggtctcacttcttggggcatccccccttgcagtatatacaggatgcttctttcctcatgtgttctggtcactcacatagaatcctggactttcctcatgtagaatcctaatatttaactccatgaggtcaccaaagatgtttctccatgggaacttctgggtcagacctgaccagatgaccaagagccataaaagctgaattctgaccccacctcggatatcttattttttagacaactccagttttccctctctgtgccaggaggaagatgcattctggggcacatgttgctgccttttgcatacatatgtgagccctgataagatacttttcctcttcctagtgatgggtttctgtttttgaaaatgggccttcttggcttctggtgttttgtaacaaatacctaatgagtcatcactaaacactagctctttactgacactgtggactataacaaagaaatttaaaaccaggctccagaggcctaggggattggctaagtaaactgaggtaggtgaatgccatggaattctatatggcagttagaaagcagttatctagatggacatttcagcaacaaagacagtgtaaaaagcaaagggaaaacccagtaacatttatgtaaattacatgtctgtatcacattagtgtaggtgcttgttgggatagccagggactgatggtggtggaatctggcataaagggaaaaataagacaagacaggtggaccttatacaacaaaattgccacaggctaaagagtctgattaattcacctttctgctcctgaggttaaaaaaaaatcttgagaaacttaaatatggcatttagcatagcaaaaaaaaaaaaaaatcacaaaagcaattgattaaacatcaaagaacagggcatagacactaagattagggatgagagttagaagcaggagctagcagcacgggagacagaggagcggtaatggggccattaagtgactggcccttgaacaagaccccccaccaccatgagagggggctgccagcattacttggcaatatctattgagtgtctgttggtcaggtactaaatgagacagggctcctgccctgtgaaaaacttacagcaggctgggcgcagtggcttatgcctgtaatcccagcattttgagaggccaaggtgggaggatcacttgagcccaggagtttgagaccagcctgggtaacaaagcaagtccctttctctacaaaaaaattaaaaattaactgggcatggtggtgcacacctgtagtctcagctactcgggaggctaaggtaggagaattgcttgagcctgggaagttgaggctacagtgagccatgatcatgccattgcatgccagcctgggcaacagagcgagaccctgtctcaaaaaaaaaaaaaaaaagattgcaaaaactggaatctgagtaatgggagaacaatttctttttttagaggagggaattaggaagcaactactttgggatgagaaagatatcaggtttctcttctagataaattgggctacaatgagacccattgacaaaattagcctcctggaattccttctgaagggcagacatagtccttccctgctcgtagcaagtggacagctcagcctgaagaggggagcgtggcctgagatggccacagttgcagggctggttctgtccatgggctgggagaggcatggtaggtacgtgagaactgtttgtgtcatgaatgaactttgggtatcacatgctacccatcttcctatttagctgccagcgtaggctcctaaaaccagatttcagttgttgtatcctgatcaaaaatcttttaggcatcccagtgcccacaatcagccgtcacagtctgcctgatgtcttccatccaaactcatctccaggggctcccatctatgcacgctcccagcgccccacaacttcccttctccatccttctaaggtcgtgccccctcctgcctctgtctttgtccatgccattcttcaagacccccaatgcccttccttcatcctctgtccggtgacccactcctccctgcaaatctctgctcaaatgccacccgctctctgagagcctctgcatctcgtggaaattttaccagcctctctggtcacgttgtattggcatgtgtctgactgctccatggactcagctcccaaagtcatgagctgtacctttacaacccccaatacttttttgaccagtttattttcttattataccataggtgggatcaatttcatacaacattatttgaggcttaaacatacataaactttctttaaagttaaaccacacaaactttctttaaagttagtattcaaaggaaatttggagtcagaataaatcaaaccttctaacatttaaagaatgagaattagacatactttgctataatttagcaatgaaataagaacaaagccttggcacttcccttcgttcaaaccccttacaacctgtgattagagtgccaaagagaaagccagccttctgattttcagtccaaatgtgttacatcatgttttagaaactcacacaggtttgagtccatccaaactcaaaatgccaaagtgaatctgactgaaaaaaaattactgtgtgatatctgcgtatatttgtttaacagaaaccataatttggacattacatcaaactagacttggtctacctaaggagaaatgtttgcttttcttttaacagaattttaatgcattaccgcatgtgtttgccattttggtcagaaggaaagaaggacattttggagattagaattcttaaacaggaatatccagatggaagcagaactcctaggcagtctatgggtaccttctcagaacagtgttttaaactcataaaataaaatacagaagagtacaaaggaaaccaattctcttgaaatacaattatcaaaacatgtattttttgagacaaggtctcactccgtctcccgggctggagtacggtggcacgatctcagctcactgcagcctcaactccctaggctcaagcaatcctcccacctcagcctcccaagtagctgggactacaggtgtgtaccaccacacttggctattttgttaattctttgtagggatggggtttctccatgttgcccaggttggtctcaaactcctgctcgcaaacgatctgcctgcctcggcctcgcaaagtgctgggattacaggcatgagccactgcgttcggccatcaaaatactctttaacaaacaaatttgctgtgtaataacatgtgctttttttttttttcttttttttttttttttgagacacggtcccactctgtttgagacagggtcccactctcaggctggagcgcagtggtacaattacggctcactgcagctttaacctcctggactcaagggatcctctcgcctcagcctcttaagtagctgggaccacaagtgtataccaccactcctggctaatttttttactttagatagagacaaggtctccctatgttgcccaggctggtcttgaactcctgggctaaaaggatccgcccacctaggcctcccaaagtgctgggattactggcatgagccactgtgcccagccatatgcttctttaacattaaaataggagaactcctagaagatctaataattatcataatttcaaaatagttatgagttcttaaataatatttcaaaatatcagtaacttctgtaaagtcccatgaatatctatatgatttccgttggtgatagagtcacagtcctgcatactattatgggtgttaccacattcataataaaacgaaatgctaaatttcagttggaggttagtgaaaagaaggatggaattcacagaacccaccaaggcagtacaggaagagttatatttcattttcagggtatccacattagctaacacattctgagacccatttgggttcatgcccatgtgtgggattccatggaagctcatattttagaccagaaatggcaaagaagccaggcttctgacctccagctggcattgtactggtggccaatgatgtctgacacttcagtattcggtttgttcggctacttaccgtagcttccaagaactgctgaagcattgcaaagcttgcgatttgttgctaggagaaacttttttttctttttaagctaacctatctcccagccagaaactaggaagaacttcaccttcatttctcaaagaaggaaacaaacatttagatcatagtcatgtgtctcctgtaaggaaaccagcttctttattttggttgtaggaacaagtggttgggtcatcatcacaatgggcattaagattatgggattatggccaggcatggtggctcacacctgtaatcccagcactttgggaggccgaggcaggcagatcacttgagatcaggagtttgagactagcctggccaacatggtgaaaccctgtctctattaaaaaatacaaaaaaagaccaggtgcggtggctcacccctgtgcctgtaatcccagcactttgggaggccgaggcaggcagatcacaaggtcaagagatcgagaccatcctggccaacatggtgaaaccctgtttctactaaaaatacaaaaattagctgggcatggtgacgcctatagtccagcttctgctactggggaggctgagacaggagaatcacttgaacctgggaggcggaggttgcagtgagctgagattgtgccactgcactccagcctagtgacagagcgagattctgtcttaaaaaaaaaaaaaattagctgggtatggtggcacatgcctgtaatcccagctacttaaggggctgaggcaagagaatcatttgaacccaggagacagaggttgcagtgagctgagattgtgccactgcactccaacctgagtaacagagtgagaccctgtctcaaaaaaaaaacctaaataaataaaagattatgggattaaagtatatgataatcagggcttgcatatataagctcttgttatatgaatcttggagaatggcattgttggtacccacagtttaggccaaaaatatttgcccagcaccaagactggaataaggggccaggcatgatggctcacacctgtaatcccagcacttggggaggccaaggaaggaggattccttgagcccaggagttcgaggttacagtgagctataatggtgccactgcactccagcctgggtgacagagtgagtccctgtctcaaaaaaaaaaaaggaataaaacccaaatgtcaaatgagagtgaaggtatctttatattgacatagccatgaggttgcccttcaaacaggctttgttaaagcttgaccttcagtgaacacagcgtctagcaaaagccaggagccacctgcacctttttgtgaggtagttctggatgccattcctagccctggaactgcttgcaggcatataaattgtagccgcagctgtttttgatatgcaaggccagatgggggctagtttttgagctgtttcagaagccaattcatggacctatggaatcaggaccacatttgctaataatctgttgtggcattttaaaaattatttgctattgtatgattcaagattaacccaaacctttagagagaatgagtgagtaatagtaatagatggtaaaaagattcaaggtaccaatttttaatctcatagggaggtccttgcagattcctcctgtgctgtctttcaaatggttctttaatggactttttagttaccagatgataacctcttctacgatattcccattaaaagcaataaaatcgtggccagaacctacctcaattctgcatttttgatgtgtgaatgggatcgtaagaagaagttataaaaaagagaaaatatctttcacaagtatttctgcttgtaccatgtccgttacattgattcaaaatgtttaaactttaaagaaggtaatacatgcatatggtaaaacaaattgtaaagggcagtaaagagatatcaaatgagaaataaatgtctcccttcttatctcccatctcaacataaaccccagttcctgtcccaaatgttaatagttttgtgactatccttctctaaacattttatgtatatattttctgtctatgcttttatttaaaagtgtgcacaaacgggattataccaaacacactgttctgaatttttctttcattcacaaatgtataatggaattctttccatacccacacacaccgacctagctcattctttttcgagtcacttggtattccattgtgtggatggccagtgttagaaccatcttaagcaacgttctatggatggacatttaggctagttttttttttctctatttaaaaaaaaatgggcagataatatccttgttagaaacatttttgtatactcatagaagtatatctctcaagtagtttcctagaagtagagtttttgggtcagggtgtatgggcatttcaagttttagccatgtaatcaaattgccctccaatatggctgagtctgtttacattcctaccagcaatgccatcaatacttccttgcttacccacctggcaatacttgcaatattaaattttttaaaatgtttgctaatttggatggtcaggatgatcccattgtggctttgattttcatttcttgaattataagtaaggcagagcctcttttcatttgcttatggagtacttgtacttggttttctgtgaattgcctatttattattctttgcttttcttttgagctctttgcccttgtctactgtgtaaacattcaattcttactatgtggtgagcactatgctagactctcaaactgtaatggagatgaaatcttttggagctggcagtgtactaggagacaaacattgatcaaataattctctcagtaagtgtatggacaaactgaattaaactgaattaaatgccttgaaggaaagtttcttgcatcccttagagcatggcagggaagagagggggctggactaggggtgggagaagactgccctggagaaattgacatctaaagaatgaatagggccaggcacagtggctcacacctgtaatcccagcactttgggaggccaaggcaggaggatcgcttgagcttaagaattcaagacccagcctgggcaacatggtgaaacccccatctctacaaaacatacaaaaattaaccgattgtggtggtgcgcacctgtgggaagctgaggtgggaacattgcttgagcctgggaggaggaggttgcagtgagcagtaagccatgattgtgccactgcactgcagcctgggaaacaggagtaaaaccttgtctttatttaaaaaaaaaaaaaaaaaaaaatgaatagaacttggagttgagggaggagcatttctggaagaagggacagcaccgtggagggaagatgatgttgtagatgggctaaaagaaggcgcaggagcagagcacagagagaagaacagtgatgcaagataaggctgggctgcagcatctgggggaggaggcctctatgatgggatatatatatatatatatatattttttttttccccccaagatggaattttgctctgtcacccaggctggagtgcagtggcgtggtctcggctcactgcaagctccgcctcctgggttcacgccattctcctgcctcagcctcccaagtagctgggactacaggtgcccaccaccacgcccagctaattttttgtatttttagtagagacggggtttcaccatgttggccaggatggtcttgatctcctgacctcgtgatccgccagcctcagcctcccaaagtgctgggattacaggcgtgaggcactacgcccagtcttttttgcctagagcaatagaaagccattgaagaattttgagccatcgttggtaatctaatctacattctgaaaatactgttctagctgaacagaagagaaacaggaagatcaattagaagatattttattagtccagatgagatctcatggtagcctggccctggattatgacagtggacatgaagagaggcggaggaggttaaataagatttgatgacgggttagatttggggggataggaagagaggaggtatccaggatgattcctgggtttctgattacatggatggtggtaccatttactgagataagaaacactgaggccggggttgggttcagccttagacaagacatctgactaaagctggcaaggaggtaattaaataagatttgatgacgggttagatttggggggataggaagagaggaggtatccaggatgattcctgggtttctgattacatggatggtgataccatttactgagataagaaacactgaggccggggttgggttcagccttagacaagacatctgactaaagctggcaaggaggtaattaaataagatttgatgacgggttagatttggggggataggaagagaggaggtatccaggatgattcctgggtttctgattacatggatggtggtaccatttactgagataagaaacactgaggccggggttgggttcagccttagacaagacatctgactaaagctggcaaggaggtaattacatatgaaattctaaggccagaggcaaagtttggcctgtcaacataaatttgtgagtcattcacatatggtagttgaaatcatggtcctaggaaattgctcatgaaaggaatatagtgcccaaagcaggtctactcttattccttaagaaattctgatatttaatagccaggtagagaaagatgagacagaaaagaaaacagaaatgagcagcctgagagcaggaggaaagcaaggggagtgtggttcccagaagctggggtgagagtgtttcaaataggatggaatagtgccaagtgctgccgagacatctgaaaagaggaggcctgggaaacacccattggatttagcaacatgggggtcttggtgagctaattttaaatttcctcaatggaatgatggaggcagaagccagattggagatggttgaggaattagtgggaagtgagaaaatggtagacattatatggaccactttttttccttttttttttctgagactggagtgcaatggtgcgatcttggctcaccacaacctccatctcccaggttcaagcaattctcctgcctcagcctcctgagtagctgggattacaggcatgcgccaccatgcctggctaattttgtacttttagcagagacggggtttctccatttgttcaggctggtctgaaacccccgacctcaggtgatctgcccgcctcagcctcccaaagtgctgggactgcaagcatgagccaccgtgcccagccgcaccacttttgaagaagtgtgattcttcatagagaatagccccaaatctgttcttcctcagtttccacccttgacccttttttgctactcagtaagctgaattgatcttgtaattcagtagtgaaaggtctgcagctttgccctccctgcagccatggcaccagccagcccagtgtggagtctgcagggggagcccagctggagtttgggccactccagcccctctgtgcagtttctgattctacaggccagagctctgggaaggcccattgtaggaacgcggctgaaaaaatgagtttaagaaaaagttcttatattttagtggtacctactgaaaagttgaaggatacatatttgcaatgtgacacaagagaagccatgagctgatccttgttgaagctgagcaatgggtacatgggggtttattatattgttcacaccacttttgcatatgtatacatttttccataacaaattataaaaagttaaatttaggaattctataaaccgaaggtgcaaagagccagtggccatcacaggtccactatgtacatagcacttaaaacaggaccttcggctgggcgcagtggctcacgcctgtaatcccagcactttgggaggctgaggcaggcggatcatctgaggtcaggagttcaagaccagcctgaccaacatggtgaaaccccgtctctactaaaatacaaaaattagcagagcatggtggtgaatgcctgtaatcttagctactcaggaggctgaggcaggagaattgcttgaacccagggggcagaggttgcagtgagacgagatcgcaccattgcactccggcctgggcaacaagaacgaaacgccatctcaaaaaaaaaaaaaaggtaccttctctaaaccagtcctcctttggattgtgggtttccaggtgccaagggtagctgaagaaattctatttccagatgccaccctttcttctcctgttaactccaacaccttgttccttgcccccttctcctttcgtacccgcctcctgagtacacactagaaatcacaggtctgacccctatgggcctcatgaacttgaacaagttccctcccatctctgagccactctgaaaaatggggattataacatctgctgtgcaatgttgtgacgattaaatttgacagtgcacgtgcggtatctaacacagcccacagcctcagatgcccaggaactcaggaaggtcatagaagtgaatgaagctgaccaggtacatgagaaaatcatgtgaccctcttagctttagctttgccacttgtagtagacatgtaagtagagagaattataagaaaaattctgggccaggtgcagtgactaacacctgtaatcccagcactttgggaggctgaggcaggcagatcgcttgagctcaggagtttgagaccagcctgggcaacatggcaaaaccccatctcttaaaaaaaaaaaaaaaaaaaaaaatatatatatatatatatatatatatatatatatacacacacacacacacacacacacacacacacacaagccaggcatggtggtacatgcctatagtcccagctactcaggaggctgaagcaggaggattccttgagcccaggaggttgaggctgcactgagccaggatcacaccactgcactccagcctgggcgatggagcaagaccctgtctcaaaaaaaaaaggggagggctgggaggggagaaaaaattggataagaaaaagaacaatgcaagtatgataaatgatataaatcacccatattcataaataaaggggtaataaactgagacttaacctcagtgttggggggcaacagggaggggtggggactggggcaaatcagagcatatagggtccatctgagagggacagccatcctgggctccagccgattgctgccatgagggagtgtgaagccaatgttaacatgtcttcctggtttataagagaagccagaactcttaaattttttatgtgaaatatttcaattcttaaatttgggctcagttattttttttaataacactacagaagccaaactaaacccatttatgggccaaaatcagctcgtgggctgccagcgtgcaacctctcacctagataatggtatataatataaatacgtttcccttccccccttttttctcttcctcctctttctcctttccctcccattttccacatccttttcacctaaccagcccccaccctacatttctatactaagtccaagtgatagaagggattagggtgggttgaagcagtgattaagcccaaggggatgtaatctagatgcctaatggcgccccagggcctggatcattgcctggcacatagtggatcctgtcaaaaaccttgatgaatgaagaagccagaaactgggggagtcagttctgtttcttgtgcacaccctgggcttacccaaagaactgtctgatttttctcaacagccctgagaagtcgttctggacgctccatcatcaatgggaactgggcaattgatcgaccaggaaaatacgagggcggagggaccatgttcacctacaagcgtccaaatgagatttcgagcactgccggagagtcctttttggcggaaggtcccaccaacgagatcttggatgtctacgtgagtttggatgtttctggactgttctttggattttgaatcttgtcacttctaaggaacatactctgaacaaataagcaacaaatcattgcccatactcaataaaaaccctttgagcagagcctgttggaggcactccttgaatgcttggcgttcatctttgcctttacttctgaatgggcccagctcacagcaacctccaactccaccagatgcttattaccttcggagtttattgacccagtaaaaccaattttacttgttgaaccaaatcagaggcaaaacatgccctttatttcatgagcattggatctcctccaggcactttccttatactgctaatttggcatgttttctttttatggcaaaagaaagcaagagcctaaaggaaggcaggaccgctcccagctcccagccctgttcagactctgagagcaaatgaagaaaggagagctccagagccctccagatgaaacaataaagctgagagtcacagtagagagatttactagaagctccctgcttcatagaagacaaaaccttaatttcttttacgtgaaactaagatattaaattgctcaagagttttaaatggtccttacgttcaaaggaaaccactagaattcaatcttcttaaaagaccaggaaataaagggtgataagacataaaagcttgaaataacattttgataaaaagattgagatcacccatgaatatacacattatttctgtccccaaagctgagctgattaacatatttgctgtgtcagagttttagaaatattattaattgcattgtcattacttctccacctacacacagttctatgtcctttcctcttgggcctagtagactcgaaattacaaaggaagccttgttgtagtttattttggattttttttttagactgtccagttggttggttgaatctgaatatattttaaatggcatcagaggtaaaaactcaggttgttaaaggcctactgtgggtggtctaggaatggaagccaacagcaatttcataaacgggacaaggttttgcactggcagaatgctcaggcagaagaggcaccagagagggagggaggatttccagccacagaccgagaggaagattgtgtgaaaagggagtgaggggatgagggatacacagcaggaacctgaggtcacacaaccgtgtcccttggggattcagtgcccaccacgtttctgcaacgccgatggtttgatattggttcctgggtaggagaatcccaggggttctcaggtctgccttcctttgggtaatttataaaatgaagacccatttcatcagtagggagtggcaagagatcatggcataaacaggaagaatagacacaggacccaccatgcaggagtgactcagagatgcttctagctggaaaggacctttgaaagtgacatgattctaacctcttccttccccaaggaagaaatcaaaaactgcagggtgaaggggcttgctctaggttacacagctggtcaataggagagctgctttataaagcagcagagacagaaacatcaaacccgaccgtgtctccttgcacggctcatatttacactgtggattctcattctgctgctgggtttagcccaccaccctgctccccatcaggaaatccatgggcagcaaagactgtgtgctctaaatccaatagggagggacgtattctgttgggccatgctcatttaatatgttttcagcccagacaatgttcagctgctgacttccacagtcctacgtagattcctgcttgccatcctatttttgtcatcattcctaagagaatatgacccagcaagagttgggtcgcttctacttgttttcctggccccatgtctttgtgtttctggggctttccctgaataagagggagggacctgggggccagcctcaccagccaggtcaagaactttgagggaacctaaagcatcccggggtggctctgtccaggaggtctgctgcttgttcgcatgactttgtcacgccacctagtgttaaaacagttctcctgcagtgtacacgtatttatctgtgttggatgtttcaagagcactgagcaaaatctaaggacagaaaggttctgctaccgttgctccatcttctcctttggagtttagaaaatcttgactcttagcttagtcttcttctgatttgctcggcctaagttcttcattcttcaaaagtaaatgacaaaaagccatccaggaataactttgtttaatctgccacaggttcactgatattactggatgcgtactagagtgaaccaacccagtcatttctcagtagttctgcaaatgccattgaaacccagaaggggtgtgcatacgtgccaagtgcggtaacactgatttttgtgtcagcagatgatacaccagcagccaaacccaggcgtgcactacgagtacgtgatcatggggaccaacgccatcagcccccaggtgccaccccacaggagaccaggtagaatcccttgtcttgtggccggggactctggtcatttccttgtaaagccttctctctctcaattcttgtgcatccaccctctgtctctcggtcaacacagagaaaattgagggacgcatatttcaaagccaaggggccttgacattggagcaggcttcaccatttgtctgagccttcactgatgagactgtttcattcactcgattccaaaatggcatgagcatcctgggtctgccctgccagttcaacatttgaaatgctttatactagtttccaggccagacaagggggctcatgcctgtaatcctagcactctgggaggccgacgcaggtggatcgcttgggcccagaggttcaagaccagcctgtgcaacataatgaaacccctgtctctacaaaaaaaattacagaaattagccaggcatggtggtgtgtgcctgcaatcccagctactcaggaggctgaggtgggagaatcatctgagcccaaggaggttggggctgcagtgagccgtgatcagaccactgaactccagcctggacaacagagtgagaccctatctcaaaattaagaaaaaacaacacaaatttactttcttagagctctggaggttagaagtctgaagtgggtttcattgggacaaaatgaaggtgtcatcagggcccctctctctccagaggctctaggagagaacccacttcctcgccttttccaacttctaggagccacctgccttccttggttcctggccccttcctccaccttcaaagccagcagggtggcactttcaaatctctctctgaccctggcctcatcacatctcctctctgactctcatcttcctctctctttcctttataaggacccttcagattacactgggcccacccaagtaatccaggataatctctccttctcaaaatctgtaatttagtctcacctgcaaagtccatttttgctatgtaaggtagcatgttcacagattccagggattaggatgtggacatctttagggggccattatctgtctactatatgccttttctcttggttccccttttgtttctgttaataatactttgacctataagacaagaataatgagttcacacctaacaatccatgttgagtcttcctggtgggctctgcttatggacagagcaggcagctttctctcggctggcactgggcatgggactgctctctgagtctgcagacatttctctaccggaggatgatggagcccaccacccaaatgcaggcagtcttttccttccttaaaataggaaggtctgcagaagtattcatggtaattatagctcacacacattgagtccttgctgtgtgcaagggcttagaaactgctgtgctgagctctttgcgtagattagttctttgaattctcatgacagagggaggtacttggagggaagtactattattagccttattttaagagtaaggaaatggaagcttaggaagagtaagttaataattgtcctgatctcacacctgggcagtgacctgaggagggcctgtgtgaccatactttgtgcttgttatatcactgagaggttacttggtccaatccctaccctaggaggaaataaaggcacaagtgccaaacccgccccatccattcttctctgaactttggacgggataaccaggttatctgattgctacagactggggaggacaacagctgggtgcatccccagaacatggggtgggtgtgttgtccaaactccaagtcagcaaactcagcacaacagagaatttttatgtcatgtccagaagcaatccacagtttgagaaaccaagtttgggtaagatttctggggtccattgctggtttacagggataatcagacagactatttgaaatctatcaggatgatgatgatttctgtcaggcctgatggggctcagctcatgaatagcatgggggttctgggatcagctccctgggacagggcaggcctggaggggtcacctgtaaaaagttggtaagcaggggcattgtcaccaggcttcctcttccatgtcaatggagtctggaggcagagttggaatccagctctgcacctttttgctgtgcaccctcaggcgggtcagcaacctctctgaacacacacccagtctacaaaatagaagaaaaaccctataaggtggtttttggcaggggagaggacatgggaagagattgaataaattagttgtccatcctagcatagagcccagaacaaggcactgaaaagacttcttaaatttttttgtccaacaacatcttggacagttctcatttatgtcaacatgcctggtcctgattttgttggtcatatttgcatgtcatattttaaaccatgaagcataataaccaactaagtaagaaagccctggcaaaaaagctgagaggtctggtgcagtggatcacgcctgtgatcccagcacgtttggaagccgaggtgggcagattgcttgagcccaggagttcgagaccagcctggacaaaatggcaaaaccccatctctgctaaaagtacaaaaagcagctggatgtggtggcactcacctgtaatcccaggtactcaagagactaagacacgagaatcacttgaacccaggagacacagggtgcagtgagcctcctgcactccagcctgggtgacagagtgagactctgtctccaaaaaaaaaaaaaaaaaaaaaaattgctgagaaagccctaattgttgttgttgttgttgttgttgttgttgttgttattgctgaaatggggtctcgctatgttgcccaggctggtcttgaactcctgggctcaagcaatcctcctgcctcagcctcccaaaacgttgggattacaggcatgagccacctcacccagcccccttgtagttttaactgtgttctacagtaaccctagaatttgcctccttattttctattaaaatgagacatacttgaacaatattcagtcaaaatagaaatatatacagtcaaaagcaactgccacataattgccaaaacttggaagcaaccaagaagtccttcagtaggtggatagacaaaaactaatggaatattatttagggctagaaataaatgagccatcacgtcacaaagagacatggagaaaccttccatgcatattactaagtgaaagaggccactctgaaaagactacctattgtttgattccaactatatgacattctagaaaagttaaaactatggagacagtaaaaaggtcagtggttgccaggggctgggaggacagagggatgaaaaggtggaacagggaggatttcagggcggtgaaactactctgtgtgatattacactggcggatgcatgtcactgtgcacttgtccagacccacagaatgtgcacccccaagtgtgaaccctcgtatggactatgaactctaagcaataatgacatgtccgtgtagggtcatcagttacacatgtaccagtctgatgtgggatgatggtagtaagggaccctgtgcctgtgtggtgggaggaggtgtgtgggaactctgtacttctactcacttttgctgtgaacctaaaactgctctaaaaaaaaaaaaaagcctattaaaaaaaaaaaaagtccacagctcccaaccccatgcccttcccagagggagtctaaccctttggtgggattttgcctagcccttttctatgcatacacaaacatgtttccagccatttgaatcatcatctacaatctcagatgtgcaaggaatattgcatattattattttccattagtcagtttaaatctgacctcaacttcacccttctttgaaaccagtagataattcaatcgcagtctgcttgggggttacacacacacacacacagacacacacacacacatattctcactccagatataaggaaagatctagagtcttagacaagccaaaacattggctagacccccctggtggtctgtccacactaattccgctgaggtgccaccgggagcagcctcatggggccttcaggttagggctctgctccttccagtctgcatggggggcacaggaagctggtgaggctggcagccaggccccctctcccgctgcaggggtggcttcctcctgggacactggacattgtctggtacacctaaggatccatggcactcaggaaacccaagactccagactcctacctctcctccatcttgaaaacctctctctctctttctcactctctctctctctctctctttctcactagctctctgtcttgctctctgtctgtccctctctgtctctcttaccatctccctctcttttgctctctctttattgctctctgtctctctcgcactctctgtttctctctctctctcttgctctctgtctctcttgctctctgtttctctctcttgctgtctctcttgctctctgtctctctctcgttctctgtctctctcactttctgtctctgtctctgtctctcttgctctctgtctctcttgctttctgtcactgtccctgtctctcttgctctctgtctgtcttcttctctgtctctgtctctcctgctctcttgctttctgtctctatctctctgtctctcttgctctctgtctctttcgctctctgtctctcctgctctgttgctttctgtctctgtctctctgtctctctctgtctctcttgctctctgtctctctcactttctgtctctatctctctgtctctcttgctgtctgtctctctctcttgctctctgtctctgtccctctctgtctctcttgctctctgtctgtctctcttctctgtctctcctgctctcttgctttctgtctctatctctctgtctctctcttgctctctgtctctctcttgctctctgtctctctgttgctgtctctgtctctctcttgctctctctccgtctctcttgctctctgtctctgtctctctcacactctgtctctctcttgctctctgtctctctgttgctgtctctgtctctctcttgctctctctccatctctcttgctctctgtctctgtctcacactctgtctctctcgctctctgtctctcctgctctctgtctgtgtctctctcttgctctctatctctgactctctgtcttgctctcttgctctctgtttctgtctctctcgcactctgtctctctcgctctctgactgtctcgctctcttgctgtctttgtctctctcttgctctctgtctctcttgccctctctgtctctctcactctctgtctctgtgtctctgtcttgctctctctatctgtgtctctgtctctcttgctctctgtctctctctctcgctgtctctctttcttactctgtttctctgtctctcttgctctcttggtctctgtctctgtctctctgtctctctctcacttgctctctctctcccttgctctctgccactgtctctctctcctctctctctttctctctctctcaaaatgtgccctcctcctctctctgggctggcccctcagggacatccactttacccttaatgaaagcctaggctttgcactcttggaagggaaagctgttgacttctagcagcttttgttttctgtcctgcacaaaaacaaagcaataacatctaaggacttggctactctttcaaaccggaggaggaagtggaggaataaagatagtaaatcacacacaaattagtatctcaaaaagtgacctgccacacctgtgtgtatgtgtgtgtgttctgcttttttctttcaccaaacaatattgtcatttcttcatgtcggaacgttatatttgctgcattcttttcaaaactcacatagtattccattttgtacttgtagcataacgtagtttaaccagtaccactggtgaacatttgtgtctgtttgctatttcaaataatacctcagtaaccatacctgtatattcagatttatgtacaagaaaatatttgcggaacagatgtgatagaaactgaattgctaggtcaaagggtatgtgcatttcaaatttggataaataatgccagatttccctccaaaaccatggatctatttgcaggctcatccatagtgactggaagtgtgttttcctgcaccttcaaaaggagtttagggatttaagggtttccaaactttccaatctttggtgttaggtggtggtgttcttttcatgtgtatttatggaattatgagtaaagttgaggatttttgtatgggttttggctgtttgtgtttctttttatgtgaactgtctatggctcacaattcctgttcctactgcagtgttcgtctttgtcttattgattttcaaaagtgctttgcatgtgagggaaagcactagtaggtgtctgcttattttaaacagatgtgcttatgtgctgtgacttagaaacgatctcatgctacacagtctctaatgtcgaagcaatttcctctttacaactcagggtctaaactgatcctgattctgtgtgtgcacgctcacctctcctaggggaacccttcaatggccagatggtgacagaaggcaggagccaggaggagggagaacagaaagggaggaacgaggagaaggaagacttgcgtggggaggcccctgagatgttcacctcagaatcggcacagaccttcccagtcaggcatccagacagattttctccccatcgaccggacaacttggtgccaccagcaccgcagcccccacggcgcagccgggatcacaactggaagcagcttgggacaacagaatgttccacgacctgtgggaaaggtgagcctgtgtgggggacgggtggatccctgcagaaccctaagcaaggagtgtgtgggtggcccaaggcagcggtccccggcttttttggcaccagggactggtttcgtggaagacgatttctccatggatggtggcggggttgggggatggtttctgggtgaaactgccctatcgcagatcatcaggcattagttagagtctcataaggagcatgcaacctagatcccttgcctgcacagttcacaatagggttcacgctcctatgagaatgtaacgccaccactgatctcgcccacccaccagtcacctcctgctgtgcgacctggttcctaacaggccatggactggtgtcgattgggggcccctggcccaagggaaatggcaaaccctcacctctgtgagcctgtctatgagatggctcatgggtgtgacagattgcattggggccctcaacaccaccctcaggtttaatgattggctcaaagggcttacgagacccagaagagctgttacaattcatcacagtcaaaggatagggattcgagttaataaaggaaaaggtgtgttggcaaagtcctggagatgccaggcgccagcttccaggtgttgcctccagcagagtcacacagggatgcacttaattctctcagaaatggtgtaattcagaggctgagaacacatgccaagtactgccaaccagagatgctcacccaagatttggtgtccagggtttttactggggtctctcgtctaggtatgcagctcccacatgagtgacactagctactctccctttaccatcccagaagccaaaccaatactgcgtggcccaagacctcagcataaaaaaacactcttatcaggtggcatattccaagggcttagaggttctctctcaggagctggtcaagggcctgtctttggcatgtgcagggtttgagcaactcaggcctgctgtgcacatatattcattaataaacggaatacactcatgtacttcaagatctaaaatttaatctccaagtcagggttgtggaagacttacacaaatcccagttgaaactcattctcaaatctcaggatttcagaaaaaaaaaaaaaaaacaaaactttgcaggcttggcgtgttagctggcttttacactgaccaacactcacagctcccatactatcccggtaaaatcccaaccctgtattcattcattattccaacctgatcagctaggaccaccagggacaaacctgaagcccaacaaagtcagctttattgacccctcaccacaagggagtccacacaccggaggaagcatggggcgtctctccaaacaaaagaaaagatagagttgtaggatttgggaggatacagtttaggtgaaatttaaataaagtagggttgtgataggctgaaagcaagacatggcagtgttacaggggtcacatcaggatgatgaagtggacccagggtcccgtttccttgaaaactccaaagttaagatacatgtggaatgtgctgtccagaaaccctttatctgacattccataccagattggaaatcaatgctgcttctgtttcaagctgactcattgcaaagatacacctatgaactgtgtagttataatttccttcatatatatgataatagcctcctgtttgtagtaaagtcctattttatcccctgaaacagctcttctttgaggggaggttgctaaagaaacaggaaggctgtatcccccaggaatctctgcaaactggggaactgtgtgatgtcccagagcattggtttggggtggttttttttttttgctttgctttgctttgctttttttttttcttttcctttcttttcttttcttttgatactggtatctaagagtacaaagtttggaacctctcacaaaattagcacactgaaaaatctcatgacagcttctaaagtttttatctttttcataagagcattggcttagtggcttttgagaatagaatttaggtctttggttcttcttgggggctggagcttttcctgcctggaacctctgcagttccataatgatttggtaactggagtgttgatttatagaggttttattgtgcaaattttattatgcttatacttaataaatgtgcaaagaatctggactgcagattcattggaccaacttcttttatatactttgtgaggaaaaattaaatgcatataaaatatgtcttgacagagtcagaaagctagaaatatttttgcattaaggccaaaaccattttggtgagactctgtgatattatagaggtaagcagtatgtaacataattgatataggaacccgaaatcaaaatgtattattattgaaatattctacctttaggtaatgtgtgatgcccatcaaaggaaccagatacactcagaactaggtgaaaatagggaaagtcataaaaaggatgaaagctgtcactgcgtggttttcaacaaagggtgccatgtggagaagattctctttcaccctgtccggagcccataggccttgtgttgtgagcaggatgagatgagggcaaatgcatgtgctggttccctgtgtctcctccagacgctcccacggtctctctaatggagcaaactcataaccaaatgttccagtttttgcccccacaacccatccgcacgctgtgtcatccacactgaggtatggagttgaaatttaaagaaagcaaggttttgatagactgaaggcaaaacataactgttactacctcactatatgctagtatccctcctttacgacactctggtatctggccagcaaagtcctgctcgtactccaagctctgagaccacctcttctgcaaagccttcctgattctgcaaagaacaggtaggcatttcatccttgggacctcacagcaattcaggacacatttctgtcccagccctgcttggcttggctgtctccatgaatatacactttgcaacttctgcaccaggcatcataccaagcacacagtaggcactcctgtgttttttgaataagtgactatatcatcaccacatttcaaatgcggaatatatgagctactagaaaagacataagggtagattttacatctttattgtatcctagatatacaagtctattactgccttttcccatgttctgtcaacatagcataaagaatgtggatttacctgttagaaattgaataagcggccgggcatggtggctcatacctgtaatcgaagcattttgggaggccaaggcaggtgtatcacttgaggtcaggagttcaagagcagcctggccaacgtggcaaaaaaccctgtcctcaccaaaaatacaaaaattatctgggcatggtgatgcatgcatgtaatcccagctactcgggaggctgaggcaggacaattgcttgaacccaggaggcggaggttgcaatgagccaagatcatgccactgcactccagcctgggcaacagagcaagactccgtctcaaaacaaaacaaaacaaaacaaaaaaactgaacaatctctttctctagatttccatatgattttgtttaatcttctgtcctttgcattgcagaaacacacacacagaaattcacaagagtgtgaggtatgggactgagcatgcacaggacccattttcaatatttagcccatatacacccatgtgtgcatgtacacacacacacacacacacacacacacacacacacacacacactcggcatctgccactcagaatgtctgaggcgacatgtctagctcttctttacccagtaaatggcaccagttctcaggcccaagagatactgaagaggtgccttggaaataaagcaaacctagggatgtgttgtttctcatccctcccttctctggcaatcctagttcctttttctttcaagtgacaagtggcagcggcccgtggaggcctctcctttgctctgtcccaggcggtgatggcaccagacatgcagggtaggtgaggcaatgcggaggcacagatgcagagcacatctaatggtcgtcagcagtcatggcaagtgaccaggaaatcccaagcctcccggcattgtccaagtcacttatgcacagaataagtctgttccccttgtgatcccattgtgtattttctcacataccctcgcctaaacccttctccagtcctccctggtggagctaaccacaccacacagttctgtgcttttcatggtcaaatttccctttgtctaagtgcttccagcatcatgatatcaccatctcagggaagggccctgttgctggcatccaagagtggtccatactcacacagccattgatcaggcctctgtcaaactcttggcttgtttcatttgattcctagagttccaagtctaaagtcatttacttttttcttgctctttattttgtctctcttccataatgtcccactgacctctacactagcccctgaattcactgacctcatttattatctgctaattacctgtgtacagttccccccttcaacatgacatatttctattttgatcaacatgtccgcatataaggcaaccgaactgatctcgaatagttttcctgctgcctgaagcccagccagtgcctgacctcaccaccttgttcctgcttgctagcaaatagaggaataattgaattgcaatcttgaacaatgggaggtggccaggtgctgtctccctttctaaatatattaaaactgacccaaagaaggaaaccactgcggtcactagactcaagagttgtagatatgggtcaggcgccgtggcttatgcctgtaatcccagtactttgggaggccgaggtgggcaaatcacctgaggtcaggagtttaagacaagcctggacaacacggcaaaaccccatctctactaaaaatacaaaaatcagccaggcgcagtggcaggcacctgtaatcccagctacttgagaggctgaagcaggagaatcacttgaacccgggaggtggaggttgtggtgagcagagatcgtgccacttcactccagcctgggtgacagagctaaactctgtctcaaaaaaaataaaaaaagatttgtagatctggcattttcccaccttcagagagccagagggcctctgagttcatttccgtggagctggaccatggacaatgtccataaacgccgtaaaatgtcaagggaagacaagcagtggccaggtgctggacaaccccagcaggacccatcttcccaagacacagagcattcctatgggagcctgtatccttttgattaaaaaaatttgatttctcccttatttgagtgccaagtggttgagatagttccttttgctttcctatccacaaacatctaagtggaaaagctaaacccgcatggtctgaaggaaaaggaataggctaaataagatctttacttaatcccttaatagccgggtcccactgcaagctgtgaaccatgtattcacctttataactgcacagtgtacttaatgtttgttgaatttaattaaaaatctgttctatttaatggaaggagatctgtagctggacaaactttaattccacaaaagttctttgcatcccattaactttacagtcagtactgccttttactcagccaataattgtgcttaattggaacgttattttaaataatggtctcaagttatagccacactgtaaatttttactaccagggtaatttaaacaaatgatcgtttcagattcaacactgtcttgcaaactgtcaagtttcttactaccctctgggtcagtgtgtcatacaagatgagcttgaaaaaccactgaaacactttcatgactgatgaaatattaagatgtttatgttaaaagatagcccctatgttgcagttaaaattgtaaggagttggaacttcagaaaatatgaatgcctggccaattagcaacagagataagacagagttgtagaataaagtatagtgttcttcccggcaggagttgtatactggcctggactgtggggaagacagttatttgtgaagaagcatcttcccgtggttggttcaggttcaggggttacatttctcacgttataaacgtccattaataatagctcagtgttgccaccaggtggcagcagagaaaggaaggcagaattgaatcagcttttttttttttttttttttttttaattgacacctagacattccatttaacaaattctggctttttatcgaaaatagatgtatccttattaatccaatgaaagtaaaacaaaaaacctaaaacagttataaacattcattcaacaccattcaaacattcattcaacacggtcatttattgagcccctgctactctcctaggtactggggctacagagattaagaagtagccctgtccctcagaagctcacggtctcatgggaagtagacaaatgctcagatcactgaaataccattggatgggtactttattagaagaacatgaaagacgcttgccaaagggggaggcagctgctcttccgccctttcttgaatcttctacttctgtgcttcaacctatcccttaaatgtacctggtgtagcaggctagtttgtcaggcaggtactttcattccagtttaatgacctagacagcctcctccctccaaaatatacatgcacatatctacccaaacccaattctttctctagaacgaagcttggcccatttaggacactttctctttgacgcttccagagaactttagaaaagttactatttgtgttccttctataatcattcccctgcctagggaatctctcttttgttatcttgaactataatgaagatgctttgtatctgcctttgagcatatttagaccgtgtccacaaatagattattgattccttttagggcaggctcttctttgcacccccacagttcctagcaaagacctgtgaggtaggtgtgtgtaaaccctcaaatgaagggggagcgtaagtgtgcatgcatgtgtgaattgtcctcactgtttctgtgccctctcttcatcagcacccgaatctctgtgcatctccacccatagcccagctttccagtgtgtgggactgtccttcagacattctcctgttgttgcaggatcgcagtaccctattttccgctgtgtgcacagaagcactcatgaagaggctcctgagagttactgtgactccagcatgaagccgacccccgaggaggagccctgcaacatcttcccttgcccagccttgtaagaaggcccctccatttaggtcgcctattaccgggtcacttcaggtcacttatgcacaggaccttaggaacagatataagtcagtctaaatctgagttagaaatacaagacttggaccatgcataaaatgcagtctgtttagcaggcacacctgtctttcaggatgaactcaggagctgatagcctttagcaagtcaacccacttctgggaagcccacccttgacaaagctggagcaattaggtttgagcctggtaaggaaaacaaaggaggaagcaaaaaacgagaagccagtgtagttggtgtcgtaggtgagctgttcacagagagaggataatgcaagtcacaaaaacatcagcctggagaggccaagaaaagtgtctcgggagaggtcttgaactgtttcggttttttggttttgtttttgtttttatggcagagtctagctctgttgcccaggccagattgcagtggcacgatctcagcaaactccgcctcctggattcaagcaattctcctgcatcagcctcccgagtagctgggactacaggtgcacattaccacgcctggctaatttttgtattttttgtagggacagggttttgccatgttggccaggctggtcttgaactcctgagcactaatggtctgcccacctcagcctcccaaagtgctgggattacgggcgtgagccactgcgcctggccttgaactggttattgaatgataaatgggacacttgaagaagaacaaggggaaagggccctaaaagggtcaaaacctaatttgcagagtaataaaaatataattctcatccaagtatatggtgagcatgggctgatgtctcatttaactaataacagagcagatgacagaggagggtttgcaaaactgatacgggaattgttaatgaaaaataatgctagaataagattcctaagttagtagcaaaaatgagttaatgatctacagtgtaataaaactaacctttggaggttttttttttaattagataaaaatcatttgtacgttttcagttttctataacttttcatagaatctgggccctaatcactggtaaatagcatgtcaagtgtcaggcaaatttatctgcctttacagagtcagatgacccttaggcagactttttctttttctttttcttttctttttttgagacagggtcctactccattgcccaggctggagtgcagtggcacaatcatggctcactgcagcctcaatctcccaggctcaagccatcccctgacctcagcctcccgagtagctgggactacaggcacacaccaccacacccagctaactttggtattttttgtagagacggggttttgccatgttgcccaggctggtctcgaactcctgggctcaagccatcctcccacctcagcttcccaaagtgctgggattacaggcgtgcgccactgtgcccagcctaggctgactttcaagcaatgctctagtaagaaactctacccatagtgattctgatgattctgtgtacgctgctgcgggctcacgctgacttcctgttgactgaaggttgtctctcactctcgctctctcattcctgaaccagctgggacatcggggagtggtctgagtgcagcaagacctgtggcctgggcatgcagcaccgccaggttctgtgccgccaggtgtacgccaaccgcagcctgacggtgcagccctaccgctgccagcacctggagaaacctgagaccaccagcacctgccaactcaagatctgcagcgagtggcagatccggaccgactggacctcggtacgcaggcagggcagcccgctctgcagctccctctccagctcccaccacactttccagcctcccccaccaagacctgagatgggtaaccctgagttccacaggagggaacccgtcccgtgggggtctggacggctgtttttgcaaaccacaggatgtaccaatagttcaatagagttcagggtagtgtgtgccacccacagccaactttatgagtgagcccagggggagccctctgatactggcctcatctgctttgtgagtcatggtgaagtgaaggttggcaactgctggtagagccaactccttccaattttccctacccattttatagctgaaaagactgaggcctggaagaatagagtagtgtcagtcaaaattaaggctgttaaggcagaaataatttgataaaagatttattggaagccaatgtaaggatcagcccaagaagacacacgaacaacgttggacatgttccaaagtctgttacaagttgaaaggcttttagaagaaagtttaggagaggagacggggaccccttgaatcggagttgtctttttcattggagggtacagcacagaggttgcaatcactggctacagatgacgacatacaggctaaaatgttttaagtgcaagacagtcaataaaacttcatgagtcagaaataaatcagcaaaactttatgactcagaaacaaaccaaacaaaccagtgtcctcttcaatgtccacaggttacgtattaatcagtatgtcaacagtttgaagaattcacaataagatttgaggaactgacaataatattctttactctaaacaggatgtaagccatgaatcctaagaccttcttcccaggcaacttagaacatagtttattcttcaagggcagaggtgcatgacttaaccccttgcctgccatggcgttgggtcctgtttataatttggtatcttattgccacagagagtccattctgtcagtcttatgatttctcccttaacatcagtgctggtcggttgtgtctagactgcaaaacggaggtggtatgacagggtgtgtccaaccttccatcctgtcatggccaggaaatccatttttaaggtttctctgggggtctccttggccaagaggaggcccattcagtcagctgggaggcttaggattttatttttagtttacagtaggcgaggcatctaagaaggtcttgtagaaaagggttgtggagttttctagggctcagatccctgccccagctggtgacatgcatgacagagcctcagtctcatggggctgatcacaaaggctgcgggctccatactggcaattctctcccagagctgaagctgctggttcccctgacgtcagtgtgctgtgtttcagtgctcggtgccctgcggcgtgggacagaggacccgtgatgtgaagtgtgtgagcaacattggggatgtggttgacgatgaggaatgcaacatgaagctccggccgaatgacattgagaactgcgacatgggaccctgtgccaagagctggttcctcaccgagtggagcgaaagggtgagtgtgatggcgggcagagcgccggggaccgaggtctgccaggtgcctccaaaaccacacaaagatgagtcactagctcagaatcccaagactgatttctggctctggggggaaaaaaaaggcccagagaggaattatcgtaggctttctatccttatgtgaggactgagggtctccaaaggtgaggagggtgtatgcaaaacttgattgaattctccttagcactccatgtggtcactccataatactaggtgaagtgaatcattacatcccatcgttcatatgtcttgtaagtgcctggtgtctcatagacactcagcaatggcaggcccctctactgctttttgccaactcaaaacatcccacaccccgttccctccccagtagcctggcctcccatgggaagtctcaggtgtcaaagaataactcaaaggcatatatagtcaaccattagcccaccagttacctggatataagggaaaacagtcatatattaaattcatccatcaaaggcaaaaggaggatttatatgaaaaggggtttctgcagatggagtgatgttggttacacaacagcatgaatgcacctaatgccctggaggtgtgggcttaaaagtggttacgatggtcaatttcatgctatgtgtattctaccacaatcaaaaatgaagtttgagaaaagacactaaacaaattgtagaacataccttgggacagggagaagaaaagaggaaggagataaggaattgtgcttcctttcctggtgggatcggcgcattggcgggcatgggatggccagtcagagggtttgcccagggcagctgcacagctgtgagaggcaccaagtccagattctggattctctaggagatctagggagtttacctgggatgaggacatgattggctatctctgaccttggttagcggcctacctctcggatacactagttctgccccacttcccttgctagaatcccgtgcgtacacgttacctgtgaaccgcattaaagtgtaggtctgaggcagcaggtgtggggaggagccagggattctacatttattttctttcttttttttaatatttttatatttttaaatttttatttatttatttatttatttatttatttatttattttgagaccgggtctcattctattgcccgggctggagtgcagtggtgcaatctcagctcactgcagcctcgacctgctgggatcaagcaatcctcctgcctcagcaccccctgcccccctcccgccaacgtaggtgggactataggtgcgcgccaccaccccggctaattttttgtatttgtttgtggtttcaccatgttgcccaagctggtctcaaactcctgggctcaagtgatctgccacctcggcctcccgaagccctggaattgtaggcatgagccactgtgcctggccacagcctacatttctaataggttcccagggtctctgaggccactggtccaaggaccacactctgaataacaaggccataaaaaagacagaggagcccagccatgttcttggatcttaggagacacgatgcagcccatgagcccccaccccgtccccactcccagcatcatgagaacaacaaccatagtatctcagactcaaagaaggaccctttcacgcagtttggggatatcagcagacatgccccatacggccacattggctgactccaactggtcagtgtccattctgaccggtcaatggccaccatgcacctgttattgagtattttgaatatcacccctagaggtgttcacataggttttctctccctctgcggtgtaagatgccccttcattttgtccctctatcaccataacaatccacttccacagggagtgttatccagaaagagaggaaggacaaacctgcaaatgcagccttcactccacctccagagatggtcctggagattcttacctagcggctcatcttcttgtgtgttccccacacctcatggcatatggcccctgccccttaggcccacgatggccccagatggacagcccttggtgcaaatactgagcttccaagatgagcatctgactgtgcccccagtcccaggagcagacactaatttggccatctgggaggctctaaccaaagagaaacagatggagagtaagtgctgatctggccactgactcaagcttctgccctaaagctgagtccaggagagctcatcctagttcttcggtgtatccctattttccaagcctcccatcccaaacattagcgcatggtactgcggaaacagtgggggaaggtgtttgtgagctcagcctccttgccagcatgaggaatcctctgcagtgcccctgacataggtcacagctcttgcccaaaccctttatcagaaattcaccctgtgtccagacaattacatctatttcttgtacagctcaaggtgtcaagaggtctccttttacagttaaccaaagtgtttcttactaagtcccactgtcctttagaaaaggacagccctacagccattggggaaccccttccactttctccaggctaaaaatatctagtttcctcaactaatccttttgtgcttcagtttctgaactcattcgtgttctcagtaaacttgatggatttcctgtatcagcaaatggatgaaaagaatgatgctggactttcatttttatattggaatgattctttttcttaaaaatgttggcttttttctggttaaaaagtaacacagtattgttttaagaatatgagaaatttggaaaagtatgctccaaacctcttcaccaaaagaaaatttgagattaagctatacttcaagttttttcttctcatacatactttacctacatagctttttttcctcatacgtattttaaagatataaatgtatctttatatcataatgtatgtataatttggtcacctcttttcacttaattattataagcataaaatctttaaaacatgatttttattataataagctatagaactatataactgaaacaatctcctatttctaaatgtttgggattttctagtttttatttttatttttatttttatttttatttttgagaccaggtcttgctctgttgcccaggctggactgcagtggcacaatcatggctcactgaagccttgacctcctgggctctagtgatcctccctcctcagcctcctgagtagctgggattacagttataagcctccatacacgggtgatgttttactgtttaaaacagaatattttaaaagacttcagtaagtgttcttgtgcataaatctttatatgcacctcttcttatctctgtaaaatagtgggggcgtggaatcatgttaaattatgggaaaatattatgaatgctttttgaactcttaatacattttagctaattgttctccagaaagattatttcggtgtagtcttccaagcagcaactgagagcgcttttacagtcattttgttgccatgattctttagtttgtaaattccatgtctctacatttgccactctctgaaaaggcagggggcacagagcacaatacgtacagagaaaaaacaactctgtggggaaaatagctgcagtggttcattcctctgtgtgtctcccacatttatttagaacagtaaaaagctacatgtaaattttccaaagatttccactctacctatttcctctccaataatgacttgcagatttccccttaaagtaattttgctttgcatttcaacataagttcttgccgaatctagcttggcttaaaattataaatagagcaaagaatgagcactttattctattcagggaactctttcgttcgttttggaaaagatgttctaaatcatgcaagttgggtgctatggtgtaagtaaataatttttgccttatctaccctcagaatagatcatgaattctaaatgttcatgcttattttagagtagatgagtgggaagggagtactattgggtttaagaaacgcacattggctttggtatcatctccatgaccatcacttatttcgtatttgaccctgagccagctactgattcaccgagcttcagttttttcaactgtaacattgctgagtaaccgctgcagtaatatatttgaagctatgacctagatgaggttggcacagtgggaaggatttcctgtgggctgcttcattcttcttcagctgcgtgttaccaggggcctttgggccaccagttggtcttagaaaaggttcagcccctggaatgaccagcggatggcagtcttccacttttgaatagttgctttgtgtagaaaatggcctcgttaagctttagtctgaactatgaaattttttattactgggaataaacacgtgttgagcacctgttacatgccagtcatgaacgagacacagcttccgactcaataagctcaagagggagagaccaaagaaaattaaagttcgcaaacacttaagagtacagagtgtgtcttattgcccaatttaaaattaattaatctttacctaagtgaattgaggttgtaaccccagtctgaatcttctgttaaacttctagggacacaaagtttcttctggcttaatgactcaccttaaaaacatcttttcagctgcttgtacttgagagtgggccttatcagaagtaagcatcgttgacttttcagttctacaaatcaatgataggtttaagcccatgtgcaatttttaatcacaacaggaaaaaaacacttttagaaagtccaccagccttagtttggtaacacctaatttctaagaaagttttccaggaaaaaaatactgaatcatttaaattataagaaatgatgcataaagctgaagttcaagaatagtcattacagccttatagtcccttaggggccagttgggccaagtttaggatttaactgttgctggaatgagaaggcagtccccaccagagggttgcttaggaattccatgtgtttctgtgttttatcagcccagaagttcaattacgagtcatgtcctcttctgactagcaaagcagatttggtccttttaggaacatcctttaaggacagtgggtgggtgtggtttggagcctcacctggaaggttagtccccactccctggtagggacttctccttccccttgcttctgctgacaggcttcctggaccaggtcgtgagtggggagctcctttcatgtttacacttgttgggcttttcactgaaggtgttgtaataaaatgaaactcctctacaggcctcatccatgtgatgtcctcccattgggcactggcatggtccttcatattcttcttttaaattaggtatatggggatgtgaagacactttcccaaatgtatgtgcattacttggttttgaaagcagaaaattaagttagctagtcagatggaaattacttggaaacaagtagcctaagggttggaaacatgaagataactgaaattctgtttaccttttattcttttttttttttttttttttgagatggagtctcactctgtcacccaggctagagtacagtggcatgatttcggcttactgcatcactgcaacctccacctcccgggttcaagcgattcttctgtttcagcctcccaagtagctggaattacaggtgcacaccatcatgcccagttaatttttgtatttttagtagagatggggtttcactatgttggccaggctggtctcaaactcctgacctcaggtgatccacctgcctcagcctccgaaagtgctgggattacaggtgtgagccaccacacctggcctacattgtattctttacaagagtatttaaatgtcttgagttttaaagttaggaagaaaaccagatcatacatggctgaaacaaacaaacaaacaaacaaacaaacaaatcctttagcctagaatattccaattattgtaacaaattttaagctaaaggactgagtcattgtcccagatttctaatagcaatctagcaaaatagcaaaggacatgaaatatgcaaatagcaaaatagcaaaggacatgaaaaatgtctgcaaacctgtaggggaggaaaaatgtttcctctgcattcttaggttctctggctgcagtctgtgaattaagctgacaaaagattaacagataaaaagcataccaattttgtttgatgttaatatttttgtagtggcatggggggcttcataggaaagaagtgacaaccccagagaagcagttagacttgagggattatataccattttaacaaagggtgataaactatggagaagtgattagacaaaggaaaggggctggggcttctagggacagtaaattgtgagaaattgactaagaaaaatatgggggaaattgacagaagataagggtccttttattaaagtttatttgtgcagacttgtcttggagtcaactccccatctccagtgataagaatcttctcttcttcctagcactgggagggcacccttctcatgggaaatttatgccctggttttaggcagaaatggggaaggcagagagctcttcctgcatctgctatttctcaatagccttcagctcaaaataatcaacatgccaaagcaacatattttggggtggcatgttctgatccccttcaagccctttgctccagagggagtttcttccctaaggggtcaagcccagcttagcagtggaaaggtaaatgtttgatcgctcatgctggcatgtgattttacaagactagatgtcagcatacaaaaatgaaagtggaaattttgataaggaaatgaggttgtaaggattgtttttcccttttctcaatttttatttaaattctattgctttattttctaaaataatacgggtagaactcaaacattgactctatttttaagaaaagacccagaaacccttagaaagggctttggtcatgtgctaaagggccacgtctaggattagaaagtgctaatagataagagaaatgaacaaggcagggcccaagtctatatgcaactgatattcatggatttactcatgaataagacactgacctgagaaagaattagagatgattcgttagttcctgctctcaccaagcctgcttcagcaaagacaaaaaaaaaaaaaaaaaaaaaaaaaaagacaggacacaaataaccataatacaaaggcaggaagcagcacatagagtgccatgagaattccaaggcttgaaagaacatcttaaattggacactcaagatagtcttcacagaggacagaggagaaggtatttgaggtgagccttaaaggcttctgatctgtccagtgaagggaaagagcattctgggtggagggaatgacaggggcaagggctctgtgagccttttatgtgatcagggaataatagccactctgagtctgtccagaaggaggtatgggggataggataataggaaattagtctagaagaattgggtcaattggggccatattatagaaaacccttaatgctagaagtccatatgtgacttctgttaggaatgggataacttcagagggaatttttagcatggagttctcaacacctggcagcccaatgcattggaaaagctggtgaggttgagcaagaagctacagccacagtccagggtaagaaagtaaactgtgctgggaaccatggatggaaaggggcaagacaggttagagaaatgtggcagaactagagtctgtgagacctaatgattgtctagatgttggaagcaagagggtaggagaatagtcaacttttaaatccaggtagaaacttgaaagcaaatcagaaaaataaaaggaggaatggtaacggtggtgaaggtgtacatgctggattcaaggtatctgtaggacacccagataaggacgccccaaaaatgtttgaaaagataaagtttaggtgtggtggcacacacctgtaatcccagcactttgggaggccgaggcaggcggatctcttgcgctcaggagtttgagaccagcctgggcaacatggcaaaatcccgtctctacaaaaaaatacaaaaattagctggacatggtcgtgagcacctggagctactcaggaggctgaggtgggaggatcacttgaccccaagaggttgaagctgcagtgagctgagatcacgccacctgggtgatgcaatcctatctgggtgacaaagcgagaacctgtctcgaaaaaaagaaaagacacgataagatgagaaccaaaataagggcacattccaacgtatggcaagacagatggaaaatgctctatgagctttgggctgtgactcaggaatgttttcactgtatcctaggagaggacagtgtgattgtagtagaaaaatcactaatagatatttggctttaagtgaagattttatccctatgaggcttagtttctctatcttggagtgggaatgtaggggttgaagccccttataccatttactgggcacctcccatctgcaaagcacattatacagtctccatagccctgtcagaaatgtgtttctatgccagttgtctagatgagcatgccaaaggtaggaggggctgggtcacttgctccaggccgcacagctagtgaggatatcaacactgatgtacctggttccaaagccaagctctccctctataccaagctgtctcccaatcccctcatagctgtgaccttcagagactggaacaatttgccttaatatcaggcagcaacattgaggtgacagacttaagtccccctatttttccaacccagacttggctactagcaggtagaaatatgcccaggttttcatgcacccattcttcttcagctgaatatatatatatttttttatttttatttttagagacagggtcttctcactctgttgcccaggctggagtgcagtcgtgcagtcatagctcagtgtagcctcaacctcctgggctcaagcgatcctcccacttcagcctcccaaagctctggtaccacaggcgtgagccacaatacccggccaagctgaatatatttttgaaagcaaaagctgggaaggatagtctaacaagtataagtgtattaattgcagtggcaagattggatatttggaatttggaatgaagcccaacccagaaaatctaagacagagaattgccatactgatatctcataatggagtaggctatgcacgagaagctgccagatatttctaggggaaacagacggcaggaaaatgaagcattccatcctcctttccatcatttgaaagtggcttcagcagctgccagggcctcctgactaatgtgcccttcccctgtctcacagtgctcagcggagtgtggggccggagtgcggacacgctcggtggtgtgcatgaccaaccatgtcagcagcctgcccctggagggctgtgggaacaaccggccggcagaggccaccccatgtgacaacggaccctgcacgggcaaggtggagtggtttgccgggagctggagtcaggtgagtggccagaactgggtatgtctgcctgtgtcaggcaaaaggcagcataccagaggggttaggaaccaggactttgtgtcaggtgtcccagctttgaatcccagcagtgccactgtctatctgtgaccctggagaagctatttatatttctggagcctcagtcagtcaacagtattcattgagcacctacggtgtgctcatctaagtacttgggttacatcagtgagcaacacaaatatctctgccctcagggggcttatggcctagcatgctttcctcatctatacaatgctggcagtgatggtaccttatgaggttatttttagaagaaatgaaattgtgtacataaagtatgtagcacagtgcctgacacaaaataaatggtggctgctgctattattcctgttaataaagccagtttttctgtatttgacagtatcagaagcagaaattttaaaagttggaattgttcattatgaagaataaataatactgaatactttaataattgatgaattacattttccctcactcttccaaaattgaacgtgaaccccactaagaaaatgtggaaatgactgccttggtttgattatcatcagtattggagttcttgagccacttagcatttggctcccagggctggctggttctccaaggactgtttggcttatgatcatgatttacacattatcaagacctctggctccatatagaattttatttcttttaagtagcattaaaaactgaccttggaaaaaaatgcactgccttatccttgtaaattgacacaagcccttgggaaagcaatttggcaataaaagtcaggaaccataaaaatgttcctttgccttaacccagtcaccccactcctggggattcattttaaggaaataattaacaaaagaaaaaaaacagcctttttcaacagagatgttcatgacagcaggatggttacagatattatggcatatcataactcagtaaaatataaggtgacaatgacagcgatcgttaggaagatgtgaaagtgcatgtggtataatggcaagtgagaaatagaatgtgaaaatattcaaaccctatcatctctgccacttcaatgtagagtttttatgcaaaaagcatagggaaatgtttttctattcaaattccctttaatgttttttaaaatatagagaattcagaaagaattcaagtacttccagtgctactctggtgaatatcaaagttagacacatttgctaactgatcccagcttgacttctcatgagttttctggctctaggtgagtgatttaacctctctgagcctgtttcctcatctgaatatgaaggtaatcatatcaacctcttaaggttgttacgaggttttcataagatgctatacataaagagaattacccattgcttgggatatgggaaacacttaataaatattggttcccatctctctatgtttattttttctgccagctatttctatctcattactggtagtaaaatacataggacctaaaccccaaagataattcagcagcgactgtatataggacaccaattataccaaatatccatagatgtgtgaaatcatatcagatcattacagtcacacacgtgaagataagcagtacaatcgaactcatatgtctaccattcttagaagagaagggagcaggattcagggccttttttgcttgtggcttcctattgactttagacctaagcttaaagaaccaagggtggtatgaaccctggcaaagacaacctttatttctgctaagattagaaacaaaggatttgttgccctgttgtccaaaagggtcaagatacaattgaatgtggccaagggttttggttctggatttataaggatgtcagggcctgctggaaattccctgccctaggaatttgacattatccccaaagaaaatgaaataagagcatgcttatttcttgaaaggtaagttttaaacattaactggcttcagaatataaaaataaatgttccttctcaccatatgggttgaatgaaagttggtatttcgaataccccaccagcctggtcacagtgattagtccaggagtagacatgtgatccaacaggtggatgtgtgacccaagctgagccacagaatccttcccaaggacatttcatttgtgttttagggaagagactcactaagaggttgtgagctcaagggctggcagtggccctactgaggcttgtgcaaaaagccagtctgagagaatgagacctaagtccatggagaggcagagaccaaggagtttctggctttagagtctttctgactccaccaagaaaggaatatattccatttctgctgcttcccagatccctggaaactaactaggagtatatcaagcttagggagtctttttctactctggaggcacagtagcccaactcttactcatgagagtctaccaagtctattatttatgcccagaattatttcctttcttctctatcaattctgagtttactgcaaccttagattgtcttagttccggggagatctgtcacagtctctagtcttcaggagcagccattttgtctgcctctgggtctggattgcattttattgattgcatttattgcaatagatatatttattctcatctcttcgcgaatcagtgatccacaaaagtgcaactgcaggaattctttaggtacagaaacatgcctaattgccatcacttctcactgaaagcatttatccctattaaatattactttttctcatgtgtgcttttctctgtggattacattttatctactatttgaattactccatcttgtttcttattgttgattttcacctgatgtatcttcatcaatttcttaattttcaaacgttctatgtatttttaaggtatgtctttcaggactatttttgtctttatttttacccaatctataaacctctgtattttaagagttaaattttaaccatttatatttattgtaatcacttatatgtttggacttttccctaccatcttattttgtgttttctattttcatgctttcttgcttctttcctctttcctttcaacatgcttgttattagtcaggttttcttaattccattttttcccctccaacattttggaagttataaatcttctagtggtatttcttctgtgataagattcaaatttttagcacagaattttaaacttttatgtctccattagtgtcaagttatcagtgaccacatcctctcctaaaagaaaatagaagccttccccttttatttacctccactctctcaatctacaatatctccaaaaagatgttgatattatctggatctagctccagattaatgttaattttatagaaaatatagatttaaattttaaaatagttttctgctttccccccaaagatttttttattgaaatataattcacgtaccataaaatttaccctttaaaaatatagaattcattggtttttagtaaattcacaaagttgtacaaccatattcagcattatccaattccagcacatttttatcattccaaaaagacacctggcatccattagtaataacggcttttattggtgtctttgccagctccttcttttatgtcctgtgtcttcttcctggttcttttttattttgctaaagactataacccaggaagtctttcaaataggatttgtaagtggtaaggtttctgagcccttgaatacctgaaaatgacttcattttgcactttgacacgaatgcttctggcagatgactcactgcttcctcttccttggcacagtcaggccagcccggctgctcttggccagtaactcagctgatcactcattgtcctgaggcctccatcctgatctccatgtccaccaccaatatagcctgaagcacatgagttttgctagagctcctcctctgtgtgcatttggactatagtttccttcttcaatttgatctcatctgtctttcattgttcaaagattccccataatttctggtccatcaaggctgattgccctttcttgtcttcaaatgctgtctcatgcgcgtgtgcaaacacacacacacacacacacacacacacagagatagagatacacacacatgaacacattcattcactttccagacgcacatattctgccatttctgagcatttacagtaagagaaggctgagacgggctcattctccctgaagtacacaatctcttcaaggacttgccaaaaatagcagaagataactacaagttttgatcaaagtttgcagtcttctgttctgccacacacttagtacagatgtaggatctcatagcattgaggggtctttcagattatgttttcaaacccctcactttctcttttcagataagaccacagcgacctgggaaagtgcaacgtcttagccaaagacacagaactatttagcgacactgtctagactctagtttccatgtctcctgacttcagtctagtgttccacccctgccgcccacccctgccccatcctcattcctcctgcaggagaggccagacctttgcctgctgcagcttgtggctcttctcctgccttcagttcttccattgcctgcagcacttgaaagaaaaggacaagacacgaatacactccaaatcataaactaacatggaagaaaataggagaaacagagtgggaaatcttatagtttttttttggctgggcacagtggctcacgcctataatcccagcactttgggaggccaaggcaggcagatcacttgaggtgtcaggagtttgagaccaccctggccaatatgacaaaaccccatctctactaaaaatacaaaaattagccaagcataggggctcacacctgtagtcccaactacttaggaggctgaggtaggagaattgcttgaacctgggaggcagaggttgcagtgagccgagattgcaccactgcactctagcctgggcaacagagcaagactccatctcaaaaaaaaaatttttttttagtaaaaaaatcccgtagttttttaatgctacgaagatggcaaaaaagaagacatagacaaagcagaaactgatggcctctgctatttcatgccctgtgtgactacttcatcatttgttggtttgggggttttataattttttttttctgtagatgcgtgtttttctttctctctatttttatttgattgtgtggctgcctatggacagcaaagctaatatttagagtttgaactgcagacattgttgcaggcttcttataaaggtagtcgattctttaaagtctataataaagtacatagaccacagctttacaactttaaatcaaaaagtattaagaggctgggcacagtggctcacgcctgtaatcccagaacgatgggaggccgaggcaggaggattggttgaggccaggagttcaagaccagcctgggcaatataatgagaccctgtctctaaaaacaaatttttttttttttaaacagagtcttgctcgtcacccaggctggagtgcagtggcacgatcttggctcactgcaacctctacctcccaggttccagtgattatcttgcctcagcctcctgaccccaggcgatttgctcaccttggcctcccaaagtgctaggattataggagtgagccaccgcgcctggcccccgtctctaaaaaaaattgttttaattagtcgggcaaggcctggcatggtggctcatgcctgtaatcccagcactttgagaggccgaggcaggcagatcatttgggttcaggagttcaagaccagcctgggcaacatggcaaaaccccatctctacaaaaaaatacaaaaattagccaggtgtggtgacatatgcctgtaattcccagctactctggaggctgaggtgggatgatcacttgagtctggggagtggaggttgcagtgagccaagatcactccgctgcactccagcctgggtgacagagtgagatcctgcctcaaaaaaaaaataaataaataaaagaacgaatgaaccaggcaaggcagtgcacacctgtggtcccagctactctggaggctgaggtgagaggaccacttgagctcaggaggttgaggccgcagtgagccatgatcacaccactacactccagcctgggtgacagagtgagaccttgtctcaaaaacaaggaaaaatattgagtaaaccaaacatgaacaaaaaacattttgcaaagtaatagatactaaatgggatgatttatcagcaaacagttgtatgcattttatttccataaactaatgaaatgaaccaacatatgtaattgcctggcttctttgtggggtcactaccccatggtgcagatttcagcaccacattaggaaacaagaagattgggctctgtagtcacagttcccgctggctgccctgttggaaggggagggttgaccatagggtacattttcccaagtcttaggtcttctcctcagctttgggtgttcacaggtgtgcagagtgtaggagttcattcagtcacagtatccacctcctaagagaataacagataagaatgtcagttcattgtcttgcctcctgtgagaggtgccagagtctatgggacagagacaaccaaatgacctggctggtgtgttcctgcaggagagtttatggtaaactgtttccctctcagcacagaagacaacaagatcttagtgactagcatcctccaggtatgacaatcagggcacctagtctgcatttggagacagaactgttaggaaactgcattccatatgccatttctcctccagaaacatttccaagttctcctgggttcttcctcctagaattggtggtagaattgacggtgcccgtcataagcatcccttgatggacagtagctgccaccccctttccatcatgtgacactcatctttttctgcttctttctgcagtgttccatcgagtgtgggagcgggacgcaacagagggaggtgatttgtgttagaaagaatgcagacacctttgaagtgttggacccctctgaatgttctttcctggagaaaccccccagccagcaatcctgccacctcaagccttgcggagccaaatggtttagcaccgaatggagcatggtaagtcatggtgctcttgatggaggttgcattggcacaacgtcccccacctgaactcctatagacccctctgggccaggcactgggttcagccctgaaagagattccctacagcaatctaccttaggtggtagctgctggagtaccccgtgactcagcctgcttcgtggggaaggcctgagacctagatgatcttgctttctaaactgtagaaacagtgactctcacacttcagtgtgcataggaatcatctgaggatcttgtttgacaagaccaactctgggccaactgtggccgaggatttgcatttttagcaagttcctgaggtgtgttggatggagttgtctttgtactgcattttgagcaatgctgccatagaggattgaggattcaagggtgctgttaaaagaactacatctgatgccaggcgtggtggttgacacctgtaatcccaatactttgggaggccaaggtgggaagatcacttgaggctaggagtttgacaccagccaggtcaactagcaagaacccatctctgaaaaacattttttttaattactacattacacaaacacacacgcacacactctctgtgtgtgtgtgtgtgtgtgtgtgtgtgtgtacactttttaaaaatcctatagacattctggattatggattgtgggactgattctgttttctgtttgaactggctactaggaagcgcaaagccaaaattatgcctcacctagtataccagatcctgcaaagtggattttatgtgctaatattcctgtggcttctctttctttttcctacttttatcttcctttagtactagttttctcacttttttaaaatcttgtggccctctaagtctttctcaagtcatttcaaatcctttttgtaaggagggaaatagtgtgtaaatgaagaaagagagagattgataaatacagaaataagttattaagaaatgaaaggggaaaggatggatatagtgataagattcatttttttcaagttgaagagttcattttcaagaaacttcctaaaacagaaaacctcctcaccatcattccaggtgaccagaaaacctcctgagggccccatcccaggtgaccattggcgtagttctgtgggttggggtgggaagtggaggaagggtcattctgcttctcatcactgaagatcttcaagcagaggctgtagtgagcccagagtaggggggccagagcctttctcacagtgatccaagggtgataaaagggaattttgcttagaaaatatatgaataaaagctgagaattccatttccaaaaagtgtctgtctgctctagtgataacagccatttggctgtgtagcaaaccacatctcagaggtagatgggaatgaaggaggtgggttgaaaggtttctggcaacttctgggaagtggaatttaattattttgatgttgaccaaggcttgaggatacaataacagatcgcagttttcttttgtcatctgatttggagagtctacaaagagccatgctcaccaggccaagttgaaggagacaaacttcaaaaacaccccaaatgtccgtcagcaggtgaacggacaaaccatggtgcatccacacagcggaacaaaaaactcagccacaaaaatatggatgaacttccggtgcgttttgctaagtaaaaaaaaaagccaggttcaaaaaactacgtgttgtatgagtccatctatataatattctgtaaaaggagcagctacaaacgccaaatcagtgcctgctggaggatggggtgaccacatctgtgcaatctgaccgtagaggggcagcatgggaattttttgtctgcaatgaaaatatttcgtgtcttgtttgcggtaggagatacacaactgtatgaatttgtcaaaactgatagatgtgtataccacaaaaagggacatttttagatgcaaatttagaaaatatgaagtaaatggttactataatagcaaagactgatggaagctagacttctttgaatgtaccttgttttacaaatttgagtttggaactaagtaaatattttagataatcataaaagaaaattaagttttaaaaaagcaatcccccagaactgaaaatacaatgaaacaaattaatgtaaatatgtttctagttggtggcatcagcactattgcaagtgacttgaatacatagtaatttgacattctatccctaaaaaaaattactgcagaagaatgttcacactgtttgcaattatcctatttttggtgatagtgttgtgctggatatgatgattgggcatataatgtgtgagaaggtaaatgagtaattagatgatagtataattctgttagccccaatatccttgagaagtaggatgttcaaacttaggagaaagtagatacagatacaagatagatattgtatggcttaagtccgcaataaaaagcctgttgtcctgaatttgaattggaagtgtcagtataaacttagaaattatctctctaaaaatcttttctaatttcacccactgaaagagtctagaatcagtgaccaatctcgggattcagagggggtggccgcttccagatctggggcagcatatatgtaagttaggttgggatatctttttctagcaggcagcaaggaagttcttaaacacaacagagctcatgtccaaagcatcccagagccaacttgtagaggctcctgtgagccattgagcatcagtaagaataataataccatagattagatgaaacacattatatgtgtttaaatccatccatttacaatgaagtttataatactttaaaaaactgataagtcatcatcataggatgttagggaaccaacttattattatgaaaacccgtaaatgaagggaaagattcaagtgtttatgctttctttcttaaacgacataccactgggtaaccaaagagtaaaggtgctgagggaatatgatagaattagaattagaattctaaactccctgtaaactgatggatctgagcattgcacatcagtggccactaacatccccaaaagagaggcagccccccggaagtagtctcacaaaaaaaaccaaaaaaaaaccctgcacctgttaaggcctcttttaggtccaacttccaatgttcaggagatatagagcatagaggaacacgaattacaccgtgggagcacagtcagcaaaatccagactatgggcaactgcagaacaaatgactcagttccaccccaccaccgcaaccaaaaactttttaagtgcaagaatgaaaaagacagtggaagggaaacctatggattgaaagagttgtgagagacttattgaccaattgcaacttgcagacctgacgcagatcctgattttttttttttttttttttttttgagacaaagtctcactcttgcccaggctggaatgcagtagcaccatctcggctcactgcaacctctgcctcccaggttcacgccattctcctgcctcagcctcccaagtagctgggactacaggtgcccaccaccatgcacggctaatttttttgtatttttagtagagacggggtttcaccatgttagccaggatggtctcgatcttctgacctcctcagcttctgacctgctctgcccgcctctgcctcccaaagtgctgggattgcagatgtgagccactgcgcccagcaatcctgatttttaaaggaaaaaaaatctgtattaaaaaatcttggctggctgcccggccagccgccccgtccgggagggaggtgggggggtcggccccccgcccggccagccgccccgtccgggagggaggtgggcggggggtcagcccctctgcccggccagccgccccgtccgggaggtgaggggcgcctctgcccggccgcccctactgggaagtgaggagcccctctgcccggccagccgccccgtccgggagggaggtggggggtcagcccccctgcccggccagccgccccgtccgggagggaggtgggggggtcggccccccgcccggccagccgccccgtccgggagggaggtgggggggtcggccccccgcccggccagccgccccgtccgggagggaggtgggcggggggtcagcccctctgcccggccagccgccccgtccgggaggtgaggggcgcctctgcccggccgcccctactgggaagtgaggagcccctctgcccggccaaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggcggcagggtcctctgcctaggaaaaccagagacctttgttcacttgtttatctgctgaccttccctccactattgtcccatgaccctgccaaatccccctctgtgagaaacacccaagaattatcaataaaaaaaataaatttaaaaaaaaaaaaaaaaaaaaagaatggactttcccaggccagctgtggtggctcacgactgtaatcccagcactgtggcaggccaaggcgggcagatcacctgagatcaggagttcaagaccagcctgaccaacacggagaaaccccgtctctactaaaaataaaaaaaattagctgggcgtggtggtgcatgcctgtaatcccagctacttgggaggctgaggcaggagaattgcttgaacccaggaggcagaggttgttgtgagctgagattgcactattgcactccagcctgggcaacaagagggaaactccatcaaaaaaaaaaaaaaaaaaaaggactttctcaaagaaaatgtatttaaatgtctgcaccaataattccagcatgtgtatgaataaatatgatatgtcctttaaaaaaaaaaaaaaaaaaaaaatcttggctgggtgcagtggctcacgcctataatcccagcactttgggaggtcgaggtgggcagatcacctgaagtcaggagcttgagaccagcctaggcaacatggcgaaaccccgtctctactaaaaatacaaaacttagccaggtgtggtggcatgcacctgtaatcccagctactggggaggctgaggcagcagaattgcttgaacctgggaggtggaggttgcagcaagccgagatcacgccactgcactccagcctgggtgacagagcaagactccatctcaaaaaagaaaaaaatctataggattcgcaagataagtggaagtaggaacactgagtctatattgaagagaataagaaattattgtaatttctagggagaataatgatactgtggtaattgttaagagttcttgtcttttagagctacagcctgaagtatatggaagaagtgatcagatgtctagatttgcttcaaaatagtgggaggagcaggagggctggggatatggataggacacacctggcatgagttgctgattgttgaagctggttgataggtacatgggagtttgttttcatattctgtctccttttggaaatgtttgagattttccagtgtcttctttctccagtgtgctgagctattggtctgcccaaaaatctgatgttttccctttgttcccatgcagtgttccaagagctgccagggtggctttcgggtccgggaagtgcggtgtctgtctgatgacatgactctaagtaacctctgtgaccctcagttgaaaccagaagagagagaatcttgtaaccctcaggactgtgtccctgaagttggtaagtagagatttcaatcatgggggaaaggtttgtgttttttaagcttgtcagattctccggtgtgacaataacaagcctcttctaggtctttctgtgaccttgcacacagtcatggagttcagagggttgaggtgcttttggtattataaatttcatggtttaagatgatcattcatagcgaggatggctgtctaagccacccaccaagagacacactttagtgtggattgattaaaatggtaatgccttcaaagatttggctctatcgtccttaaggtcaaagtagtaaaatgtcaacttttaattgtaggtgcaaaccagtgtaggctggaccatgtggggagattctgggaccttagcagggagttggcagagaagggaggaaggggaggaggccaagaattggtagagacagtgatggagggtctgaccatctctcagaggggcgtagtgcaagctgagtccagagagatgcagtgactagactcaaggaggaggagtgacagcaggaagatctaggccacacaatggtcagagtcctgcaaagaacagcagtcttgcaattcagaagaccccaacctgcacccttgaaataggggccagtttcctggaggaaagcattggagagtgttagggaggttaggccctctcatgggctgcggttcatgaggaaggggcccatcccagcaggggagctcaagtacagccagaaaaccaaagaaggcacctcgcacatagattgggcagataggaagtgtgaggtgggtgaagatgcatctccagaggcatattggatgccccaaagcccaacttgaaatctactcagaatgcacccccaggtatagtcaggactggttccagaatggaggtgcaccgagccccttcagtagcttcttcacagtctgctaagaacatatttacttttctgtcttcacaataacatcaaaggaaatgtattaatatatcaataagctttcatggggtagattcctcctgctgtggaccaaattgaaggttttaatatactgacctaacatccttcctatcccagggaagatgtgtcagttacagcatagatgctttatgatcataagtttcctatgtcccagcaatgacccatgactaaagttatggggatgaccattcccagtagctaccaaaaaaacccataaattccataagaagaaaattaacaagtttataagatctatatagaaaaaataaataaaagtaagaaagccttgctatagaatataaagggaaatgtgaatagatagaaacattaacatgttcctgaatgggaacactcaatactataaaggtgataaaagaaggttcccaaggggagccgtatgtgccatatattggaacatattataaagctacagaaactaaaactattaggttggtgcaaaagtaattgtggtttttgccattattttcaaagctgcatttacttttgcacaaacctgatatatgatataggcataccatataccaacgttataatgcagaattctgaaacagactcctttataaaggaaagttaagtttgataaagggggaatgataagtaagtggggagaggagaggcttccattgtattgagaccacactgaagatccctttaaaaatataaaatatataaatgtctaatggattaaagactctaacagagaaaacagtctgtaaaaatgctagaaaaaagtatcttgggctggatgcaatggctcacacctgtaattccagcactttgggaggccaagatgggaggattgcttgagcccagcagttcaagaccagcctgggaaaccccatcttggcaaaaaacgcttaaaaattagctgggcatggtagggcatgcccatggtcccggctaattaggaagctgaggtaggaggatcacttgaactcaagaggtcaaggctgcagtgaggtgcaatcgcaccactgcactccagcctaggagacagagtgagaccatgtctcaaaaaaaaaaaaaaagaaaaagaaaaaagaaaagaaaaaaaagttatacacataaagctgcctgtttgtctcaggccagataatataactaaagacaatcaaaatcaccaggtccttggaattgattgtgtaattctcaaagctaggaatgactggcataagcaaatcaggtactctgaagagctgtcactcagctgcctcactatgtcaaaggcttctagctaatataatataatacaaaatgtgttgccactgtttttgtcttctgtatttgtctatggtatcttttcaagcaggggaaattgtctaacttctaattatataaaatccaactagagaaaaaaagggaaactatgagattaacaaaacagaatatgtagacaaagccttggtattctttgatgtgcctcaaaattatacctgtcaatgccaaagttactaaagatgtccaggccacaagccagagttatgacacacacttcggtatatcccagagggctgctgatagcaagaatctgtgtaggctctgaaggaaaagaaggctcaagtgcacattttgatgatgctgctgaagaagaaaatagtacctgagtacatgggtacatgtgtgctgttgtcagctttttgaaatctgcatataatctttcatttaatcccagagtgacatgattaaatcatcctacaattgatagcatcttaaaatcaaataaatgtcactcaagtagacagaaaattaaatccccaatatagacagaactcactcaattttttaaaaaagacaagtggtccagttttgtaaaggataaaggaaatgaacaaactcaccacagggccgggtgcggtggctcatacctgtagtcccagcacttcgggaggctgaaaccggtggatcacttgggccaggagtttgagaccagcctgggcaacatggtgaaatccttctctacaaaaaatataaaaattagccaggtgtggtggcgcatgcctatagtcccagctacttggaaggctgaggtgggagaatcacctgagcccaggaagtcgaggaagcagtgagccatgatcgcactactgcactccagcctgagtgacagagtgagactctgtctcaaaaaaaaaaaaaaaaactacaagaggctgaagaaatgctcaagctactagtaatcagaaatgcaaattttaaaaataatgggagtccatgtttttccataagattggcaagcttttaaaatattagacaatgtttgttcattgttggcaaccgcatgggggataggtcaagtggcaactcgtaacttggtgtaaactttttgaagagaattttatcaatatctatcaagatacaaagatattattacctttgacttaataatttcacttctaggaatatatactaaaaatatgctttcaaaaatgtacaggggcacacacatgcaaagaatagggctcatcgggtgtgccacctactcaggacgcagaggcaggaggatcacttgagcccaggaacccgaactgtggctgcccctatgaacagtcacggcacctcagcctgagcaacacagaaagaccccatctctgaaaaaaaaaaaaatagggcttaatgaattgtgtagaattaatgaatgaaccgtacaatttcttgtaacttataaaaattggaagcaagctgggcgacgtgactcacacctgtaatcccagcactttgggaggccaaggcaggcggatcatgaggtcaggatattgagaccagcctggctaacacagtgaaaccccatctctactaaaaatacataaaattagccaggcatggtggcacgtgcatgtagtcccagctactcaggaggctgaggcaggagaatcgcttgaacccgggaggcggaggttgcggtgagccgatatcatgccattgcactccagcctgcgcaacaagagcaaaactccatctcaaaaaaaaaaattagaagcaattacatttctataactagaaggaaatgacttatttaattatgttccagcacataggacaaaatacagacaccccaaaaaagaagatggtagatattatgatacaaaaaattatctaaatatatttatgagtaatattttaaaaagcaagcagctgagaagtatattgtcagttctttcccaaagtaatctataaatggaagcaatattaatcaaaatccaggcaaggtttttcatagaaaaatctgacaacctgtgtctaaagtttatgtggtggctcacgcctgtaatctcagcacttcgggaggccaaggcaggcagatcacttgagctggagtgggagaccagcctgggcaacatggtgaaaccctatctctactaaaaatacgaaaaaaattagccaagtgtggcagcatgtgcctgtaatcccagctactcgggaggctgaggcaggagaaaggcttggacccgggaggcagagattgcaatgagctgagatagagccactgtattccagcctgggtgatacagcgagactccgtctcaaaaaaaataaaataaataaaataaaataaatagaagtttatatggaagagcaaaagcaaggaaccaagaagagccaaggctgttttgatgattaaccatgttgagggacttttcctaccacatatcaaggcatcttggcacaaggatggataaaaaaagcaaggagagcagaataggccagaaatacacatataaaggatgtgtgatatatgatggaggtcatattatgaagctgtggggaaaagatgaacaattcaataaatggtcatgagacaattgtttatccatatacaaggaaaaaaacaagaaaactgaactccctcctctcatcctacacataccatacactccacaaaccctaattcctggtggattagtcaaaagaatgtgaaaagaacattttaaaacttttagaagagaacagggaaatttatattttatttcagagtacagaagggttttttaaatgaaaccaacaattccaaaccacaaaggaaaacatattataatatcaattacattaaaattaaaaatctctgtttatcaatcaacaccagaagcaaagtgatcagaaaagccacaggctgaagaagatatttgcagcacatataacctaactcacaaaggatcagatccattagatataaagaattttcgtgaatcattttttaaagttaactaaatcagaaaatgagcaaaagatcagaaaagcaattcacagaaaaggaagcttgaatggcaaatatacatgatatgttcagcctcacgtgggaatcatttcacattcactagctcagcaaaaactaaaacatatggcaaaaagagaattcttctgtttcactgacaggaacataaacagttataccgactttggagagcaaactgactgtatctagcaaagttggatataccttatgacccagcaaggcccaggcagaggatggtaacaaaactacttaaaagcattgtttgcactagaaaaaaaaaattggattaatgtccaacttaaatgtccatcaatagaaaatgattaaattgtggattatatacacaagaaaattcaataatgaaaatatagcattcatcaaatatgaatgaatcgcacaaattcaatgtcgagcaagttgccaaggagcttatacagtatgtatcttttatgtttaaatgtcacagagtggtgagggattccctcacatagagtttaagtgtaaagaaatgtttggggataagaaacgccaaatttggaacttctgattacctctggagtgatgaggatgaaggaggaagtgatcagagagaagtgaggacacagatgagtaacttattctctatacctatttcccttatcgtgtttaaaagaaagagaaaaacctgtgagcccttggcacacattcataccccacaatggtaataaacagcagcgcaggagttaaagccacagccactgccctttctcttcccactggtccaggctgcctcttgtgctcagggagtcttctgttcattctctttcgctacagatgaaaactgcaaggacaagtactacaactgcaacgtggtggtccaggcaagactctgtgtctacaactactacaagaccgcctgctgtgcctcctgcacccgtgtggccaacaggcagacgggcttcctggggagcagataacactcctgcacccccatcagtagggcagcatcactgccttcccgggggcttcagcagtgcgcctggctggctgctgctccaccacgggccccctggcccaggcgctgccaaccaacttagtcaccacccctgcctccggtgaatgcaccccgtggtacccaggggctttttacacaagatgtttgaaagccacagtcagtcctttaagcatcaccatgtactgatgatcccctccttggacctggcatctgctaatggtgccctttgaaagtcaagcagtgggaagtacatggagctctcagccctgctcccatctggcaccttcaagtcagcagatgggccactgactgagcactgccccgtccctggtgctactggtctttctaaacttagcaccctggagagtccaaggaggcagcgcccccaacccagcgccccactaagccttgctgacacgcgtgcatccctctgtgacctcagcccagatgtgcctgttttcattctcaaagacattagactgttttcctgccctatgacacagatagctcacatgaatattgtgctttatttagcaggtgtactcacagatactagctccttagcagctcacaacatcccagaatgggaggcagggggtgactcattatccccattttactgacagggaaactgaggctcaacttaagtaattgacctgccaggtatattcacccatccagtggaagagctgagtccccgccccagtcatctaccagtatccagcctggggcctgtacttagatgtgaaaggtgctgcttcatttctgaccaagagactgagaagtttcccagaatgcaaacaaagcccaggcccctgaaatctttccggtcaagcctttatcccagcactcagttgttttggatgtctgttcctacttgcccttacccccaaagttacagatcctagttacaggactctgccagctttgttaaactgtccgtgagacaagaaagccattggggaaaccaggtgattgcctgaaattcttactccgttccaagtgctgttcctcccaggaaatcaaaggccagggtccttatggccgtggagccttcccgaccacagagccaacttgtgaagcacacagctctgcagcctgggctctgccctgcctcagccgcctcccccacgctcttcaccacgttcctggagagtccggccaacctgtcccagccgaaacactgctgtattagaaaaagtctctttctggtctttctggttttgtttatgaatttccctctgtggccacaaattcctcccctcccccatgactcacagtccatatggcccacccccagacttgagcaccaagctctgcattaatgcagttggcctgcgacaaggagctgtggacccttccccatctcttccaattcactttccccaactatccagttccagaggccgcaggcctggaaggatgcagtgcatattgaaaggtggaccctctgaaaacagttaagaggaatatatgtatgttttacccattaagaaaaaatggcaagctaaacaaatgttaaacttacagaaaatttgtcttatggtcctgagcatatttcccttttagagcaagcctggattcttagcaaagtgtttcccccatttgctcttttagctgacaaatctgccactgtgatgatggtttgcagcttttggaagcagtatggcaacctggcctgacatgctctttaggcttccactaacctggggctttcagaaattctatttggcctttctgtgggtagctttccagcttctcttctagggagccccaggcatcatttcccaaaagcatccccatctcctgattctcttggaactcctacagataagcatcctggcagaggcccaggctcccaaaccgacaaagtgaaaagagaccagagaggccaagcatattgactggtgctgttcagggcctgctcttttccactcaccacttgttttgctgcttgtcacgaggagagttgttcctgtatgtggctgctctcagatctttccaagcaagccagtcatttgaagaggttttcttttcatgctggagggcaggctaagatcaatgagtggaagagagaaaggctgttttagctcaagttaaaggaacaccttctagccatcaaagccgcccaacagaggcaagggccaccacacatgagagagcgctctgtccttaaagggaattctctgttgagtgggaggtgaacaccctggttcttccaactcaggaattctcgtggctgggctgggtcagtgatggctttgtctctttatgtctaaagtgccctatggctgctgaaggttacctaaccattctttaaaaggagaatgaccctccatgggaatggccagcctgccaactgtgcaattgaagaagacccgatggatcaaccccatgtctcccttggggagaaagtgcataaaccaggggtctctttttttttttcaacaaaccattgagctgttcttggagttcatctctggagaggttatacattattagaagtttgattattattatagtttgatcaatttatttgtcttagagatccaatttttactaattccctagttttttatttcagcatctgaatgtctttctccctagcacagtgcatacaatcagggccttgggtatttccagtgataactttccttggagaggatctaagaaaagcccagatttcggtagccatctccctccaaatatgtctctttctgctttcttagtgcccattatttccccctctcctttcttctgtcactgccatctccttcttggtcttcccattgttctttaactggccgtaatgtggaattgatatttacattttgatacggtttttttcttggcctgtgtacgggattgcctcatttcctgctctgaattttaaaattagatattaaagctgtcatatggtttcctcacaaaagtcaacaaagtccaaacaaaaatagtttgccgttttactttcatccattgaaaaaggaaattgtgcctcttgcagcctaggcaaaggacatttagtactatcgattctttccaccctcacgatgacttgcggttctctctgtagaaaagggatggcctaagaaatacaactaaaaaaacaaacaaaaacaccaaaagaaaaaaaaaagccatttaaagccagccactagagggagtcagttcagttccgtaaaggtatgctcagtgcccgctgcctgcaagctgttggggaccccagggagggcaaggcagcctgtccccgcccccagggaactagaacatgacaagaattctccgcactgtgcctacctgtccctttaccttacctctctggcccagagttcttggagggttttttctttattttcttatgtactcatctacttattctcaaagtatttagcattcaacactctttttgctttaaaaagaatggccttacaaagggacagaaaagagaagacacgagcttggtgtattttcatcaagttatgtggcagagaaatccagatattaccaggacctgtctaaacaaatgttgtgggttttcttttcattcggatagccactttatagttggaatatcaattctaatgaggaggaagacataaatataagtggtaaaaagaaacatgacttcccttaaaacaggctggataatctatatcagccttgtgggtggagactagtatttgatccttgccatataaaacattttaatatggtttacatgggaaaatatcgatggcttcctcacaaaatgtatgggtgacgtgaagttgaagagccaatggcttgggtgacacgtgctggatccaaaaagatcagggagactagaataaaacttggatgttaaaaattcaccaggaatccacataaagtactatatttgggctaaaatgaaaaactaaatacaaggtgggagagaggcaagaatttcagttgactaagctcagtgtgagtcaaagtgggatggaaccatgcaaaaacaaaacccacagacatgcaggctacgtgaggagaaaacagtggtgaggatcacatcacattgtgtttgcatttgccggaaccatactttaagaagaaaaccgatcatctataataacatcagtttatcaatgccccgtcctgatgaagtgtgcagactctcagaaacagcaggaaggacttcatgagaaccctcaggctggagaaggcactagggcacaaggagagctctcctaggaccaggaccaagaagctacaggcaggcacagtttagctcctgcagagacccagcttttcacaagttggagccttccagagatagagggactgtggtaggtggtgacccacccatcactggaggtggaagcagaggccgtttgccagggatgctggagaggggattcaagcatctggctgggcaacgtgatgctcagggccgtctccactcagggcttaggggagtctgtgagtagaagagctttaggtgatttgtttggtgggggaaggcaagtacacagctatgcactttccgtttctgacttttgccaccctgtcagccatggggagcccactgtgggactgaaaccctgagctgaatgcggcctcatgtctcagagaaacactggcaagttggtcagagccgccgtctgcatcgaggcgtagctgagcggcaggatggggggctgcctgcccagggtctctcaccgtggtgtaagcagagccatggcttgcctaggaccctatagataccatcactctttctcagctcgactggagtttctgcacctttgcaggggcaaagtaactccctgcaccctgaaccaccccccattcctgttcatttcagcagataatgatggagggggggggtgtccatcgtgctgagggtgtgaccgcaagagggtgaaaacttccagccaactttctcagtcctttctcttgcgagagggaagccacctgctatacaaactaataccccctgccttgaccccttccccacgactcagttgacagaaggatatactttgttataacttattattttgttctctgtaaatacaagatgtttataggaaatatgtattctgaactctatctgcagaatgagtcactacaccaaaatagttctattatttagaatgtgttaattttaaagggacctgataggtatttatttacatatgcgatccacatttgtgtgaaagcatgtgatcatactaacccagcctcctggaatgtcgctgtacgatgattgatgtctttttctcagtccatagttacaattgtttagtatgctaatcagtccagttccctgaggtttaagatcaaatataaattactctgcttttcgactcattcaggtagcattgtacctgaacctgattgctactttttcatcttaaatattatatttcctcatctaatctgccttcccctcatccacagacatttggagaaggaaatgggagggtgtctgttatccctttctctttgctttgtccccgttgttagactggcagcgtcagttgctcggtgggcttggttagagccgtgggtgaggcaggtggctggcggggacagggagaggctgagagggaagtggtggcatttactgctctgacacttccactgtccctgctggggatgctggggccaaggcctgtggggcctgtgaactgcacagccaggagcaaggaacccactaaatactccgtcacctccatgtcccctctacagtgttaaattattacataagcaggtgaaaggtagaaggcgaattatgtgagtaaatatggtctgttttctcttcagcaaaaatgactatttttgtgtgtgactaatttatttttattattgtaaagatacaataaaccggttgaaatatctgctttgttgacaagcgtgtgctttctctggccttattcgcgttctgttctcctgcaaatagcgccctctaaaaagaagagtcagacaataaactggttgaaatatctgctttgttgacaagcgtgtgctttctctggccttattcacgttctgttctcctacaaatagccccctctaaaaataaaactcagacccttgagaggtcagccgcttgtagacgttggctttgggtgcttgaggtggagccgggccagttagagaatgagacacgccttagaaagaacatgagcccacccgtcctatgttaggctgcattagactcacctgagaagcttaaagtgaagtcgtcaggcgtgtgcaccgcgcccaggatgcaatctcacatgaatttctttatgtctcccccagggaattgtgcagaataggttggcagccactctgctggtttggtggggctccatctctaacttgaattaatcttcctccagctccctctagctgacttcacttggggcttgattttagcaaagtgttcgacaaaatctttcaggcgatcttggtgcaaaataaagtgaaacgcgactaagatggtgatgccagttgaagcccaccctggcctagagagcagtctctagcgaagcctgcaagctctgctacggactccgtcctggacagcatgtcgtcaataactcagaaaccagctctatgcctaaaatgctatcgcccacccttcccatccacctttttgcctggaaaaacctccattctttttttattgtggtaaaatccactttacataaaattcactattttaacttttttttttttttttttttttgacagagtctcactctgtagcccaagctggagtgcagtggcgtgatcttggctcactgcaacctctgcccccggggctcaagcgattctggtgcctcagcctcccaagtagctgggactacaggtgtgccccaccatgcccagctaatgttttgtattttagtagagacagggtttcaccatgttacccggggtggtctcaaattcctgagctcaagcaacccgcccccgtcagcctcccaaagtgctgggattacaggcgtgagccactgcgcctggcctccattttaaccatttccaaacgtacaactcactagtatttaaagcaaccacagtgttgggcaaccatcaccccaaaattccatttattcttcaacagttcaatacaggagtccaccaggcgccggccactctgctgagcacacttacatgagctcatttcgtcttcacagcaaacctatgaagttcaaatattgtttcctcctacagatgagaatattgagactaggagaggtttggtaccccagctgatacttggtggtgctaggatgccacagtcctcttcccctagaggctgaggcttgtctctttgccgcctccatctccccggggcctggcatgttatatggttccagcctatactagttccaacctctttctccacatcagtttcagtcactgggcaacaattgcacaaggactggttgaaaaagtccagcgctgcccatcctacccgggctcagtgtgaccaatgtgatctgaggcggcttctggaggagtgcaccccccaccagggggaggcagtgagcctgctctgcgcaaggggcagacccaggctgggaccctctgcctccagttccggggaccacatgtcataaggtttattgactgtctggaaaaagcccagaggatggtaggatggtgaccaggatggaggggttctggaaggagggctgtcttcaaccttcagacaatttaaagtactgtcagggacagatgacaagaacccggactcctccagcagaccagggcagggatgtgactgggagtcagacttggttcaaaatgagacgtttccagtaatcagagaggctgaacaatgggaaaagacactttaagagacagggccaggggcagtggctcatgcctgtaatcccagcactttgggaggccgaggtgggcagatcactcagaagttcgaaagtagcctcagcaacatggcaaaactccatctctacaaaaatacaaatacttagctgggtgtggtggtgcacacctgtaatcccagctactcagcaggcagaggtgggaggatcacttgagcctgggtggcagaggttacagtgagccgagatcgagccactgctgtccagcctgggtgacagagtgagatcctgtctcaaaaaaaaaagagagagagtgagtgagacccccaaaaaagtgatcaggaacattttaggagagggaaaatttgaatatgggctgtatttaagatgacatcattggccggacacagtggctcacgcctgtaatcccagcactttgggaggccaaggtgggtggattgcttgagcccaggagttcgagaccagcctgggcaacatggcaaaaccctgtctctactaaaaacacaaaaattagctggacctggtggcggacacctgtaatcccagctactctggaggctgaggcacgagaatcacttgaacctgggaggtggaggttgcagtgagcccagatcatgccactacactccagcctgggcgacaaaacaagactctgtctcaaaaaagaaaaaaaaatgacattgttgaatctgtgtaaagcttcttggacgtgaggatggtgtttggccaaacaggagtacatgttcctccagtacttagccaggaaggtcatgatctgctgtttaccttctaatgggtcactaaaagtgtgtgcgtgtgtgtgtgcacacacatgcacatgtgtgtatggagaaagcatgcacacagataaggtaagatgtattttggtgaatattagtgaagggtatgtggtgtccattacactacttctctgaggtttgaaatttcctaaaatagaaagttgtgggtggcagaaataaagtacaaaaaggggatggggagaaagagaactaacttttttcgctgtgtttttcagatttacctaataagaattaactggggtgctcattcaaccttgaaggtaagcaaggtaaattatgtgcacaaacaaatgtttttaattgtttgaatttttttcaatgaatcatttatcaattatggtttaagaagaatggctagctgagcatggtagctcatacccataaagaatcccagcactttaggaggctgaagggggaggatcacttgagcccaggagcttgagaccagcctgggcaacatagtgagaccctatatctaaaaaaaatgaaataacaattagccaggcgaagtggtgcattcctgtagccccagctactcaggaggcagttcaaggctgcagtgagctctgattgcaccactgcactccaggctgtgtgacaaagcaagaccctgtagaagaagatgaggaaaggaggaaaggaagaaaagaaggagaaggagaagaaagatgaaagaaagaagaaggaggaggggaggaggagggggggaggagggagaggaggggcaggaagaggggaggaggaggaggggaggagggtgaggaggacggacaggaggaggaggaaggggaggaggagtagggaaggaggaggcgggacgaagaggaggagaagaggaggaggaatggtcaatacttagtagactcaagtgcaatttaataaggcgccttacatcactttatcgggaacagttgccttggtctctctgaccaagaaaagagagagaagcgggtttacaaagtgctaggaaagaagacacaatattagaatgggttaacgaagcaaagaacaagccttccaaaagtggacagtggagccagtggagaggaggggaggtcccaggagaggggacaggaatctgtgtggtgatccttgccctcatcaaggctggggaaccctgactgggtgagcaccactcgatgtcaggtatcgtccgagtctctacagcacttagttttcatcttcgcaacaactcatgaagcaagcactcttgtgcggccattttatggacaaataaattgaggcccaaagagaataagtaatgtgaccaagctattaagtgggacagtctggcttaggtcttccttatgcctcactgtctaatgaaatcaactggaacttcttttaaaagtgatatgggggccctactcccagatattttgatcttcagttgattgagggtggggaccaggcatcgatgttttgaaacctctccagggaattctagctaaggctgaaaacactgagaagagtatgtcccactctgatgtgcatatgaattgcctggggatgttgttgaatttcggattctgatacagttagtctggggtggggactgagttctaacatgctcccaggtgatgctgatgctgctggtccaaggaccgcactgaaaagtgaggcacctcacccttcagaatgctgaggggtttcctatattcaccgggaagatgagcaggtgacctctgagtcatttgctttctttataaaacagtcttctatgaagtctagatgctaggtctgaatctactagttcaccttttggccaatgacgcttagggactctgaagtggttttaagcctctgtgctcctgcataggtgatttatttgtttttactagataattggtgtatttaggcactcagctgtccacacaaaagagaaaccttgactgcactgacttggggacttgtttttgttggtgggttttttgtttgtttgttttttgagacagagtctcactctgtcacccaggctggagtgcagtggcgcgatcttggctcaatgcaacctctgcctcccaggttcaagcgattcttgtgcctcagcctcccaagtagctgagattacaggtgcatgccaccatacccagttaatttttgtatttttagtagagacggagtttcaccatgttggccaggctggtcttgaactcctagcttcaggtgatctgcccgcctcggcctcccaaagtgctgagattacaggcgtgagccaccgcacctggccgggaagtccttctactaaaaatgcaaaacttagccaggcatggtggcatgcccctgtaatcccagctagtcgggaggctgaggtaggagaattgcatgaacccaggaggcagagactgcagtgagccaatattgcaccactgcactccagcctgggcgacagagcaagacctcatctcaaaatataaaaaaagaagttcagagggaggcagttgttggattaggtctgcaactcaacagcttcagggccagcttctctgcagctctcttggcctcttcttcatggttgcaagccagcttctcctgctccacctatcatgtccatcttcagggaagaaagcaggaagggccattgcagctgtgtatctccatttgccaataaaccaaatacattcccagagccccatcctacgtcccacaaacttctatttacatcttattggccaaagtgggctccatggccatttgtggctgcagaggaagctgggaagacagagaagggattgttatgcttggctgtgaccaattggggttccattagcagagaagaaagacaggaaggatgtgggtgagacaacctgggatgtctgattattgcacccttaccaagcaaaagcttctaggaagggacaacaaaagttcaaacaccgcagtgtctgttcatctttgacccactgaggaactactccttaaaatgggtttaggtcgtacatcctccctttattcagcaaatatttattgagcacacactctgtgccaagcaatgtttggggcaatggaaatacataaatctcatggaacttacaaaatgctgtgcaacctaaaacacttgcagataaggagacctattgcatcaggcttctggagcgaacagcctatgaatggacaccatatttggctctccatttgctgagagctggaacgggtgatgctacagattttatttctaaccagatagctagggaacttacacttaccgcgcctccacatgatcgacctcaccttgtatactcacagccacctcaacagctgggtgctgcaggtctctctgctttacagcggggaaaacaaagcctcagccaggtgagggaacttgctcgtgatcatgcaggtctcaagtgactggggactttgagcccaagtccgcctcatttcaaagcttatgctggttcctctgcatgctgcggcctttctgaaacaatcacacgaagccatcacgtagaagactaaactctctttaaaagtaaacttcagccagaactgacaccctgagcatggggcgttcatcacagcagatactgctgatgatcactgtggcttcatgaataagagcctggggacacaaggaaggcttctcctatgacacacacacatgcacaaacacatgcacacacacgtacacatgcacacgtacacgcattcatacacatgcacacactcatacacatacaagcatgcacacgcacacacatgcacacatgcactcatacacatgcacacacacgcactcatacacacatgcactcatacacacacatgcacactcatacacacacacacaaacacaaacactgttgcctgcagggaaaatgcttcaggagccacctctacttctacatcccacttttgtacgtggattccaaaaatctcttctaggcccaggaacagtcttgtttaaaggctggccaaggaggtgggggacagaaccagtgggacccaaagaatccagtgtgctggaacttgatgccgatgtcagcctcaatgctctcaccctgacagcagaagtggcggcttctccctccacctgtgcccggacagtgccaccagtctaacttctgccaccgtccctacctgcagctcacctgagcccagaaccatgccccctgcaccctcccgacacactcaggtaatgcccccgtttgtgttatctcttgctctataacaaacaaccattttattatttctcatgattcactgggtcaggaatgtggtcgggacactggtaatagctcattcttcctccacatgaagtccgccggggctgggccatccaggctggctggttcactcgcaggtctgatgatgatcaggctgagatgattggaatggtttgccaagggggcctcagttctctctgccgccctgttccctgcttcttcctctccatgtggtctcttcacgagggtttctctggatgaagaacaggcaagaggaaggaagagagagctgccagatctcttaggcctgggcttaagcacccttcctgcatgtggaacccctggcacgctaacctagggaaaggctcacacttctcactcactccactacccggcccacctcagtgacctcagaggggtctgccgagcctggggatgggcagtcgtccctgtccactccctgtcctggaggtacactggaaagccacaaataggcctttgtagcggcaagaggcagctgagaagcaccacggcaatgtagccgtcactcttggtgactccagctctttccatcctcggcccctccatccagatttgggtcctgcaagctgattctcaagtttggccccattgataagagccagaggcattgttgttttcttttcttttcttttcttttctttttttttgagacagtcttgctctgttgcccaggctggagtgcagtggcatgatcttgactcactgcaacctccacctcccagattcaagcaattctcttgccttagcctcccaagtagctgggattacaggcacctgccaccacgcccggctaaattttgtatttttagtacagacagggtttcaccatgttgaccaagctggtcttgaactcctgacctcaggtgatctgcctgccttggcctcccaaagtgctgggattacaggcatgagccaccacatccagccggcattgctgttttccttgtggcaattttaagtcaagtcaagactgattcagggtcttcctgttgatataagggtgtgaggaagatggttgtggcaggtgctatgagaggctgacctcataaaagttgtatgaatcattcagacaacactcctgccttgttatattggtcaaagccaaccataggcctgcccgcattcaagggaagggatatgagtctacctcagcctgctcctgactcagttctgtttgcctcagaactcagctactctcccttgggattcgctgcatcccaactgcctctatcctcctcagtcatggtaatcattcactcactcattcaatcgttcaacaaatattaattgagcatctaccctgtgcctgatactatgctaggcactgaatatatagcagtaaaccaggtggcataagactgtccccagggagcttccatcctaaagaaggagagagaaaataaagacataaatgaggacactctacgtggtgtgtcaggcatgatatgtgggctcatacctgtaattccagcactctgggaggccgaggtgggaggattgcttgagcccaagagtttgagactagccaggacaacataagaagaccttgtctctatgagaaaaaaaaaatagccaggcatggtggcacatgcctgtggtcccagctactcgggaagctgaggtgggaggatcgcttgagaccaggagatggagggtgcagtgagctatgaccttgctactgcacaccagccactccagcctggatgagatagtgagatgctgtctcaaaaacaaaaacaaagcaaagtagaaaacatggataaggagtggtagagacagggttggacctgcaatttgaaatagatggttagggggtgtggaacaagccagccacatggctatctggataagggtgtccctgttagggcagggaaatgtgcgaaagccctgagcagtggggcctgtgcagagggttcaagatgcgggaggacaaggcggagcaggggaagaggtatagtcagatgacgtggggcccaggggaaagacctggggttcagtctgagtgagattaccggccagtaagggatttgggcagaggagcaacaggattcgactaaggccagcagtctgatgtaagctgtggattcgtgcacctgctttgtgtgcaaatcacctattttcctgggtaaaaccattagcattagaggctagagccgtgaagctgagcataccctttcacttaataattccatgcctgggaattcaacctggagagagaatttaacaaaacagtattcttcaggagtctcaagttttcaataagaagtttttaaattttgtgtttttaacaataaccttttaaaataatggtgaacatatattccactgtctggttgattacttatatctcaataccacatttcattccagcagcagagttaagtagtattgctttaattgcaacaagctgagctaatgtgggaagaatgcagtagagtggcacagaagaatggtgagttcattgttattaccctcctagcccgtgagaacgcccaccatcccatgagttcctacatctatgccatgaggagcagttgggtttcagcacagcattctctatctttgcaaagttgttgattttaaccctgtgttttgaagttgtgctttgatttaattagcaatttcattttgatgggatagttatatcagtcataccccttctacttagttttatgtccataatattataattaaacattatttaattcaacattgaagggcagtgaaataattattttctgttttttctttttttctttttaattattatactttaagttttagggtacatgtgcacaatgtgcaggttagttacatatgtatacatgtgacatgctggtgcactgcacccactaactcgtcatctagcattaggtatatctcccaatgctatccctctcctctcccccgaccccacaacagtccccagactgtgatgttccccctcctgtgtccatgtgttcccattgttcagttcccacctatgagtgagaatatgcggtgtttggttttttgttcttgcgacagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacacacgtgtgcatgtatctttatagcagcatgatttatagtcctttgggtatatacccagtaatgggatggctgggtcaaatggtatttctagttctagatccctgaggaatcgccacactgacttccacaatggttgaaccagtttatagtcccaccaacagtgtaaaagtgttcctatttctccacatcctctccagcacctgttgtttcctgactttttaatgattgccattctaactggtgtgagatggtatctcattgtggctttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatgtgtttgagttcattgtagattctggatattagccctttgtcagatgagtaggttgcgaaaattttctcccattttgtgggttgcctgttcactctgatggtagtttcttttgctgtgcagaagctctttagtttaattagatcccatttgtcaattttggcttttttttgccattgcttttggtgttttagacatgaagtccttgctcgtgcctatgtcctgaatggtaatgcctaggttttcttctagggtttttatggttttaggtctaacgtttaagtctttaatccatcttgaattgatttttgtataaggtgtaaggaagggatccagtttcagctttctacacatgcctagccagttttcccagcaccatttattaaatagggaatcctttccccattgcttgtttttctcaggtttgtcaaagatcagatagttgtagatatacggcgttatttctgagggctctgttctgttccattgatctatatctctgttttggtaccagtaccatgctgttttggtgactgtagccttgtagtatagtttgaagtcaggtagcgtgacgcctccagctttgttcttttggcttaggattgacttggcgatgtgggctcttttttggttccatatgaactttaaagtagttttttccaattctgtgaagaaagtcgatggtagcttgatggggatggcattgaatctataaattaccttgggcggtatggccattttcatgatattgattcttcctatccatgagcatggaatgttcttccatttgtttgtatcctctttaatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtatgagaatgcttatgatttttgtacattgattttgtatcctgagactttgctgaagttgcttatcagcttaaggagattttgggttgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggtttttgaattttgtcaaaggccttttctgcatctattgagataatcatgtggtttttgtctttggttctgtttatatgctggattatatttattgatttgcatatattgaaccatcgttgcatcccagggatgaagcccacttgatcatggtggataagctttttgatgtgctgctggattcggtttgccagtattttattgaggatttttgcatcaatgttcatcaaggatattggtctaaaattctcttttttgtttgtgtctctgccaggctttggtatcaggatgatgctggcctcataaaatgagttagggaggattccctctttttctattgattggaatagtttcagaaggaatggtaccagttcctccttgtacctctggtagaattcggctgtgaatccatccggtcctggactctttttggttggtaagctattgattattgccacaatttcagctcctgttattggtctattcagagattcaacttcttcctggtttagtcttgggagagtgtatgtgtcaaggaatttatccatttcttctagattttctagtttatttgcgtagaggtgtttgtagtattctctgatggtagtttttatttctgtgggatcggtggtgatatcccctttatcattttttattgtgtctgtttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgttttctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcagattgttcagtttccatgtagttgagcagttttgagtgagtttcttaatcctgagttctagtttgattgcactgtggtctgagagatagtttgttataatttctgatcttttacatttgctgaggagagctttacttccaactacgtggtcaattttggaataggtgtggtgtggtgctgaaaaaaatgtatactgttgatttggggtggagagttctgtagatgtctattaggtccacttggtgcagagccgagttcaattcctgggtatccttgttgactttctgtctcattgatctgtctaatgttgacagtggggtgttaaagtctcccattattaatgtgtgggagtctaagtctctttgtagtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttgtaattggagcatttagtccatttacatttaaagttaatattgttatgtgtgaatttgaacctgtcatgatgatgttagctggttattttgcccattaattgatgcagtttcttcatagcatcgatggtctttacattttggcatgattttgcagtggctggtactggttgttcctttccatgtttagtgcttccttcaggagctcttttagggcaggcctggtggtgacaaaatctctcaacatttgcttgtctgtaaaggattttatttctccttcacttatgaagcttagtttggctggatatgaaattctgggttgaaaattcttttctttaagaatattgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctaccttgctagattggggaagttctcctggataatatcctgcagagtgttttccaacttggttccattctccccatcactttcaggtacaccaatcagacgtagatttggtcttttcacatagtcccatatttcttggaggctttgttcgtttctttttattattttttctctaaacttcccttcttgcttcatttcattcatttcatcttccatcgctgataccctttcttccagttgatcacatcggctcctgaggcttctgcattcttcacgtagttctcgagccttggctttcagctccatcagctcctttaagcacttctctgtattggttattctagttatacattcgtctaaatttttttcagtttttaacttctttgcctttggtttgaatttcctcctgtagctcgtagtttgatcgtctgaagccttcttctctcaactcgtcaaagtcattctccgtccagctttgttccattgctggtgaggaactgcgatcctttggaggaggagaggtgctctgctttttagagtttccagtttttctgctctgttttttccccatctttttggttttatctacttttggtctttgatgatggtgatctccagatgcgtttttggtgtggatgtcctttctgtttgttagttttccttctaacgacaggaccctcagctgcaggtctgttggagtttgctagaggtccactccagaccctgtttgcctgggtatcagcagcggtgtctgcagaacagtggttttttgtgaaccgcgaatgctgctctctgatcgttcttctggaagttttgtctcagaggagtacccggccgtgtgaggtgtcagtctgcccctgctgggggggtgcttcccagttaggctgctcagggggtcaggggtcagggacccacttgaggaggcagtctgcccgttctcagatctccagctgcgtgctgggagaaccgctgctctcttcaaagctccgatggaaatgcagaaatcacccgtcttctgcgtcgctcacactgggagctgtagaccggagctgttactattcggccatcttccaattattttcttttaaaggtcgtctgagtgttactcgagtgtgcacacactggaataacgaatggtgtggagcatgggataattcaaaacaggctttcttgtgctccatccccagtcacccactcaggaagggctgaacgttcctggctgccacaagggtcagggaggccatgaaggtagcaaatagctagtcaggacctgtccaggccattcgtggtggtcaccaggcctcctccatgcacaggccctgacaggatggtccagccaggattcaggaatgttcagttcatttatgctggtggtgagcacaccgtcagggaacagcaggcagggctgtgtccaaaaaagttttctggctctcaggttccaggcatacactcactcactctttctttctttcactcttccttccttccttccttctctccttccttccctctttccctccctccatcccttccctccctttcttccctgcctcccttcctccctcccttccttcctttttttgttagagacagagtctcgctccgttgcccaggctggagtgcagcggcacaatcttggctcactgcaacctctgcctcccagattcaagcaattctgcctcagcctcctgagtaactgggactacaggcatgcaccaccacactcagctacttttttgtattttagtagagatggggtttcaccatgtttcccaggctggtctcaaactcctgagctcaggcaatccacccatctcagcctccaaaagtgctaagactataggtatgagccactgtgcccagcctccctccctccctttttttttttttttttttttttttgacagggcctcgctctgtcacccaggctgtagtacagtcacagctcactgcagccttgacctcccaggttcaagcaatactcctgcctcagcctcccaagtagctgagactacaggtgtgcaccaccacatcaggctaactagtattttttttgtagagacagggtctcactttgttgcccagggtggtctcaaactcctgagctcaagcaatcacctgcctcagcctccaaaagtgctgggattacaggcatgaaccaccatgccgagccatgcactctttttttttttttttttttttttttcgagatggagttttgctcttgtcacccaggctggagtgcagaggtgtgatcttgtctcactgcaacctccacctcccgggttcaagtgattctcccacttcagccttccatgtagctggaattacaggcgcccgccacccacgctcagctaatttttgtatttttagtagagatggggttttgccatgttggccagggtggtctcgaactcctgacctcaggtgatctgccaaccctggcctcccaaagtgctgggataacaggcatgagccaccgtgcccggccatgcactcttgatcatcactcacgctctctgccaggtgaccccagtcatcacctctgtaccacctcctccaagtacctttccagctcccctgactggcagggccatgagaagtcaacacccctcactcctccatgtcaccctgcctccattcctagtgtctgctgcttaagacacatccttcctgccggagccaagtttgcctaatcccggtgctttcatactttctttacctaccagcaaagtgtaacatgacagaggttcctagccaagcacatgcacagaatctcatctttctctggcgacacccttgtccatagtaggtttgccaggattcacctgacacttgctcccaggactgactcagtaaatgcccttcctgctcactgatctccaaatcctgggaatctgggccttgaggcaatcacttctagaatacaggaaaccaaattctagacaaagcatctgtctccagccattttccaatcatctcaacagttcctggccaggtgcagtggctcatacctgtaatcccagcactttgggaagccgcggcgggcagatcatgaggtcaggagatcgagaccatcctggccaacacggtgtaaccctgtctctactaaaaatacaaaaaaatagccaggcgtggtggcaggcgcctgtaatcccagctacttgagaggctgaggcaggagaattgcttgaacccgggaggtggaggttacagtgagcagagattgcaccattgcactccagcctgggcgacagagagagactctgtctcaaaaaaaaaaaaaaaatctcaacagttcctatgggaacatggaaaaccctctgtaggggacaccgtatattttaatgccaagtacgtgattcagtaaaataaatccagcatccactccactcaacatctgttttctgggtgtttgcgatatgtcaggagctctgacgcacatgagccagtgtatcaggacacaatggggtgatactcccagggggcggggatgccacctctgcgtcagatagtctcctgactgtcgctcagcccctctttggtgctttgatttaaaaaaaaaagttgtgcatgaaacgctatagggaaccgctggggttctttagtaagagcttaaatcctctgcctgaagatgcaagtgcgtattggtgaagtgtttactttgctacaattccaaagaagaaattctcaagtctcttaggctacaaattgggggatggaacagtgcagagcaggccaaacttttctcatggagtaacacctccatcttgtggcctttcagggtattccaagtggatccaactacctgctattttgtgattctgggtacaataaatcagatctgagagaacttgagaggtcctctgattcggtcctctgccttcacccagacgtgaagctccactattagctccatgatttcctcatagtaacagtccagagaggtgaagagacttggccgagcccacccagctaatacgcacggtctcatacctgaggctcaatgctacccacttgtcactctttaggaagagaaaaaaacttcttcaaacaaaatttgaccaactatgaaacagatgaaagcagagagagtcccggtagagactgcagaaggacccacccttcccagcaccttcagtcatcacgccctggaaaccactgtcttgtgccagggggatgctgcttctctgggtaatggaacatcattgtggcagcctggaaagccccctaggacaatagcattcccttccgagtagcttattgcttcaatcagtttaggtcctggccaggtaaatgccttttattaaaacacattttacacctctcatggcagaataaacggcctcataggataagggtgtgtggccccgcgactgctgatgagaagtgaagccagctggacttctgggtcaggtggggacttggagaacttttttgtcttacaagaggattgtaaaatgccccaatcagcacactataaaatggaccaatcagtactctgtaaaatggaccaatcagcacactgtaaaatggaccaaatcagtgctcagcaaaatggaccaatcagcagcacatgggcggggacaaattagggaataaaagctggccaccccagccagccctggtaaccagtgggagtccagtttggtgcagtggagtctttgttcattcgcttttcacagtaaatcttgctgctgctcactctttgggtctgtgccacctttaagagctttaacactcaccgggaaggtccgcagcttcattcttgaagccagcgagacaaagaacccaccggaaagaaccaactccgggcctccggacaccattgggacctgcaattgctgggacccggtcccgggaggatgcccgagagatgcccacagggccccgggcagggcagaaagccgaagccgccgcaggctgccaggactagggcaagcttacgtccactcaggcggtcaacaaataattatcagactccttctacgtgtcatgccgttgaacaagatcgacaagaccctggtctcacaaagcttctgtgcacattggaggagccgggtgactgcaaagaaagggcgtaagattgtttctgatagggcctgggatgtgaggagcgatgatagagtgcgtgctctcaggagagaccttggagctggtcttgaagtgtgaggaggagtcggttggagaaagagggaaagaacaggccgagccgagccagaaccgggtatagccagaagcgcgaaggagagagccagcactcgaggtcagaggaagcgcaaggtggcaccggcccctctcgctgcgctttttgtccttccaggagggggcgctggtccaccgactggcccggcagttccccagtagcaccgggggtttcctgccgcgcgcgtcacctggttcagtttagagcctccaaagctgcaaggcaaggcgaagatgggcagtggagacagagtagggtggggagggtccaagctgaggagcctgtagagcgtctaaagtcatcagtggcacctgttgtttcattgttcgtgtaggcagcttgtatgtgtatacatattttaaacttattacctaacatttcaatcacaaaagcaattagagataaaaggtccatgacacccatgtacccatcacccatatcaataactatcaccttcagtcctcagttcatctactccctcttttcattcattcgtttattaaaaaaaaacaacaacaaaaaaaaaaacagtctttaaaagcaaatccaagacattgactcacttctgtaaatacttcagagtatatctctagcaggattattttttaattaaacatatccacaataccattgtcataacaaactaataaccccttaatatattctaattgtatatattgtttttaaatattttatcttcaaaataattcgacttccacagaagtttttgttttgttttttgtttgtttgtttctgagacagagtcttgctctgttgcccaggctggagtgcaatggcatgattttggctcactgcaacctccgcctcctgggttaaagtgattctcctgcctcagcctcccgagtagctgggactacaggcgcctgcttatagacaaggataataatgacaatgcttatctgattgtgttgtcgtgaggattaaatgagtttacacatataaacgcttagaactgtgtctggcacataaaatttcttaataaatattttccattattattacagctcgtattttttaaaaattaacccgtctcttttaaaaagacaaaaaagctttattttatcttgattataattctaggccaagcacactgacttacgccctgtaatcccagcactttggagaccaacgcagaaggatcgcttgagcccaggggttcgagaccaacctgagcaacatagggagacccccatctctacaaaaaaattaaaaattagccgggtgtggtggcacacacctgtggtcccacctactcaggaggttgaggcagaaggattgcttgggcccagaaggtcgaggctgcagtgagccatgatcacgccacactgcaccccagcctgggtgacagaccgaaatcctgtctcaaaaaaaaaaaaaagaaaagaaaagaaaatgaaaaaagaatgcatactctgagcctgagagccagataactttttggacacagccctgactgctgttcctccatggtgtcctcaccaccagcataaatgaactggtcagtcagctagtgtaccctggtgtggttgtgcctgttgttaaacgtttaaaaatagttctatactggttttcaaatagcttcctgccccagcctgcccccagtgttctggcccctcccagggtctccagatctgcccatggcccagcaactaaagggtttacacctggtgcagcaggtggacgggcggcctctgcactgggggctgcagctgttccaagcagcggaggctcaggccagagcagccgctagagatttaggtcctcctcttgggtgaagagggagagaaaatgaaagcatggggagcttctcattttcacacataaagactgaatttctttataaatatttcctatcattattagtataggtaatattgatttcaaattagtctctttttttaaaatacaaagaactgtattttatccaggttagagctgtaatacatgtgtattattaaacattcaaatgaaacagaaatatttgcctgtggggagaatgtctgcggtggcctctggtgacagctctgcaacagaactgagacagccacctcgcatggtgcttgggagtcaagccaagctaacctggaggtctttcctgtcagtcatctcgggtacagaggaggaagaggtgacccagggtggagcaacagatggtgcatgttccagacaggctgctttttgtctgcctgtcccaggacagggcagggcccccgccagccctgcttagacctttagaagagttcaaggggaaaaagactttactagtcaagggctgggaaaactgtgcaggggaatatctgatcatttctaaatgttatcttgaaaagaaaagaaagaagctttattgagaaacattcccgctggtgtctgcctctcggagccctgcaccttccactccctgctctagaaagaaaaccattgattcatttaggtcctgccaaggagacaagcatcccatgatcttcagccagaaattcccctgggccacatgaaatcaaactatccatgtctgttttgtaagtggctttgaagttgagacattgtggacatatttccatgtaaatgaatataggaacaccaccagctgcaatggctgcatgggattccactgtacagagggagtagaacttatttagccagttgtctagaaaattgctgcagggtacatccatataattaaatctttgtaaaattttccaagggatagtttcctggagtgtggatggctgaggcctcagctccagggcctgtgcactccccactagctatgcttcaaagaaggtgaagacacttgggggtggggggcaggaattcggggggtgggcaggaatttgtgggggtgggtgactgtttaagaaataaatcctgggccaggcatggtgacagcactttgggaagctgaggcagaaggatcacttgagcccaggagttcgagaccagcctgggcaagacagggagaccccatctctatgaaaaactaaaaagttagccaggcatggtggtgtgcacctgtagtcccagctacttggaaggctgaggcgagaggatctcttgagcccaggagactgaggctgcagtgagctgtgatctcgccactgaactccagcttatgtgacagagcaagaccctgtctcaaaaagagaaagagagaaaaaaagaaaagaaggaaaaggaaggaaggaaagaaagaaaaaataaatcctggggccaggtgcagtggctcacgcctgtaatcctagcactttgggaggccgaggtgggtggatcacctgaggtcagaagttcaagaccagcctggccaagatggtgaaaccccatctctactaaaaatacaaaaattagccgggcatagtggcgggcgcctataatcccagcttctcgggacgctgaggcaggagaattgcttgaacccaggaggcagaggttgcagtgagccaagatcaccccactgcacttccagcctgggcgacagagcaagactccgtctcaaaaaaaataaaataaggaaaaaagagatcctggaagatttgttcccagcacccagtattgtggctgagacatgccccagacaagaagcccagagagccgctccccctagagaggctagaacaggggattccttgccagggccctgaggatgcagagggaggtcagtcctgctgcccctatcacgccttgttattccacccccaaccggcccagacctcctgggagtcagaggaagttgctgacctgtcccctgggggaataattgtattagtgataaggtggcctctggcagcttactcagcagattcagggctttgggctgagtaatcctttggcgtctgccccagcagctggtgatcacagatcggggagacccccccaacccccaggccctgctgggctttggcttccattcccccagcacagtgcatagggcacagctctggctggcctgacctgccaaagaacccagggccaggctcagaggggattttggctggcatccacgtgatggagtgacagaatacagtcaaaatcaacagcgtaaaaatgggccggtcaaacactgcagggggctttcatttagatgggactgggtttcttgtgtggcctggcttgttttgtttttgccattttaggtaatacatacccactacagaatacagggaaatacagacaaggttgaaaacagattctctgtccattaagtgccttgggatcctcatccccagctaacccgaaactctaagcctgttccctggaatcttccatctggatggaggagagaaagttgacctggagtgaggttcaatgtaaggacaagatctgcacccggagaagctctctctcggagagcacaggcggcctgaggagtcaaaacaggtggcctgtggagtcagcacaggcagcctggaggaggtgagccctggacaggcattcagggatgggaagggtctgggcagaaggagcaggagggccaaagccagccccgctcagcggcctcccctgcgtgtgctgcccctgagagaaggaagcgctctcctccagtagccctgcccccgcttcctcccttccatctgccctttccgcttcagttcacctcctttaatcccaccacaaccgcccaatgggacaccatcctactcattccagagagcatgaaactgagaggcagaataacttccccaagcccacacagccaggctctgagaggagcggtgctggcccaagcctgcccttaagcccgggctgcaggccggagcagccccttctctcctgccggctgccgccccctcaagcctgcaggtgtctctccggagatgctgggcatggggcagggtttgaggtacacccaccttccacctctcttcctggctctttctcctctgtagctcccattttaaaaggaactgcattcctaacatatttttctttaaatatctaaattcgttggggaaaaaaatctttccttaatgttaccctccctgccacccctcagccccgtctccttccctcacagccacgctccctccccacaactaggcctcctgaatcatgctccctcccagggcaccagctcctccggctgctgctgaaacccaatgaggcagctgcccctcctgggagggtgtcctggtgcaaagctgagtgcagtgccaagcacagtttgaaatcctcatctgcatccccagcctcctccaccactcactagctgtgtggcctgaagcaaattacttaacttctctgactctgtttttcctcacccatgagttgaggctagtaaggacagctcctttacaaggctgctgtgaggtttgaaggatctgtgtaagaacttggcatgcttcctttctgcatgacacggaaggaacacttgcatggtgacaccaccattgctgattcctccccgtccctggctcccgcgacagcgcagcgctgtcctgagtttccgtcttgtctctgatgtgcctttgtcatcagcttgtccttggctccagccaccagagtctgagacccttgagctcagccttaggcattttcaaacctgcacgcatttgctccaggcggccccccagtcctggggttactacctctgtgcagataaattgggggtggtttggtctggggcatgtggagctggactccacggtggaactgatatgaagtggccctggaagccgtgagtgtgtgtgaaactgcccgaggagagagcgggaagggctgctgggaccagtctctgggtacatggaggtgatgacaagttcaaggcaaagacccgtgttccagaagagatgggaaagagcggcttcgggaaggagggagtggccagtcaaatccatggaggatggcctcagcttcagtcttaggtggagctggagaccttgtcctgaggggctttttggcagaggaggcagggaggggtgaggacggaggagaggagaacaggtgagagcacccagcccggtggcctcgatcttctgaggccccagaaagcggattaccctgcaaagcccctcgagctgacttcccaaatccctaattgtgcttctctgtcacagggagggttaaccccacttacataagggccaggccccgccccctgtccccttaactccatgatccttctggaagcttcacgctccgcccgcttccccttggggtctaaggctggaccaaccccaccccagctcatcctgaggtgagctctggtctgctggggacaagtggtcccctccaggacaacatgggctttcagctctgtcccgggcagggagggggctggcaagtgggcctgggggtggaggagcaggcaagaaaaggctgctgagtgtgaccttctcagtaaccccaagaatataacaatatcagctgcacacaccatttattaggttcttactgagtaccaggctctgaaacacatttcctgaaccattgtctttagttccccaactacaccataggacaggtgctcttctcatcctgttttacaggtgaggaactgaagtttggacagattgagtcactttctcagggacacatggctggccggtgatggagaaggtacttgaacctgggtctgcctctgctctctccacactcccttgcgggggcccggggcttactataaggcaaggatgtaagacaagttcctccttccctctccttcccacaggagcagaggcatcgctgggctggaggtgggaaggatggacctgggagcagcgcagggggctggtgtggcaagaggcaggcggagctgtgaggccgagttcggggggaaggggaggactcctgagagcccgtggccaggctcaaggtggctgtgtcctcactggctctagtcctgcaggcctggctctccagaggagcctgccagctcctcttctgccccctcacaggcctgaaggagaccctccagatggggatccaggcctctttcctccaggccagcctcagaccctacgggggacggttctgggaacgtcctctgtgccaggtgtctggggactgctagccttctgggggggctggatcctcaaatcgtgagccccaagcagtccctttccaagggattggagtgagaacctcgtggggcagagccagatctacctaggacccaaggggagtgtctcaggcaggacccccacaggcaaagacacacacactggccacacacttgccttcggatgtgtgccaagcagctcaaaaggatttaaagtccagccaggtggggtggctcacacctgtaatcccagcactttgggaggctgaggtgggcagatcacttgaggtcatgagttcgagaccagcctggccaacatggcaaaaccccatctctactacaaatacaaaaaaaattagccgagcgtggtggcaggtgcctgtaatcccacctgattgggaggctgaggcaggataatcgcttgaacccaggaggcagaggctgcagtgagccgagaccatgctactgcactccagcctgggtggcacagcgagactccgtatcaaaacaaagaaaaagatttaaagtccttgggagaggtggagtccacacctctcttcaagatgtggcatgaaatggtgaacagctgagcacacagggcaggagggccccgggggaccttgggcagcccgggaaccagcatggggtagcaggactgaccggctcccggggcaccttggtaatgctgcaggtgtggccagttgatcccctgtggagacagtaaagattaagaggatcataaactgcgtccagcggctgccccgggagaaatctcctcaagccagagcctgtgctgtgaggggcttcgggaccttggggcagctcctgagttcagacagagttcaggaagggagacaggggcacagagagacagaggttcatggactgaggcaaaggctgggccaggctcagcaacccaggcctcccgcaggcaggcagaggctgccctgtaacccatggagaccagaccaacagctctgatgagctccacagtggctgcagctgcgcctgcagctggggctgcctccaggaaggagtctccaggcagatggggcctgggggaggatcccacaggtatggcttctcctggaggtagggttgggtctgggcccttggggagcagggtaagggccagaggttcgcagggaccatggaaggagccagaacaactcagacccagccccgccggctgtgggcaagggtggggtagcctgtgggtaaacccagaatcctagaaacacggtggggcggggatgggggttgggggcgggcaggctgcagagccaggacaggacagcctagccgatggggaaggaaagaacagagaagcgcccttagggcttaacagcacagaggtccctagtggcgttgacaagaatgtttctgtgggatgatggagcctgaagccacccacagagaagggatgggagctgggaaagtggagctagggctcggactcttgctgaaaattggccattgagggaggagagagggcaaggaatgggggtgggggctggggtgtggatgcacagtgagggagacacttctccagatggaagagtcacgcgtgggttcgttcaaatgcgggtgagcggggcctgaggactgggaaagggacccgagggaaggaggggagcgtgcagccctgccccggcccagccctgccctggcccagccctgccccctgcccctcaggcgtgagcccctcgctccagtgccgcgtgtgcggagacagcagcagcgggaagcactatggcatctatgcctgcaacggctgcagcggcttcttcaagaggagcgtacggcggaggctcatctacaggtgagtgcggtgggccctgctgggcgtctgcccctgaggggttctggaggggtgagggggtgctcaggggaagaggggcttgggcaaaaatgtccaagcccatggctcagggcatgggagggacactgacccctggggtctcctcttcacctgcaggtgccaggtgggggcagggatgtgccccgtggacaaggcccaccgcaaccagtgccaggcctgccggctgaagaagtgcctgcaggcggggatgaaccaggacggtgaggcgggggctggcccggggggaggtgacaagaaatgggcagcgggactggcgtgtcgtcctgacccttcctgcctccccagccgtgcagaacgagcgccagccgcgaagcacagcccaggtccacctggacagcatggagtccaacactgagtcccggccggagtccctggtggctcccccggccccggcagggcgcagcccacggggccccacacccatgtctgcagccagagccctgggccaccacttcatggccagccttataacagctgaaacctgtgctaagctggagccagaggatggtgagtgggagagcagctgagggcacagcagggcttggcttcccgggtcacagcagggctgcagcgccttgccttgatcctccctcccccggggctccaagtactccctgccacctcccgagaagcaggcgctaagatcacaacctcctcctccaacagctgatgagaatattgatgtcaccagcaatgaccctgagttcccctcctctccatactcctcttcctccccctgcggcctggacagcatccatgagacctcggctcgcctactcttcatggccgtcaagtgggccaagaacctgcctgtgttctccagcctgcccttccgggatcaggtacctaccggcctgcctgctggggagctaggctgggctggggtcaggcggcccactcgagtcaaccagacagggcacacacatccccacgccagtatgaatgcacacagcttggatggtgatggctggggacacacatacctctgattcagcgatggctggggtgcatctcagggatggtgacggtgggggtgcatgcatctctggcacagggatgatggtcggggtgcacacctaggagatgatgatggctagggacctacagggcccagggtcttcttaagttctggaagaccctcaggccctgcagacattctgtgggtaacaagtgacctgcacaccctgaacaggctgagtggctgactctaggcccccttggagcacaagtgcctacgacttcagggcttgcattttagttcaatctctccagctctgggccatccctctcggcttctaatgggcaagcagatctttcaggaaaaccaggaggagaggcatgaggagggtttgaggccctcagccagtctgtgtgctggggtggagcaactcagaagagtcaggccacaccacttgaatacactcaacttaggacactcatgaggcatgtctctgaggctgcccaacttccaatggctctgggcgttcctaaatgtcccagctgcagctctggatggaacccagtgtctcagatgataggcagctgagccggatggtgccaaatcccagagctctgagcctctggctgatgtcaggagagcattctcgggtcccaggacagcacttccattccttgggtgcctgagatggtggcagaggctccagactgagccagagaagctgtgtgtctgccataacaggcacccctgtctgagcacaggtgatcctgctggaagaggcgtggagtgaactctttctcctcggggccatccagtggtctctgcctctggacagctgtcctctgctggcaccgcccgaggcctctgctgccggtggtgcccagggccggctcacgctggccagcatggagacgcgtgtcctgcaggaaactatctctcggttccgggcattggcggtggacccccacggagtttgcctgcatgaaggccttggtcctcttcaagccaggtaactgagtctctgcccaaaccttgagtgggaattctggtgacttccatctgcctctcactctccctccactacccccatgtgtgcagatgtgtgtaggcctctatcctggggggtgggaggagagtggtgaggctggactcccttctccttggggccactcctggttgactgtgaggggacagggcaggctgggagcccctgggagaccctgagccccagccggagcccctggtggctcctctgggcctggcagagcccaccccacagggccccaggtccatgtctgcagccagaaccctgggccaccacttcatggccagccttataacagccgtaaacctgtgctaagctcactggtgctgcttctccccagagacgcggggcctgaaggatcctgagcacgtagaggccttgcaggaccagtcccaagtgatgctgagccagcacagcaaggcccaccaccccagccagcccgtgaggtgacctgagcatgcgcccacccactcatctgtccctgacctctaacctttctctgcctctcccacactctcccagagctcactgattagacagcacaagggtctcagttcaacagcatacagccaacatctatggtgtcccaggcacagtgccaggccccgggagtggggaccaagatgtacataagacaaagctactgccttctagagacaaccggcagtgacctcactgaagacaaaaactgccctagccaggtactgagggttgcatgaatctgcaggagacagagatccccttgcatgggaaacataaagcagaattgggagggactttgtggagacagggctggacttgaaaggaagaagaagtctaaaagaaaacatcatttgcaaagggagagaggggcaagcatgatatgttgttagaacaggagcccactttgaaggtataacaggttcctgccagtgagaaatggggagaataagccagaaaagtaccctaggaccagcccgttcaggactttgaatgccagccaaaggccacgtctgacttgggaggcagagggcagctactgcaggtttccgagcagagggtcatacacagggctggacctcacgcagactggcatggccatgggtccagaggatactactgggaaggggatggcagctactgccaccttccagatggttccatggagttctgatctttgggcatggccaggggaagcagaagggagactctaggagttgaaatgggtcagacccggtgtttgggtgaaggtaaggaatgagggaagaggagctctttgggagaagacattgttaaaaatataaaaaggaaagccaggaggaaagacggttttgagggaagatgataaggtgttttgtaggtgcactgagcatcctgtagagatgccaagcacatggatggccctggctaggtttgggggagagttgctgcaggctgagtgtggctgcgcgagggtggggcaggagccggtgctctgggactacgctgtttggcccagcacaggcagatgtcatggagcctcagcaaggttggaacatttggccttcaggcatctactggctattttagaccatgttatctgcaatctttggggctcccggcagtttctttctgaagaagcaagctaatatgggcatccttgcatcacctctaatccaagaaatgattacaaggagaaaaggtaatttccttttaagaaaagccacagtatacaaagtatatgccatatagcacaggaagatttgtgctgcttatgagcatagggagaacgctgctactactaagacttgacttagcatctgaagagtgggattcagagacattcagaaaccagcagcctttctctgccaagtttctgttggaaccaactcccagagatgtcctggcatattggttatgcgtcaaatttcaaaatgctgattaagatttcctatgtcccttttatagcggttcattgcctactacaagggaattgagcatgaagatagtggtttggggttctctaatccagcatattatttcagtttttaaaaactgcaacacccaggaagaaacacaattaccatcgccccctgatatgcacacagacaccaaagcgaagttccacgaagtaattcctacccttagcttttacaatttacctgatgtttctcttttctttttttgaaaaggctgattgtgaccccctgaatttaatttcagacccactaggtgaggcaatacctgcagtttggaaaaaacattctttaactgactttatagttatttcttcttcctcccactctaatttagatcagaaaaacagaagcagggaaggcagatgggaggggtatacgacttgctcagtgctgctcacttggcactagcaagagaaaggaaggccttaggttggcaaagcaagtccagcagatcactgagtggtggggaagtcttccccgaaattcacggtgagaggagcatgggactgcccaatgtggagtagcctccttgatgctgggtgttgaccctggccatcagacctacccagggaaggtttagttcccccatctgtctcttggggcttcaccatccgtcttttgtgttgcggactcctgtcttagcaaatactttttttttttttttttttttgagacggagtctctctctgtcacccaggctggagcgcagtggcgtgatctcggttcactgcaagctccacctcctgggttcacgccattctcctgcctcagcctcccgagtagctgggactacaggcgcccaccaccacgcccggctaattttttgtatttttagtagagacggggtttcaccgcattagccaggatggtctcgatctcctgacctcgtgttccgcccgcctcggcctcccaaagtgctgggattacaggcgtgagccaccacgctcagccagcaaatagttcttatttaaaacaataaatatttttttcaatgactatctcagtcaccaaaattatccttcaacttcaggacattttcagtaatggctatcatcatcctaggtggtatacagacaggaatttgtattcttacaaacaattcttatctactaaaaactaatcatataattataatacttatatatgagattaataataatattttcatatacaggtgctccttgacttatgatggggttacatctggataaacccattgttaagttgaagctactgtaagttgaagatgaattttcatacataacccatcttaagtcaaggagcatactgaatgcttatcactttcacaccatgataaagtcgaaccatctgtatagagttaatataaacttcactttataatctttacatataataaacaatatttactcattattttcattgcactcctaaactaaatagagggtggcggctcacaatgggtcgaggtaggtggaggcaactcctctggttaatgcggcttttcttttttctttttttttttttttgagacggagtcttgctctgtagccgaggctggagtgcagtagcgggatctcggctcactgtaagctccgcctcccgggttcatgccattctcctgcctcagcctcccgagtagctgggactacaggtgcccgccaccacgcccggctaattttttgtatatttagtagagacggggtttcaccatgttagccaggatggtctcgatctcctgaccttgtgatccgcccgcctcagcctcccaaagtgctgggattacgggcgtgagccaccacgcctggcctgaatgtggcttttcctcgaaattcctcctgacccactctggggacctcatctctcctctccttcctcccctccctttcctgggagggcaccgccccagggactagtgctcagaagctggtcgtaaaactgatggcgtcctctctcctgttcaggtttgggaaattgctcctgctcctcccgtctttgaggtttatcactgcggaacgcatcgagctcctctttttccgcaagaccatagggaatactccaatggagaagctcctttgtgatatgttcaaaaactagtgggggtggaggtgaaatgtttccaagcactctggaaaacaatctactgaaacgaaacatttgcctactctttgccccagcaattcctcgtaggtgtgtgtacccagcagaaatgcccaccgaaagatattgtaagaatattcatagcagctttattcataatagccccaaactgtatattgatggtaggatgaattaacaagttgtggtatattcatataatgaaaaataatttaaaaagaatgaattacggatacatgtggcaacacaggtaaacttcacagacataaaagttgaatgaaagaagccaggccgaagttccatttatgcagagttcaggaacaggcaagactaattgacaataatagaagttggaatagtggttacttctgggtggtgggggattgatacagagggggctcatgggagccctctggtgtaccagaaatgttgattttgatctgggcagtggtttcacaaatgtattcatacgtaataattcattgagctgtgcactttattttgttagacctcaataaaaaagtaaaaaaaaaaaacaaaaaaaaccagaaaaatgagtgtggtcaaggctctccctttggggacactgaaggaatgagcgcaaggtctttgagttccatctgggttccactccaagtcagagaccaggcgcaatgaattcaagcccagtggaaaatctcccatagaattcaaccacccagcttctctccagatggcatcccatcatccgcagcatctctcaacctttatctcctatctcctgcctcatctccttcctaagtaaagaacaccttccaactcaacataaggcagctacaggtacgttttgtgaaagggactcttcatcacttctcaggtccttatggaaagatacagctcagacaaacttcatcattttctttttctcttttttctttttttgagactgagttttgctcttgttgcacaggttggagtgcaatggcgcaatcttggctcacgacaacctccgcctcccgggtataagtgattctcctgcctcggcctcccgagtagctgagattacaggtatgcaccaccatacccagctaattttgtattttcagtagagacggggtttctccatgttggccaggctggtctagagctcccgacctcaggtgatccacccaccttggcctcccaaagtgctgggattacaggtgtgaacctaatcctttttgaagatagacccagatgactgtgaaaataatattttaacatgttaacatagatcaggcaatgtatatattaatagcaggcagtgagccgggcactttttaaattgccatttaatccgcagattaactctgagggaagagccaattttctccatttataagtgaaaaaactgatgcttagagaggactcaaaccttggtgtgactctacctaatgctgcttaactttggcaccgcctctttcccaacttccccttcacttttggaatgaaagactgaacaattctgttgcattttctgccttcaaaggataagtgtttgaaatcaagacagaaagggtcatgtgagaaggctgagaaatcctaggggttccctgtcctttggcttgtgtttgaattcccttagctgacagaaatgccctatctactcaggaactcagaaccgctagggctggtgccagagaggaaagagtatggcaaatgctgcccagctgaagcccttcttacttcagcccctaggctacttcagattctctccaacttttcaaagtatcagagtggcctcagttaatcggtcaactaatgtctataatgccattatacagtccaattccctatcaaaagttttatccatatgagctaagccctgagcaaagccaccttagtaagacacatggttgaaatatgacatgaccagccctgcgtatgtatcttacagtttggctttggaggacatggtaagactgcaaaggtagcctgctgaagttcacaggctagcatctgggatgtgtgagcccagcacatctacattgggaaggagatttgagggctctccaagaagtcttggagaattagaggaagtacataagctggattgtctgctgtcaatcgggcatcaataccacccctcccccacttctaagggcttttcttcactgcagagatgccaggaaggaactacatttcccagaaaccctttcccctaggatttgctaatgaaagacactcacaggagattttttcccccctaatgccaaactgattaaatttggcattaggaaaaagagaagccatttttctttggagacactgcagccctgtcgtgggaaaatagatttcatagcagcctcctggctagaattgcactagcttccaggcaagctcttgagaactcctctggaacttgtagctgagatttgcgttggctttcttgacctgtgggaatatctctgacctttgttagatcctaatttctgtattaagtccatctcacctggaatacaaagtggcctctgttctcctaacctggtacagctctcagcatgtcttacagacaagaatacaaactcctgtttgtaaaccacctaggatgatggcagccattattcaacttcttgttgtagattggctctacagaaattctgatgagtaatggcttttccattgcatttagggtccttattaggagggtagataatttgaaagcttttttttttccccctcaatgccagaaatatctttggctatgaagcaccacagaggtagtccctgtgggactatctgggcctttcttttcaaataaagctagtttttagattcacgagacactcctctacccacaaggggatatttcaaggtaggaagggcagggaaagactcaaagatgccaagaagcgcaacctcatagtcaaacccaggtatcatggatgactagtctctatctggtggacatcactggtgttccccactagaatgcaggctccacagggcagagatctttgttttgttcactaatgtaccctaagcacctaggacaatgcctgtgggcactacctggaagtgacacactccttgactgtgagtctgagatacctacaagattcaacagtcagatattacatgtactttatctactttcatgtttatatctctggctctaagacactgtactgccacccattctaggggcaaaagcaatttaaaaaacaaaccaaaccaaagctgtggtcactttataacttgcctctccttatatacctttctgttctcaggtcttcataatcacaatagttgtcttctcagtaatcatctcaggggcaagttttaagaatgtatttcggctgggtgtggtggctcacacctgcaatcccagcactttgggaggccgaggcaggcagatcacctgaggtcaggagtttgagactagcctggccaacatggtgaaacaccgtctctactaaaaatacaaaaattagccaggcatggtggcaggcacctgtagtcccagctacttgggaggctgaggcaggagaatcacttgaacctgggaggtgggagttgcggtgagccgagattgtgccactgcactccagcctgggtgacagagtgagactccatctcaaaaaaataaaaataaataaaaatggtatttctaggttttatttgggcaactaagggaattttaaacaattaacacttcatatttcaatgtaatataaatttaatgcaaaaatgaaaatgtaaatgtaacgtaaaaacaagtgagaaggatgaccccagaattttaaaaattgaatacatttggcattagggacatgtttttttccccatgtaacctcagacctgatttggcattttggaaccactgatcctagtcaatcctctcatccaatatctgcctagccagcaccttttattaggtgctgggatctaagagtcagcaagacaggtaagtgtttgacgctgtgaaaactgagagctgttgagaacacagacctctaacccaattcacagggtcagagcaaacttcctaggacaactaccttttatactaaaacctgcgagtcagtaggagttctccaaagctgggagtttgggaaacagaactgacttccagataagaaaactaacattcagagagagcgaatgcctttcccagacatgcagtaaagttggtagcagaacaaaaatgacaaactgagttaaaatttctgttcctattgcaatgtgttgctttgaatttcagtgagaatccttgggccctctattggcaacctctattagcaacttcttcaagtggccaatttaggggaggatcctaaatgcagatttactgcttttcctcccttctagccttaaaccgattaaatgaagtcttgacagccagcagcctgcatccactacagaaaaaacgacaccttgaatcacaccttcacttgaattcagttgagttccagtgactaccacctctgtgctttgtcaactttgggttgagtcctttcctgaaaacacatcagtgtaactaagaagtcactgctgtttcttggagttgggttggaatagttggagtgggagccaggatggttggaaaacaaaccacacatattgctgcttctggaagctttgttctttaatgagccatggggtgatttgttcatcaagctgcttttgtgtagccatacagtgcatattttgagtgacacaaactgcactttatacagatggtatcttgttacccctcaaccccccagcaaagaaaaaaaaacaaaaaggaaattacaaagtgcctattgattgcatccggaatgtaatcagttccgtgggtgagataaatcattcttcttatagaattattctattaaacagtaaaatgttatatttcacaggatatgtccttttataatacagtttttaaaaaaaatttacactcagcatacttataaattacttaaaatccattaaaataatataatacgaatctgtagtccacacctttcccatagtaaatacaaatacttggttcaaaaggtgcaacttttatatgacctcagagggctgataaataggcattaagaatggatgactagcaaggtgacaggcccattgttggggcttttttgaaaatagtttcaaccaggggaccaacatgagacctaatagatccatctccacaatcatcattttgctgttaccctttcaatacccaatcaaatgtgggagtcattccagagaaaagtggttaaaagtagtctagggcatagaaaaagaggactctcacagataccaaggagttttactaccaaggccagcatggtattgcaggacagtgctggggagttgtcacaagagtatgggtggacataacacatttgtccatacagaatgatgcatgccccgcatccagcttcccaccaagaagaaaaaagagaggaggatgaggaaagccatggagtgagtatgtatgtttctttttaaaatgaaaactctcttagctttgaacacatcctgagaatcctttcttctttctagtttaccaaagtgcttgttacagtgaaaaacacagcccacaggcactgaggtgggactacagaaccttgctggaccacatcttttcagcacatttctgtgaccctctgtttttgatggagaaaacaacgctactgttatgaaacacagaatggagtcttcattaatcttccagcagggtaagtgctctggcaggtttccaaagcatgagaaggtgggggctctagtattccatcccaggacctctggcccttttgtctctctctgcaaggctcatagttggagggctgtatctccctttgtgttttcagaagcccagagtggcaaaataatttaaatggcaggaggtacaaagtacgttgtaaactaagcctccctgaatcctgctgtatttgctgttgatttgcttcaatttgtgatacagaatgaaatcacacttctctgcttttgttacattttccataataagtacatactaaattacagggatacattcactttaatgggcagagttgaaaattcaggttttgtttggggctgggaatgtgtgctgtgagaagagtgctctgcattttggagtatgggctccaaatgtggagctgccccactgctgccatgcagagatcaaacaagcaaaggagaagcactatggaaccacaaatgtgatgcatattaagggctaacagtttcataagtgattgtaatgcggcatcactttgtggtgacataactttaccatgcagagggccagtgagaacagatggatgcagacacagcgtttggttctgaaggtttttaagagttatggcttcatctcttgatcaggccaacaaggcctactaccctatgtaaacaacggctttccctcaaagggagggccccacactgctctccactcttatcattttgtggctctctcctcctcacccacccaccccaatcctggcagattaaattactagaaatccacaaatctagcaactgaaaaaacaagtttttttaattgaattttatccaaactggagtttcaggtccctgagaaaaattataaagtctcttaacatccatcacctagttcctttaaagtgacctacatcagtcgttttttaactgccaaaaaacttattttgccaaaaaagccccacaaagatttagaaggaagaacatgtgccaacatatgttcttctggccattcctctgggccacaggaaattattccataagggcaatctctttttttcatacaggatttaaccaacattctggagcaagtgcagagtaacaattaatgcccagcagtacactactctcccaagaacactgaaacacagactgtgcaacctggcacggggctgaggaaccagcaatcccactctaacacaccatgctgaggggttttcctctatcctctaggagattctctgaaattcagatttttaaaagcttaacattatttattactcctcaggacaagatgaacaaggtggcagatgtctgtgggatataaagcataacatttgctcattaactatcattattctggagattttaatggcttcctttctctggctcaattctgaacccaaagtagggagaggtaagactcctgctacctttagctgccactcagaattatgctccaagtctaacctctggggctggccaataaccactgaggcagtggcgtgaggttcagtgttgtgtaacaggagagagagactctgccttaacaaaagacttaatatttccacaacttcaaagaagtatgaaaaggaagaatacccaaaatacaggttatagatggtaaaggctctttttcagagcagtgcatgtagtagcaagacaagatgcatttagtaactttaaaaataaacatttcacatacttatctcaagaaaggctatcatgtttcattttttatatattataaatagcaaaaacagatttctaatcccacaaatgctaagatacttaaaatgctattataactcatgtgtatgaagaccacccagtggtgaaaatgatgtcttactaattccctcaacccagggacgaatggctctcatccccctgtccagtggcccctcatctgtgggaagaaattccatgggaaggagggaagcacaaggttaaaaagaaatatgcctactatacatacatatttacaataaacttcagtaaccagaatattaacaaaaatagcttcaagtagtccttgatttttttccatctatttaatactgatagtctgagaaaaggaagataaaagttagttagttagataggtcatattaaaaacctttttattttttggcagctttctgtaacacttacttacttattcatgcaatattgtatgtgaatgtttttggaaactaactaaacggtcacattatttgtttgtttgtttgagtctgagtctgtggtgggaatccaccagcagatgaacaggctcatatgcggttttcggtttaatctatacaaagagaaaagcctgaatggcttaggatgaaaccttcataagtttagggatcaccatgtctctgggaaactaaaaaataatgtagaagaatctgatcctaggaccaagaaacatgagaacagtatggctactgacacttcagcccatgcaatgtatttggcaggaactaaacaggagttaaaccagcactgattactatgacatcaaacatcatcaaaaaaaataggtattctcttcttcactgtataacaagatatctgagacacgctctgatggcttaatggaaacaatcacggtttttttttgtttttttttttttgttttttttttttgtttttgctttccccagaatataacatggagtgttttttcagaaatcttaaaatagagggattaggctttttgtttgtaagtaagtttttggaaaaaaattatattctaccctagctcctaactatcccaaaataaacccaaaggcttttgctttcacggttaagaaagatttatacgttttcttcaaatgtcagaaatgagagggtccctcaggacagcaatatcccccctagttcaacacccacctttgggaagggaaaagagggtgggggagaggcaactacaactgacccaaatccccaggccctaggtggctttgtatagtaaaaatctcaattcaaatacaacagccaaggcacagctggcaccatccccagcaggctttctgcttctgcaggaggcccaggaattcagcacatacagtcttagccatatgcttagaaaagaggcaggaccacaattaggattgactattgtggacgaggtgatgaaacgcagccccaaaggtgagatttgtttaccactctgtagccacggagggacacacatctgccggttcagaccataaattcattatttccaaagagtgctagctgttggttggaggtgcagtctgggtccacagtttttctgcggccagacatgactgtcccctctggggtctctttggttttctgaggtgagtttttcacattctttaatttttgtttgcccttttccgggttgaaggttcctctgctgatgaactgaggcttgtcttccaggaatttggtctggcccaatggtccttccattcccagggcctcattacctgaggcagctcggtagaatggagatttggaataaatctgaaatagttttctggtcccatgagatgatgccgtgttagacagacataaagaggagaccgaagagtccacgacatctaaagagtcttgctgctttttaagttgctttcgcaacttgctggaaggttcagacttgccagctgtcttcagggagctaagggctaagcttctttctaatgcaaaaaagagaccaaagatgtaaatgacagtgccctctaaagcaaatcatcatataatgaatagatgccactgttcacacatgaaattgggtgggataagattcagagggtccaggatgacttactatgggcacagtcacagtaagagctcaccatccatttctctatgtagcatttccgaatcatctccaaggaaatctggtgtttgactatgccatcagcggaggcctagaacagtcactatcatttcaaaaactgccaggatatgcaggtaagtcctacatctccctgagacatgccacccagttaaacacctcctttgtatatgtatatagtcccacctcacagtgggggcacaatgcctgccaccctcagaaaatgggttatgggtcagtaagacaacatatattgtgattattggcttttctctgtggtaagtacaggataaaacattaaattaccaaaaaacaaaacaaaacaaaacaaaaaacaaaaaactcaatcacgttgaagagttggtttgataaacaatgtatatggaagctttacaaagacaacaggaaaaaaaagaccttccgtggaagtcaggaatctaagtagcaaagacaattatatttcttatccccttatatttcttatccccatccaggtcactacctgtatgccaaacgatgaaggctaaaattatatggataaaaggacaaaattcctcaagactttgttattgctgatgtacagtcagtaaattcttaaaagactttgtcttagttttggaatctttattcctcctttgcaaaacaaatctggagtctttggtctaccatgttcacttacctgatttctcagagatagcatattcagactccatattcaaattctctgagctatcagcagtcccaatggaggcctcagactcaagggtttcatcatcagaggcacggggttccagtacaagcatctcaaatgttagctcctccctgtaagacacaatcaagaaaccattagcatttgataggaagtggaaggaagataacagaaaaaaagatcctccatggaagtcaggaatctaagaagcaaagagagtccatttttactgtccccatccaggtggtgatgaggacctgtatgccaaatatggtgaaggctaaaactatatggactaaaggacaaaatgacagatagccaatctaggaccaataataggggtaagggtagggtgaagaaagatgtagtggtgagatctttcagtaaaatgaactctggactgataagcaggagatcagggctctaaccttgttcataatatccataatgcatcaggaaagtacctttctcttctggacctcagcttcctaccacaaaacaaagagattaaactagataacctctaagattccttccagctcttaaactattttccatgaagcttactaactggctatagacgataccctctatcttcaccacagagacctctagacgaagaaaaacactgattgatcttttctgtcctttgaagcttatgccatcttcagttgtcgtattctctagtctcccttcttcatcacggtcacccagctacctctcagtaatgccccacattctgtgaggtctttggtactcagatcctaatcttgctttttcactaatgcctgacatcacctgatctattcaattaatatctttgtaaaaactcatctgaatattctaacactgaagttcctttatgtctgcaacttctaacaatattctcctctactttatctaagctactttctccaatgcacagatcctggagcttgtcattactctgaatccaacactccaccctgttcacaacctccttatccttccaattcttactcaccttctaatcaagtctcttccctaacagagccccttacctttacttcccctttacctggcttgagatccatgaacaatcatttcaagaacagtatcaccagcattacaattgtctgaggccatgtgcattctgagactctgctcgttcttctttctttttctagagactctccccttccttgaaaattcctattaatccttcaagactgccaatatcatctgcatcaaagccaaactgggtcttcttttcagatcactcttctagcaaatagcccctggtcaatgtacatcatctttgccttatcatgttttttacagctgagccccagctgcttttttagctggcctatattccagaatcaatcatgagagaccaagaaagtattttaacagtcttatatccccttataaaccaaactcaagacctgggatcctggaactcaggaataaagatcccattaagacttcctaagagtcatcaatgtcgaccagaactattacacagcacctgtagggagaaccatggcacgttcatattatccccaaggcatactgtcacccaatccctgcaacagtgatgaatggaggtaaaagagcttctcatttgtctctctcctaaattgcaaccaatttccctatctagtatcctagcaccctctagggctatagccttactatgaccatctagttgctgttcccatggtcatatggatctttggctaataaccttccttcatggatttgtgaataatgcccattcttgaaagggactttggcttagcctaagaattccttctcttctttgcaaaataaatctgttcatggaggctggtctccgacctgttaggactccagtacctcatcttggctccccactgttactgctagatgaatcgtgactaagactgacatgccctgtggatactgtgtcctcctcccagtcagcctctacagaccatcactgtagcagcctcaggtttcccagctcatggaactggcttcccagagggaacaactctcacactgttacctgagtatagacaacacgtctttgtcatctcaacatctcctgtatcatctgacacagtgtttaacacacaggagataataaataagaaaaaataaagaaacgatagaaggaaggaaacaaaaacagactataactgtctctccccttcctcctggatactcacttctccttctgtaggttctcaatctgctcagtcagtactctctcctcctgctgcatagctgcttgctgctgttctgtgatgtcagtctccatggctgcctcactagtcaaggtctcctctgagacatcagacacagaaggcaaccgaactacaacaggagacgatggacctggatagtttcctcgacgaatacgcccctttccctgcagagaaaaattcatgttagaaagtaaattgagtgactgcatcagttttacattgctcttttaggataacaagtgtatttccatcacaccaggtgaatgataagaataaatggaaacactctgcgaggcctaggatatttagtgagacatattcatacaacacatttaagttaaaatatttcttgcaggagtactggaaaacggatactttggtaggtgggagtgtaagaacccattgtgtactgagatgagtttcttcttttaatataagctgcatccattccaaacaaaatagccacatctgggtatttatttttaaattaattaaaattgaactaacatttcagttctgcagtcacactagccacatttcaagtgctcaatagccacaagtagcttgtgacccccacactgactggtacagatctacatttcctaccatcatagtaagttctgatggataacagtgctctataactgtagccttggaatgcataatctctctaggaagaccatagaagtatgttctaaaactcagttttgaaaaacaaaaacaaaatgtagtcatttatagaacacagggtgctagtgagatatattttcttaggaaacttctatccttgagatcagagtgtgaaaatctcattgctgcttcttcctttttttttttttttttttttttttaaacattggttactttatatatgactttcttctggtagtggcaaactaaactttttaggttaatctcctgctaagaaacataaaaactcaacatatgctagaaggcactgaagagctaacaagatagattaaggagacactagtccagcatttagtgctgatctaaatgtcagaagtggctgtgactctaaacagagcttttgacatgctacagcagaggacggcaaactatagcccgtgtggcaaatctagccttgcacatattttgtaaatacaggttcactggaatacatttatctcattaatttattgtttattgctgcttttgcagaacaatggcagagttgattgttgagacagagattggcctacaaagactaaaatatttattctctagtcctttacagaaaaagtctgccatcaccttgggatagagaataaaagttggagccagacccactcaatggtgtgggttgctgcctggcaaaacctccgtgcctgacactgggatccccaaggtttgtttcttagacataagagtaaactgaaattataaaagtccttgcagatactgtagtctagcttcaagtcatctgaatggtccagaaaattctaatccctaaaaatgaattaatctcagattgctaatactttaggaccaggcagaaaaaaatgaaaacattcttggaagaaagtaacattatctaggcctcaaaatattttaaaaatagtttttcaaatactctgacaaataatcaaaggtaacaggcacaaaaggagacaggacaatgtaaatgaaaactagtaaaaatgacagaaaacagaaaccctaaaagactccagatattgtggctatcagatttaaaataaccatgctgaaggagacaggaagacatagctgaagtagtggactggaaattaggtcaaaagaaaaatcctgaaccaagcaggaagaaacaaaagaatggaaaaattcacaaaagaaagtaaaagaatggctgggcaccgtggctcatgcctgtaatcccagcacttcgggaggctgaggcaggcagatcacctgaggtcaggagttcaagaccagcctggccaatatgaagaaaccccatttccactgaaaatacaaaaattagctcggtgtggtggcatgcgcctgtagtcccagtactcaggatgctgaggtaagagcattgcttgaactcgagaggcagaggttgcagtgagccaagattacgccactgcactccagcctgggcaaatatcaggacaagagagagatcctatagaataaatattgaagagatcatggcagagaattttttaaaagcagttaaagatattaacctaggaatttaagaaagcctacaacccctaagaaagaaataaaaagaagtctatacctagacaaactactgttaaaaactaaaggcctaaggcaaaaaaaagacttaaaagcgttacaaaaagcaaattccttgcaaaaaaggaataactattagattcaaagtttatttctcaacagaaataatggaatgcagaaaacaatggaatattttcatggtgatgaaaaagtaactgccaagcttgattgttatatacagaaaataattttcaggaatgaaggtgaaataaagacatttcagacagactaagaggagaatctcacaccagcagacctgcactaaaggaaatattgaaggaaagattgaaaatgtctcgaagaaaagttagaggtgtgagaaataatgaaaggcaatgaaacgtgagtatgtttaaatagtgactgcataaaacataatagcgatgtgttgaatttaaaacatacagataattaagatacacaacaacaagaggaacaaaatcatatcacagtaaggcatattaaaacacctgtattatctgggaaaaagataaaactactagttagcaaatactgatagatcacagatctgttttcaccatttggttaatgactaaaataatagtaaaagagtaaaacttccaaacaaaagaaaaaatggaataaaaaagtagtaaaaaaatgcaagaaagagcaaaaaaggcaaggaagaaaagaaaaaggaacatatatcaggcaggacaaataaaaagcacataaaaaacagtagattttaagcccaaatatattggtgagtatattaaatataaatagatgaaatgctcctattaaaatttgaagattgttgggccatataaaaaaaaagaaaacctatctatatgatgtttataagagacatgtgaattcagaaaggctgagagtaaagaaatgggaaaaaaaagacataccatgcaaataccaaaataaagctagtacagctatattaactgtaaacaaagtaaactttaagaagtattacctgtgataaagagggatacctcacaatgacaaaggttcatattatgaagaataacatttccaaatatgtatgtacctaagaaattgcttcaaaaaatttaaagtaaaatattgacaaaactatttttaaaaaatagactataatcagtactgagagaacaagtatgcacacgcaatcagaaatgatgtaaaactgaacttgatataagcaatctaacagacatatacagacttcagtatctaactagagaatactcattttaaagcgcacacagcaagacaacaaaattccaagggttgaaataatttatctgaccgttaaagtaatttaaaacaagttttctaataatgtagttacaaagagaaaattaaaaattcttgtatactcagaaattaagaaatagactttaaaacaaaccatggtcaaagaggaaatcacaatggaaattagaaaatattttgaatgaaacaatataaaaacccatgtaagctctgtctactttaaagttacagccttaaatacatacattagaaaagaattaattaattaaagaattaattaattaaggatgtaagactctatttcaggaaactaaagaacaacataataaattccccctgcaacaaaagcaataaagaaaagagcaaacaaacattagaataaagacaatcaaagccaaatgtagctctttgaagaggctaataaaatttttaaaaccctagcaagactaaaagaagtcacaaataaccaaaggttgtaatgaaaaaggggatatcactacaaatcctgtagacccaaagaggataagagactactaaaaacaacttcatgtcaataaatataaaattttagacaaagtggagaaatttctatgaaaatctaattaataccatcaatgaagaaattaggaatgtgaataatattaaagaaattgaatccagagtcaaaatctttccaaaaacaaaactctaggcctagatttcagtggcaaagaagaagaaataacaaattcttccacagaattaaaaaagaaactattccctaacttgtctttagaggcaggcgttaagtttgataacaaaacacaacaaatacattaaaaagaaggattattgccaggtgcagtagtgcatgcccacaatcccagaactttgggaggctgaggcaggtggatcgcttgagctcaggagtttgagaccagccttggcaacatggcaaaaccccttctctaaaaaaaaaaaaatacaaaaattagccaggtgtggtggcacgtgcctgtagttccacctacatgaagcactgaggcgggagcccaggaggttgaggctgcagtgagccaagatcatgccactgcactgcagcctgggtgataacagtgagagcctgtctcaaaacaaacaaacaaacaaaaacaaaaaaggattattatgggttaactttactcataaacacatgcaaaaatcctaaacaatatcctaactacaacggaatcaagtaatatagaaaatgtaatataaaaattttaaatatatgaaaagttggatttattgtagtagtatgatactactacatacacataatataatgatactactacattataatgtagtagtctaatgtagtccattagaaatggactcagtgtaatgtgtcatatcaatgcaataaaaaagtctgataaaacctcaatacatgcagtaaaggcatttcataaaattcaacattctgtcacaataacaactcttagaaaacctggaatggaaggacacatgcttaatctcataaagtacctacaaaaattctatagcaaacatcacacttggtggtaaaaggttgaaagcttttcctttggggctgggaacatgccagtaatgatcactatcaccacttccattcaacactatactggaggttctaacttacataagaaaaagaaagaaaaggtataaggattacaaaagagcaaatgaaactatcattattcatgaatgatatgactgtacaggtagaaaatccaaaggagtccacagaaaacttattagaataagtgaattcagcaaagtcactgaatacaagatgaaaaataccaaaatcaattgtatttttatacaataagcaacagaaaataaaaattttaaaataatacctatgattgcatttaaatattaaatacctagtagtaattcaaactaaagatgtgtaaaatctcaacgtacaaaactataaaacacttttgagagtagctaatgatctacatgaatgaagagatatatcatgttcacagatgggaaaaatcagtatcgtaaaaatgtcagttctccagaaggcaatctatagatccaatgcaatcccaataaaaatcccaagagaattttttgaggctgatttcataatttatatggcatataaagagccaagaatagtcaaaacaccactgaagaaggtaggatgacttattctaccagttatttttagaaagctagggtaaataaaatagtggtggtgttggtacaaagatagtcaaaacagagcacctagaaacagacccacacataagaaggctcccaatttataataaaaggggaactgcagggcattgtggaaaggaaaaattttcttaaacatgactttaaaaggtattcatcctaaagggaaagactgattaacaacattaaaatccagaacctgtgttcatcaaaaaagaaaggaaaaaagcaaaccatagaatggaagaaaatttgcaacaaaagtaacaataaaggatttgtatctggaattcataaagaatccctacagaacatcagaaaaagacagacaatccaattagaaaaacaggcaagagctttgaacaggctcctcacaaaagaggatacagaaatggccaacatgtatatatacacacacattatacatgttagagtcacaacaaaaaatacaatttttaaaaataacacacccatcagaatagctaaaattaaggaatctggcaaaagaagtgctggaaggaggtggagcaattgggaattcctacacattgctaacatattaacaaccattttggaagaaagtttggcattatctactaaagctgaagacacatatatcctgtgaccctgcaaatccactcctgtatatttctccaacaaaaatacatgtatgagtccattaaaatcataattccccaaaacacaacccaaatgtccatcaacagtagactaaattgtggtataatgcatacactgataaactatacagttatgaaaatgagctacaacaaaatatgaataagtcttacacacataaggttgactgaaatgaatcagagacaaaataatacatcttagatgataccatttatataaagctcaaagttaggtaaagcaaaactacagtgctcagggatacatattttggtagcaaacaaaaaataaagtaagtcattaatgtaaaaatcaggttactgcttacctttggaggagaaagaggattgtgactagaaagggaaagaggagagcttctggggatgctggcaatgtcctatttcttgagctggggtggtatgtggatgttcatttataataattccttaaactgaatatgtttctgtgttttgtatgtgttttgttgttatgtatgtgttgtattttgcaataaaaaagatatttaagagttccttttcaaagttagctatttatggaaatatacgaatagcctttgaaaattatgtgactttaaactgacaaatttctgagttgagtttggcaagaaagaaaggaaaagtgctgtctcaaaaatagaaatccatgatctagggcaggtgatagggtaaaggctggagggtagttctaagggcattcaggctaactcctccaaaactaaaacacttaatgggataaaatcaggaggattacaatattgctattccacttttagttctaaaatcaacaaggaaaaaacatgttaagaaaaacaagctaaaaacagaagatcactctgcaaatttaacaaaaaatgacaaagtattctttatgttataaattccaggacatcatccagttccatttgacattgactatttctagccaaatgaataaataatatgatttaaaagcctcaaggagcttgaaaatctgagtttattcctagtgtccacattccagtattcaataaaagagctgccttttttcagtgttcataccatcagctggccaccggagtatttcaccatgagttagctgcaaatcttttaatatggctaaagaaaatcaaacaagctcaacagatctgatctcttttaagaagcattaaacaaaacaaagaaaaatggaaactcctacagcctagaattatcttaaaaagattaaagtaatttttaaaaagttgattacatggagcttttagaaacatgagaaaatactaatattgtgttaaaaacagtacataaggttgtataccattggttttaaaaatgagtaatacaaaatttgcaaatacactaaattattaacagtagtttcctgactggaataatatccttcactttcccactttcctaaaataagcatgaatttacttttttcaaactggaattttttcttttggatccatgttcactgtatattctcttgtagtgtttttttccataattgtttttctaccaccagtgtgtcacagagtgaaaaaggcaaatattttcttgacagtatcataaaaataaatttgaccttgtagacctccctgaaaaggatctgtagataacactgagaagtggtttatagtatcctttgttcatttttcactgggtagctaatctttctatttacttataggagcttctctttattaaggaaaattagactttgaaataggaattgaaaatattttcttatggtacgtcacttcccttttactttccttatggtcatttttgtcacacaataatacctggtttttgttgctgaacctttcaacttttttctttaatggtcttatataatagcaaagccctgtccaagattatatttttccatcataatagggattgtattggttttgactgatcacagactacatgaataatttgtacccaactcttaatgcaagtactggaaaaaatataaagccatattgtcatcctttttctcagtaactattccagtgacttcctggcttaaactttgcaggcaaactgttcctaaaatgagaatatcaaatacaattatcttgaactgttgataagtagtaggtctcaagtcctactaaatcacaatttaatattatatacaatacccagatttccaatcctttatagcacattaacaggattatcagaaaaatctggactggactaccactaccaaagacatcacagataatatgcttttgacagagagccaagatcaggaagcagtttaagacattattaggcttatagagagctaactattctcagtttgtacagaaaaataaactagcactgaattcattcctttcaagtgggaggaagtggagttctcttcttaaaagctgtgttttcagagctctaaaaaggtacacttataaaataatttaaaaattcttctgaattgtacaatgagatactgggacccctgacttaataagagatctttaatcacacttaagcttctttctggcttgttttcagtttctgttttatgaagataaatgttttttggttaatctctttccatttgctccccttttccctttttatttgcacttttttcaccctaaagatgtatcctcttcagccaccttttatggcttggtttcaacttttgcatgaaaaggtttagctgataactttgctgatttccccttgtgctccttcccgattgccctttgagctgagttaaactacttggatattttggcagtattaaggtagagaggtagggtacttgagttctacaggatgcagggcagtgagaacctctgccaggatggagtgccagagctgtacttccagtacttttatgttttagtctttgatgtgaatcaggttttttttttctttctttctttctttaaagatacagggtcttactcttgctcagcctagagtgcagtggcacaatcatagctcactgcagccttgaactcctgggctcaagggatccttctacctcagtgtccccaattcgtcggactataggcatgtaccaccatgcccagctaactttttaaattttttgtagagatgatatctcgcattgttgccacggctggtctgaaactcctggcttcaagcaatcctcctgccttggccttccaaagtgctgggattataggcatgaactactgtgcctggcctgaatcggctttttttttgtttcttttcttccctacatggatattcattttccccacatcatttagtgaatcccagacctttgaaatgccactcacattataatcctttatttttctcttttagaattttcctattctgcttctttattttcttatgaattttagtatcaacttgtaaagatccccaaagtattcttttgctgtttttgttgagacctcatttgtaagtagttatgaaactctttccttgtctgtgtaagaactgatctttggtcaaatgttctagctcaggacccctggaaacctgataaaggcaggatgcaaatgatgttattaggcaacatcacctctggcaaaaattaatctgattgataaatcgcatctggagaagtaatttataaatatcccataggaagtcatatatttccaattccctgaaagtggagtctgttgtaactggacataccccttgaggggaccctggaaacaatatctatggaatttcacaagaggttaattcctgtacaggcataaaacttctaaggcagaatagttctgcatccattggatgtggagtcctttttccttgcacctgagttgtgacttagaagccaaagataactcattgatggttgtgtggactgctgcaagggctcccacacgaggatgatcttaggctctctgcaggcatgctatactcccagtcccatatcctcagtgattctgatgccaagtggagcccatggtagtcatatgagtctgaaagttgagcctaagaaaatatcctctttccctcctagtgggtattgaaacaatatatgaatagattaatttagaagaactgacaccattacaaaatttagcctttctttccaaatgtatttaagtcttcttttgtaatatttgaggttttaaggctttctttttttgttttttttgagacggagtcttgctctgtcgcccaggctggagtgcagtggcgcgatctaggctcactgcaagctctgcctctggggttcacgccattcttctgcctcagcctcctgagtagctgggactacaggcgcctgccaccatgcccggctaatttttttgtattttttagtagagacagggtttcaccacgttagccaggatggtctcgacgtcctgacctcgtgatccgcccacctcggcctcccaaagtgctgcgattacaggcgtgagccgccgtgcccagccttaaggctttctttgtacaaatcttttacatttcttgttaagtgtgttctttggtatttgatgttgatgtttaaagtgtgtgtgtgtacaatatacaaatgggcatttttcttccatcatatcatccaagtgattgtttgcataagtaaaatttattaattgtactcagacaccttattgaattctcttatcatctttaagttccttcattgattttcttgagttttgcatgtatataatcataatggaaatggtgataattttatttctttattttatatctccaattctttttcttaattgctttatctagtaccttcaaatcaatgtcaaataatagtggggataatggatagcattgccttttctgattttaatcagaatgcttccagtgttcttccattaagcaagatgttggattttgggttcagatatattttttatcatgctaagaatgtaagatatccctgttttaataagaatgtttttaaaaagaatgctaatatatcaaatgcttttaaaatatctatgaggataatacgatttttctccacagatcaacaaacatggtgaattacattaacagctatcctaacatagagtcatccttgcattcctaggttaaaccctccttggtcaagatttatatttttatatttataggctattgaattctgcttgctgattcatttttattttattttaaatttttctttattttttatttttttgagatagggtctccccctgtcacccaggctggagtgcagtcatggctcactgcagccttgacttcctaggctcaggtgattttctcatctcagcctccctagtggctgggactataggtgctcgccaccaggggtagtttttttttttgttttttttgttttttttgtagagacggggtttcaccatgttgcccaggctggtctcaaactcctgggctcaaggatccacatgccttggtctcccaaagtgccggtgatattttaacctaggatttttgaattaatattcatagatgaggcagtcctacatttatatatcaagtgctatctgtgtatgggggtgtgtgtataagaactctctttctctctatggagagaggtccataacaagcataattcttaatggttttacaaatattaactcatttagactgggcatggtggctcacacctgtaatcccaccactttgggaggccaaggagggcagatcacctgaggtcaggagttcaataccaacctggccaacaaggcaaaaccccatctctactaaaaataaatacaaaaattaaccaggcgtggtagtgcacacctgtagtcccagctactcgggaggctgaggcatgagaatcgcttgaacccaggaggcagaggttgcagtgagccaagattgtgccactgcactccagcgtgggtgacagagcgagactctgtctcaattaaaaagcaaacaaaaaattaactcatttaatcctaagtttggtactattaaccaatttatagatgagaacactgaggcatggagattaaataacttgcccatatcacaactactagtaaactagagctaggatttacacccaaaagtctagtccagagtccatgctgtgctctgctgcttttaatatttctatatgtggctgggcacggtggctcacacttgtaatcccagcattttgggaggctgagacgggcagattatgaggtcaggagatcgagactatcctggctaacacggtgaaaccccgtctttaccaaaaatacaaaaaaatcagccgggcgtggtggcgggcacctgtagtcccagctacttgggaggctcagacaggagaatggcgtgaacccaggaggcggagcttgcagtgagctgagatagcaccactgcactccagcctgggtgacagagcgagactccacctcaaaaaaaaaaaaaaatttctatatgcaatttttattagcttttctttgtgtatgcatgtgtgtgtgtgtgtatggggcggggggtggtgaggatcaatgttagactcttttagttaaaaaaaagaccttttcccctctctgctctgagacagcttaaattatattgtaattatgtatttaaagagttggtacgttttctctgtgaaactatttatgtctgatgtttttatgagaggaagttcttagacaactctcctatctcttcttctttttaaattagtctgtttggccaggcatggtggctcatgcctgtaatcccagcactttgggaggccgaggtgggtggatcacttgaggtcaggagttcgagaccagcctggccaacatggtgaaaccccgtctctactaaaaatacaaaaattagccgggcacggtggcaggcacctataatctcagctacttggaaagctgaggcagaagaactgctggaaccggggaggcggaggttgcagtgagctgagatcatgccattgcactccagcccaggctgacaacagcaagactctgtctcaaaaataaagtaaataaataaataaatagattagtcttaggattcttttcagctactcttttgtttgtttttgtttaagacagggtctcactctgtcactcaggctggcgtgcagtggtgctatgttggctcactgcaacctctgcttctcaggctcaagcgatcctcccacctcagccttccaagtatctgggactataggcaaacaccactacatctgactaatttttttgtatttttggtagagatggggtttcaccgcattgcctaggctggtcttgaactcaagtgatccgcccgcctcggcctcccgaagttctgggagctaccactcccagcccctttttggctattcttattgagaaccttgaagacgacccaggaggaaattgtttttatggctaaaaaatagtagctaacatcagttcccattccctatcataaatataagatataaagcaccaaaatttacattaagtactaaactctgagactttgtgagtcctggctcactcttcaagaccccatagtactaatgtcttagagtttgcttcaaaacaaagcctattttggttttaacttaaggtttcccttctgcacaattatatatacaagtttatatgtaagctatatagctttttacagaattaaaccttgttgacttttaccaactggtagttctttctccatctgcttaatttaaactcatcccttaagagctagctcacatgtcacttctacagcctttccctgtgccaccaggcagaattaagtacttcttccttagtattctcaccatatttggcacacagtactgtctaatccatctctccctccttccttttgggacaggctttctaatacccacattcaatcacctaatcatatagatttgccatgctctgtctaaggaagtctatatatgattctatggtctattttttctaagaatgatattctgaaacagacagtcttaattatttaatttgggtgagaattctgtgagaccagtccattacaggcttctcagactgtaacaaaaatattgagagtcaaatgctctaatgtgggggatctgagtgatacctatttgagggaaacaggataccctatttgagggaatcagttgaaactcactttttcattttctcctaagactttaagaagataacagtggaaacaaatagaagatactccagtgttagaatgaataaggcctatgaggagagctttgatttcttctgaaaattctgtaaggctcacgatagcgaaagaatgcaagaaggaatggcaaggcatgattgatgggcacaaagaaattaaatactataaatcgaagtaagcctaaacagtaaaagagactcatggtgataatgaaggaatgaattgcattgcctttagtaaacctgatgactatttagaaaaagacatatattaccctcatgcagaaagtcatgatactttatgaagacccaaagaaagtacacgttactagggtttgtctatgggttaaatgtgtgaggaggaggaactatgcattatctagacagaataataatataactagctaaaacacaaatctcagaatcctaatgaaattttactcaaaaatagcacttcagggcaagacggaagatcactgttgagtgccttttgttaagtcacaaaaataggaaggaactgaattatcagaccacttcctgaggagtttgctttcctgataaggagagatcctttatccaaggcttttttttgaaaagactggttgttttgtgtggtattataactaggtatccaagcttgttcaaaaatcatatcccaatgcctgcagttatggttcaccagataatcagggttagtaagcactttaaatacagctagtatctgtttgtaggtatttatatcttgcatatgaaaaggaattattctcatcaaatatttctgtgaagtgcagtgagccggtagtattatatgtattatagtgcagtggttctcagagtgtagcccacagatccccagcaaagatgctggggtgtgatgatgtcctcaaaaccatttcacagggtctacaatgtcaaaattattttcataattatactaagatgctatttgccattttcacttgttgacatctgtactaattacatacaagcaattgtgggttcaactgctgtcaccgttacgtgaatcaaggtaatgataccaaatggttctagcagtcttcatattcttttgctaccacacatttagtttttaaaaagtcagtttcacttcatgtcattgaacaagaggtgtaaattaattttatttacttcttaactgttaaattaactattttcaactttctgtatgattaactggaaattacacatacagcaactctgtcacatactaatggttatctcaagaaagagtattagtgcaattctttgaattgcaagccaaattagctgctttattaatgaaacagtatttacaataattgacaaagtttgattattcttcttgagtacgtggtttgaaattatatgaagggaatctgttactgcaagtgaaacaaatggcgatatttgttgtcagtgagtaaatttcaagctttcaaacaaatatgagaattttggaaaacttgtatctgccctgtgagtttgacagcttcccatatggtgtgaatgccaacacccaggatttagccagaagatgtaaccatatcttgcaagggactatcagtgcctacagaaatgagatagaactgagttcactgtcaacagggtaaactggagctactacttatctttacttagcctactgacaatgagccggaatagcagtgttgaacaaccaagaaagtggactgccatctcaacaccaagatatcatacagaattctgcctcccctatcactcctcccagtctcaacatcaggggagaaagggtcaagaaagacgaaaggcagaagtgtctgacaaacagaaattacccacctaccctccaaagttttaagttccagataaaggtctagtctgccctgggaggaagtgagaagagcactggattaaaactgactgaagttttaatatgaagagaactgactcttaaatactagaatgaaatgaatttttgaaaattatagaattggtttcaagatgctgttaaggtaactgatatctaatgggaaagggaagtttgacaggctggagttaagaggcagttatagacaaaaagaaaaactgacttgtattagcatcccaacaagttaagcctcctcaataaaatggttacaacacaggtggacagttttccacaaatattggtgttctcagccttccatcccccccattcctttttttgtacaatcaatggaactgaagagggataccagcaatgagatcctggtatgagttctagcataccataatatttaagtctagaactagtccaccaatttggattagttcactcctatttgtagctctgtctgataaatgctaagtggataagaaccatatttctacatctgggaggacaccatcggagtcacagatatgaatggacaaataagcattactaatgataggagatgctgaaagtaatagtaagtatttcaaataataaagtggaggagattgctgggaacacagctcatagagcagaaattaatttgatatctcaatgcttttaactttcaccttttaatgattcaaccaaagaagaaacccaaaaggaggctcatctaacaaagaggaaaaaccagtgtattttaaatggatgctgttcaactacacaatacagaggaaggaaaatgaaggatctaaagaaagagattaagagaaaagcaagtgaaaggtaatcaaaaagtagaacctgacttggggccgaacatggagggtggacaggcatgaatgatagacagggcggaacaattcctggatgaacgagagacaataatgtagagtggctgtgacacattgcattattaatacataccgagactgaattgcgggtaatgttcatgaatctaactgcaattagtacaggtttctggattaggaaggacatgaaaaggaaagcagaaggttagaatgtacatgtcattgcctcattaaaagagaaggtttaatcttgcaatggactgaatatccatcttctgcagcactggaaaaaagcgcagcttatctatctgctttgaaaagtaggtttatagcaaaaggctcttcccttcctgcctggatagccaccactaaattgggcctctcagaactgagctcctgaaaattcatactacagaaatgtttcacttttaagtgggatttctgtttttaatttctggggaaaagatttagatagtatcccctatgatgagttttatttaatatctttactgcctgcaaaaagcccatgcttatgtttgtttttacagaagacccttcactaccttaatcaacagacctttgttaagcacttattctgtgccaggcagattaaataataaaggaagaaaaagaattattttagtgctaatttgcaaactgtgaagatatgggaggaagtactgctggacccctgaaagagtaagggcatgatgaagcctgcttctctttagagatttattgggaatctgaaatgcgtgctcattgtcacaattttattttacaactgagaggaagggtggcaaatgggcaataaataaaccttaatgcagcagttttccagttatcctgaaaactgacttcagggtaacatatatggataactccagttctcaatgaccactaatcaataaggctgaagctattgattagtggtcattgagaactggagttatatgttactggttgcaaaggaagatattaaaaagtgggcaaaccaaggaaataaattatcggttttacaaggactgtctcaaaacctaaccctaaactcaaagaaatactttttgattacagtagactcatagatggaattccatttccttaagaatcaaatgattccatttaaattcagttacaaatgattaagttctctacatcccaggggtcttggcaggaccaccaaaagtgacacgattaaaggcgggaacagacagtggaaggaagtggagaaaaaagttagaagaggattacgttttcatagaaaggacatgaaaagaaagcaaggcagattattaagacaccaacattttatctaaatacttgatttgaaaaattctgcacacttaatcacatagattctataatgtaactaaagagagccagcagattaaacatgaggaatccatagcaccttgagatttggtgacgttttacttgttttttataaaaaagattctgataataatccttgtatacaccacaaaagcacatttaaattcccaagacaactcccatttttccactattccatgtgttgcatcttaccattgatctacgaatcagtgacaacctggtctttgccttattctcagcaaattccaagctactgatatctttgagacgagccttgtatttattcatttgttccacaacaatcagttccacacaactgaaacagaaggaaagagaaaaaaactgttaagaggtgaagtaaataaagtatagcactcacagactgtttttgtggtagacagttgaaagatgaaggaaaaaattaacatcccttacttgataaactcagagacaaggtttagaatggtggttcacaactttggctgcactttagaagccatctaaagagcagttatggctgagcacagtggttcatgcctgtaatcccagcgctttgggaggccgaggcgggtggatcacctgaggtcaggagttcgagaccaacctggccaacatggtgaaaccctgtctctactaaaaatactaaatcagccaggcatggtggtgcacgcctataatctcagctacttgggaggctgaggcacgagaatcgcttaaacctgggaggtggaggttgcagtgagccaagatcatgccactgcactccagcctaggcgacaagagtaaaactccatctcaaaaaattaattaattaattaattaaaaataatacaaaataaagagcagttacaaatcccaatgcccaggctacacgctacaccaattaaatcagactctctggggatgggatccaaatattgatatattttttaaagttccttttgcagtcaagattgaggagagcaaaagaaaaccatgttagaaggaaagcagagcctcaagaaaaaagaccaaggtgaaatacaggaatactgaagtattaagaccaaaggattcagagccattaagaccacagttagactagattacaggaagatactaagtgtccataatttggtaaaatggaaatttaaaatctatttagaaactacaagcagtcctaaagaaaagccagattttaaaaataagatgctttaagacaaatgatgctcagttgaatccaggagtttgcatcctcagcataagaaaacccagcagtgtccaacaatcttcttaaaaacacctgaatttatgaacccattcactatgtttgatatctggatacagtgactacatagtcagaagtccctgaggtcttgcaaaggttatggtaactggccttacgtggtagtcttactgatgtcctgtacactttgtagtgggtcagtggtgtcagggcagcggagaatgcagggcgcaaacacaatggccaaagcattagcagacattcgattagtgtcttcctgcagagcaatcctaagaattaaaacaaaacaaaaaacaaatgagtaagggataaaaagggagcaccatagggaaataggcagaagagatgagcaaaagaagacagtatgacatgaactgcatagtactagaaggatatccattaagtttaagggtctgcagacttttcccaagttgttcctttgttcctttgtctctggaaaatgtattttcacttgttctttccttgaagcagtctaggtcagccgatagcttcccaagggaaatttgtgacctacctgctctaggccaagatcactagatgaacatgtccaaagaatgcagaatcggccaggcacggtggcccacacttgtaatccagcactttgggaggccaatgtgggcagattacttgtggtcaggagtttgagacaatcttggccaacatggcaaaaccttgtctctactaacaatacaaaaattagccagggtgtggtggcgcacacctgtaatcccagctatgtagggggctgaggcaggagaatcacttgaaccggggaggcggaggttgcagtgagctgagattgcgtcactgcactccggcctgggtgacagactgaaactgtgtctcaaaaaaaaaaaaaaaaaaaaaaaaaaaaaaaaaaaagaatgcagagtagaggctttaaccaaaaataaagatggctttcttctcaactactgctgatatttacacacaggggaagagacactactcctgacgcctctttggtcaattcctgagaatgatctgaacccctcatatgaattaggtcatttcaatagattatatatcctttctagttcagctgttagaaaacaggctaaactacacactgccaccatgaggctgaagctgttacatggttcaaacaagggcagaaaagcaactgccatgcattccagctcagctgaatatttctgctccaaggtatcctaaccacctgtttgagacactgactttataaatagaagaaaaaataaatacctgtcagtcttccaaatggagaaattccttatctatttaaaataatccaagagaaactattaaaaatcgttcccttgcttcttaaagttacctgactagatgaaagatgaggcgttccagtgtattgagatgagttcgggagagttgatcaatcacagagtatacaccacggattgtctccttcctctcctgaaggcctaaaaacagtaagagcagaaactaagactaaatatccccccttatacagtgtatcttcctcccagacactatgaagcaaagaaggctggctacagagttttaggagtagttgtacctgtagggcaggagaagagcaactcacagtaactatttaactccttttgcttgagttctatattcataaacagtctccttagtttgaacctatatcacagtaatccttaataacagcaaggggatagagatgttctagtttttcagtcattgtgtagcagattgatttaccattaaagtcaacataatttatgaatcctcagggcctaaatacctctaggaaggcctttatcaatatcctacgcacttacagcactgagaaactaaactctgaaacctgttaagcttggcataaaacagccagctttacacatagttcttgcctagatttccaatttaaatgaacataagcctaatcttaaaacttatttttaatattttaatctgttttataaccccagtctttccatttctttgtaagaagcaaccaagtgtctcactcagaaaatttttaggacactaacgttttgatgagtctctaaaaagtcaacatttgaataggtgacagtatactagccgttttgtattcactgtcaaaagcttacctttgaatctataagaattaaaccactagaggatggcttgataatctatactcaagatggcatttctttcccaactataggccttctctctaacccaggaagcctatgcttacccatagctcgaagaaattcctcatagagttcaaaggtcatgagaggattgggcaaatctcgaagccattgtttgaatacacttgcaatgacgtgtatgttatagtcatctagatttacactctcagcatctatttagagacaagagttagattaacagagccaaaacatgcaaagagattcaaataattcactttagaaactatcatcattaaaggaaggcttcatgtttcttttttttttttttttttgagatggagtttcactcttgttggccaggctggagtgcaatggtgtgatctcagctcaccacaacctctgcctcccgagttcaagtgattctcctgcctcagcctccggagtagctgggattacgggcatgcgccgccacgcttagctaattttgtatttttagtagagacggggtttctccatgttggtcaggctggtctcgaactcccaacctcaggtgatccacctgccttggcctcccaaagtggagggattacaggcgtgagccaccatgcccggccggcttcatgtttcttagtcaaactgactaacctattttccacaatgtaattccatgctttggaactgtgcttctaactgtggtgaaagaatacgtcttgtgtatttgttttccaaacctgttgtggactgaaatgtgtaaaataaaagatcatggccaggagcagcggctcatgactgtaatcccagcactttgggagactgagacaggccgattacttgaggccaggagacagaaagcagcctggccaacgtggtgagacctgtctctactaaaaatataaaaattagctgggtgtggtggcacacgcctataatcccagctacttgggaggctgaggcagaattgcttgaacccaggagacggaggttgcagtgagccaaggtcacaccattgtactacagcctgggcaacagagcaagactgtctctgaatgaatgaatgaatgaatgaatgaatgttttcgtgctgaagcactgttatactgctataaacgtctctacatgcttgctctcaatttctgtacttacctggttttggatttgtccacagaccacactttgagtaacaatggtttacatgacaaatgaaaaaacgcatacaggacactttctgaaagtaaggctaattttaagtcattcttagagataaaaggacagtgataactgagcttagaaaatgtaaaggaaacaccttcacccgtttcacttataaactccctaaggatatacagattagatgactggggaagattcaggatgattgattttcacttgtgctatttcaaggtatcagagacaaagtcagtaactgcctgtaaaccaaagtagaccaagtctcttgtagacggaacctcctgcctgagtcttaccagtcattgttattattttcatactcaattcatttctcattgatttgttcataagaaacagcactgaacacaggttcttgcccacacaaggacatgctttactctgtttagttcaaaaagatctattccttcccaacagtggtaaaatgtagaagttgagaatgaaaccagagtcagtcccctgcatgaattccagtactaaaactacagctctacaaagatacatgctcaactcactaattatcagtttgagtaactgtcatcagtgtaggcaggcaagaagatgatacacaggaaagagtaccccttggagtcagaataataaagagaaaggggaaatagattatgaattcagaagatctggggttaactccaatttggtcacttattggcgatcagtctttgggcaagatcttctgtaagcctcagttcctttttctgtaaatggggataataatatccctaattcataggattgttgtgaatattataaaaacattagtacagcaccttgcatcatcatcagcagctcattatttaatttccctataccttagtttttctctttgtcaatcagaggtatcacaatcttactaaattattacaaaaattaaatgagatctgtcccaagtgcaaattatatgctcaatatatgtctgctgagttgaccaaatgaaaccaaagactctttagaaagccaaaaaatgataacaaagcatcacagaaaagaatgcattcttctggctgctaagtaaaggattgacatgtaatgaaaactttaagagcatgaaaggaactatttaaataaaagtatttcattatgatttagagggcactatcttacctgtatctagaccctgccgaagctccttgattttattagtcgaaccagactttcgataaataccttctgtatacagtccatgcatttcaatgtagtttatgagcttttccactactaaaggaacagttcggtcttcactggtcaaacgggacagttcaaccccaaattgtcgagatgacagctctggatcatactaaatgaaagataatttttagtttccaaatgcattcaaacatcttgaaacatgtttaaccatttctttaccaggagctacttttttatttctctgaagttttatgagcatagttagaagagttgggagaaagggaattatgtttaagtaagtataaatgagatattagtttcaatccttttccaccagaatctccaaaagaaaataatggagtgaagaatgaaggcagtggcaaagggctacagcttctcctatcaaaaaattgcttcaaaagcaaaggtgggatttgggtgtggggaaaagggttggattttatatgcaaacagcttgaccacctaccagataccactagaaaatctactaatttgataagaattagagttgtcagcaagttcttaagcataagaatgctttgatgtttatataaactttacggaagtttaactgaaaaatgatttcataattaaaggcagaggtacacacagatcagcccatgactactgttacagctcttttgtatggacttgaatagcgtatctgatatcacactttatttattcatgcattcattcattcattcatttgagacagagtctcgctctgtcacccaggctggagtgcagtgatgcgatctcagctcactgcaacctccacctcccaggttcaagcgattctcgtgcctcagcctcccaagtagctgggactacaggcacatgacaccacgcccagctaatgtttgtagttttagtagagacggagtttcatcatgttggccaggctggtctcgagctcctgacctcaagtgatctgcccgccttggccttccaaagtgctgggattacaggcatgaaccactgtgtccagccaatattatactttattaacctataggttactttatatcctatgtgactgcaacataacagcttacccttaagattatttgaagtaattcactgaaaagaaaaatggcaggtattatctctgagactgaaaattgttttgcaaatctgtctttccttctcctgtaccattgtccttccctaactatatattccattttctcctttaacctgcatccaaccagttgccaagtcaatcagttcatcctctttattgtttcttttctgttctaagtgtcatcaccccagctcaaaactatatcactaaccaattagactatttcaacactttcttggcgagttttccccatattcatatgtctccttttaatatattctgtagtatatataatctgttttattatcctcaaaaacctttagcggctaattagtatatagcaaactaaagtgcaaacattcttgagtctcatactcaagaacttacttgaactgattctaatttctactttccagccttacattcatacatttgtcatttatgtgttaggtaccaaggaaacaaaatcaaggccttctgcttaagactagtagtgttaggcccggcacagtggctcacacctgtaatcccagcattttgtgaggctgaggtgggtggatcacctaaggtcaggagttcaagaccagcctggccaacatggtgaaaccccatttctactaaaaatacaaaaattagccaggcatagtggtgggcacctgtaatcccagctactcaggaggctgaggcaggagaatcacctgaacacaggaggcagaggttgcagtgagccaagatcacgccactgtactccagcttgggcaacaagggcaaaactctgtctcaaaagaaaaaaaaagaaaaagactagtagtgttagtgtgtggagataagtaaaattataaatagattaactattatggaaacacagaagagagacaactagatcaggaaagactgggctggataacaaacaactaatgatcttgaaaagacctgatgttcaaccttagtgttggaaagcaagtaatagataagtaaagaaagcaagatcttttaggcacaggaaatataaaactacaaaggtaggcagagcaaagtggctacggaaatgaagctaccagataattttaaataaaggaataatcagtttattagttttagcagtattatcagtattattttgcatcattcatgcatgtatctacatgctctgcattccagctcttaatccttagagtattaatttcatgtctattttgacatacattaaattatcttaatatcacacaacatctctgaaaagcatttccaagtctaaggcagaataggacacaatcttggaatatttagaggatgcatattaaaagttttgccttgtcactatgtgaacttggctaggttatttcacatttgcaacagaaatacctcctttctacttcagagggttgttgtagagattaagttgaacatacacagcatgacaacctggtatacgtcaaatactgaaaaaattattatagaaatagaatagaataaggcttgctgtaatgattaaattttagtcaaatgttttcctaatgctgggacacagatgtgcaaatacatattctgtttatttaaatccctatggcattagaaatgttatgacttgtggaagcaaaataacaaaatacttttaggtattaaacaaaaactttaaaaataacttgatttgaaactaagtaatctaaagcaaacatgctagaacattctatttcttgaaatgaagagacaaattaatcttactattttcaatggaaaaaaaaattctgagtatttttctaaaaatatatttttatagtttttgtttcatagttatttttcatttaaactaacttcaatgtgtattttaaataaaatctttattgagctgtgacatacacacattgcaagttacagcttaatggattttcacaaagacccagattaagaaacagaatattaccaagcagtttaaaattcccccaggtcccttccagccactatgccctttacccttcacaaataaccagtatctgtacttctgtcactaaaaattaattttacctgcttttggatattatataaatggaaaaacagagtatgtgcaccttgagttagtttaatctatttttgaactttgtttaaatgtactcttttgtctctagctttcagtcaacattatgtttgtatcgacagtttttttttttgcactttttacatttagtgaatattgataggtaaaagtatataaaggtacatggaaaaataatctaattaaactaaagagcttctacacagcaaaagaaactaccatcagagtgaacaggcaacctacagaatgagagaaaatttttgcaatctactcatctgacaaagggctaatatccagaatctacaaagaactcaaacaaatttacaaggaaaaaacaaacaaccccaccaaaaagtgggcaaaggatatgaacagacacttctcaaaagaagacatttatgcagccaacagacacatgaaaaaatgctcatcatcactggccatcagagaaatgcaaatcaaaaccacaatgagataccatctcataccagctggaatggcgatcattaaaaagtcaggaaacaacaggtgctggagaggatgtggagaaataggaacacttttacactgttggtgggactataaactggttcaaccattgtggaagacagtgtggtgattcctcaaggatctacaactagaaataccatttgacccagccataccattactgggtatatacccaaaggattatgaatcatgctgctataaagacacatgcacacatatgtttattgcggcactattcacaatagcaaagacttggaaccaacccaaatgtccatcaatgatagactggattaagaaaatgtggcacatatacagcatggaatactatgcagccataaaaaaggatgagttcatgtcctttgtagggacatggatgaagctggaaaccatcattctcagcaaactattgccaggacagaaaaccaaacaccgcatgttctcactcatagatgggaattgaacaatgagaacacttgggtctatggccatactaccctgaatgcgcccgatctcttctgatctcagaagctaagcagggtcaggcctggttagtacttggatgggagaacacttggacacaggaaggggaacatcacacactggggcctgtcgtggggtggggggaggggggagggatagcattaggagatatacctaatgtaaatgatgagttaatgggtgcagcacaccaacatggcacatgtatacatatgtaacaaacctgcacgttgtgcacatgtactctagaacttaaagtataataaaaaaaaaaaaaaggaaaattcccactagaagaaaaacatctcacagatgtagattcactactctgcattctcttctctctaaaatctagtctcctaaagtacaatttgcctgtgcagctccctgatgcttgccaacaaacttttttagtatttgtctgacataagctgctccatcttagctggaagcaaatgtctcactcatattctttgcattttaattcctgaatcaaatttctctctgtactttgccatgatttgtctactgcaaacaacatgcacacacatttatatttcagatttgcatgctattgtaacaactgtcagtatgtgattaatgaataagaaaatgttgtgatcatacatcgataaaagcctgaattttttaaaaagattacctccttgaaacataaggtatcaaacagtatgtgtacagtatattttagatctctgtgtatccaagagatatatgtaaaaacaccaaccatccatgctggtgaattttgctactcatgtttaaatttgttcatctttaattgtagcttactgcattaaggataattcctagaagatttatgagcatttaaggaagtatgaaacctcaatgcagtgttcttcaaattgtggtttacgaaattaatttagtaactcacatatagtaacggtaaaataattctatgaaaatcaattcatttttgtacatatatcaccaaacatatgaactggatcatggcataaaacatatttctactgtgatttgtggtcaaaaagtttaaaaaccactcatctgtaaaactatcaaaaaggccttaatttatttccataaggcacaaaagaccaacaggtctgttatctattactgataggtgataatttcttacctttttagagcacttggctgtggttttcagacagcacttcttatggcaagcatacttgcatactgaaaaataggtgaggaatgcaacatttttagaagtctgtacatcagtgataataacttatcaagtatactttattttagacctacgtttttttctttaaatctcagactgctgtaatatgacatacatactttgtacaatggtgtaattaaaaagaattttaacccattctattgggtataatgaagttgaaaacatgatcaaaatttctagccacagtcaatgaaaaagctttttgttctttcaaagctgctcatcctgcccctatgccatacagtaccactccccaacaaattccagcaggatacttatctttgtggtttgattcacaaattagtgttcatgttctaccacatatatgctctacaacatactaaaatctcagaaatgcctattaagaatcattcctatagataaggaaggcattactgtcaaagatccctcctgaaatgaaaactaattgggtagcacagtttaagatataagaaaggtcttatttatgatctctaaaggttcagaacagagctctgaagaaccagaacatgaagaatattgagttgtgattgggaagatgggataaagaaaatgttcagagctaaaataatttagaggagtggtgataacccagagtagctgggcagctggtgaacaggaagaggcacatttagaggaaggtattgagaacacagctggcttatgtcattttgttacactagctctggcttctgtgtaccaatacctgaatatcctttcttgagcttgtaaaatataacttgtaggcttttgaaggccaagatcaagtaagggaggccatgtcattgtactggtgaaataatcaggataacaacaaagaaagttagctaattctattaaaaaatcaaatcaggccaggcacagtggctcatgcctgtaatcctagcacactttgggaggtcgaggtgagtggatcacttgaggtcaggagttcaagaccagcctgatcaacatggtaaaaccctgtctctactaaatatacaaaaattagccaggcatggtggtgggcacctgtaatcccagctacttgggaggctgaggcaggacaagcacttaaacctggaaggcggaggctgcagtgagctgagattgtgccaatgcactccagtctgggcaacaaagttagactccatctcaccaaaaaaaaaaaaaaaaaaaaaaaaatcaaaccagcccaacatagtcataaaaaagaaaattatttaaatttttagctttaagttacagaagaaactaaacctacaagaatcatagttacactaaagggtcaaatacattacaaactacttcctattttcagactcattataattttttagactactgataataaaaccaaagcaaaactgctgttgaaccatggaataagtaaatatatagtaatagtggcaatttttctgtggcaaactgctgtcatattggttccagtcctttcctagtatttgcttcattcaattttagcccactagtaaaagcaaagcttcacagaactaataatagcaccagagcagatgtataaaataagatgagtggaggctaaaggttcactgtaagccagaaccaagttgatctacaaagaatctctactcacgttttaggatttatatatttagatatatatttatatgtaaaataatatatatattatatttatatatattttatatatttatattttctactgtaatctgctaaaaggattacagtagaaaaagtacctttttgactgtaatctaatttattcatttatccatccatccatccatccatccatctataggtttatctaaccaacaaatatttattaaaacttactatgtgccatcaccgttttaggcactgatgatataaaaaaaaaaaaaaaaaaaaaacaaataagtttcctgacctatagagcatatattttagaggtgtagactgaaaaacaagaacacaaatacttaatgtaattttgggtggtaataagttctataaagactattaagtctaagtgaaagaacagagaatttcggaggctggaggggcgggcgcagtggctcacgcctgtaatcccagcactttaggccaaggcgggaggatcatctgaggtcaggagttcaagaccagcctggccaacatggcaaaaccctgtctctactaaaaacacaaaaattagctgggcatggtggcacatgcctgtaatcccagctactcgggaggctgaggcagggagaatcacttgaacctgggaagcagaggttgcagtgagctgagatcacaccactgcactccagcctgggcgatggagcaagacaccatctcaaaaacaaaaaaaagaatagcgaatttggggacaaggtggcatttaaactgggggtagaaaagagagctctctgagaaggtgagatgtgagtgtaggcatgaagtaattgaaatattaagtcatactaaaatctgggacaagaccattttagacagagtgaattacatgtacaagactctcagtgaccaaataacatcaaaatatctggtttagagacaaagagtaggtgaagagagtatagcaagagatgaggttaaaaatttaggtagtgtaaataactcctttatgttaaaggagatataagacaactcaaggaaacagaaatgtcagtggttaaaaatattcctcaaagatctctcatacttacatttgcaaacagaggctcggtccattatccatatcaaagaagaacagtattcacagtatgtagggatgctatattgggtggctttaaagatgtgaccattgtgttcttccacctgaatgaaaaaatttagctacttatattaaagccaacacagtaaatgctgccctaacgtggtgggaaatccttcaatctcttgttaagtcttcactaggcactaattccagggggacaattaggatcttttgagaaataacataaaataaaatatatttttcctgctttccaaaagctaacaatctagataaacatgaccaaattatatgaaaaacagaaagcaatgcaacagacatataatagctgtcttacatgactctaatgttacattaaaagcagcagttctcaaagtatgttttctttttctttttttggcttttttttttttttttgagacttagtcttgctatgttgcccaggctggagtgcagtggtgctatcagctcactgcagcctccgcctcctgggttcaggcaattctcctgcttttgcctcccaaatagctgggattacaggcgcctaccactacgcctggataatttttgtatatatttttttttactagtgacagtgtttcaccatgttggccaggctggtcttgaactcctgatctcaagttatccgcctgcctcagactcccaaagtgctgggattatcagcgtgaaccactgcgcctggctaaaatatatatttttttgtaatctcaggaaacttttacagttgaaaattactgatgacctcagagagcttttgtttacatgagttatacctgttaatatttactatgctagcaattaaagctgaaaaaaatttaaagtatatattcattaatttatttaaaatgaacaataaatgtattatacatgaacataacattttaattaaaaacaactatatctttaaagcaaaaaaaaatagtggcaaaaggggtattgttttacatttttgtaaatttctttaatgtctggattaacaaaagacacctggattctcacatctactactgcactcaatctgttgcaatatgcagtttagtttgaaatatataaagaaaatctagcttaatacagatatgaaagtggaaaatgaaggaatataattttttaattaaaatttttttatttgtataaatgtatgtggtacaagtgtaattttgttacatgcataggtttcatagtggtgaagtcagggcttttagggtatcgaccactcaaataacgtgtattgtacccattaagtaatctctcatcatccatccccctcacaccccctcactcttccgagtcagtggagtaatattttaacagtcctttcagatagtaatacggcaccaaaactttacatatggtaacttaaaagttaagtaaaataccataaccaatgaacccttcctgtcctatgacagtaaaatctattgttttggacttaattaaaacttaaaactttaaccttcaaagacaccattaagaaaaaaagataaaccacagactcggagaaaacatttgcaaatcatatatctgataaatgacttctagtcattatattagaatgttatgtaattatgttagaaatgttagaacccaataataaggcaacccaactcaaaaatgggcaaaatactgaagagacagctcatcaaagaagccgttcaaatggtcaatgggcacatgaaaagatgttcaacatcattagttatcaaagaaatgcaaactaaaaccacaatgaaatactacttcatacctaccagaatggctataacaaaaaaggtaaacaatagcaaatgttggtaagaatgtggatagactagaaccctcaggtactgcaggtgggattgtaaagtggtgcagtcacttggaaaacagcatggcagtttctgaaaactggaagcatagagttgccacttgacccagaaattccactctcaggtttatacacaagataactgaaaatgtacgtccaagaaaaaacctgtacgtaactgttcatagtggcattattcatggtagccaaaaatacaaaacaactcaaatgtctgccaactgataaaaggataaataaaacgtgacatatccatgcaatggaattctatttagcattaaagaagactgaactatggataaacacaatgatatagatgaacttcaaaaacattatgctaaaaagccacatgcaaaaaccacagtgtattattctatttacatgaaatatccagaaaaggtaagactatagaaacagaaagtagagtaatagtgcctgaggctagtaaagagcagtgactgtaaactggcatgaaaaatccttttgggatttttctaaaattggattgagatgatgggaaaactatgtgaatttactgaaatcactgaattgtacacataaaaagggataaatttgtggtaagtaaatttacctccagaaagctggtttacaataccaattggtctattttgtatttggacatttaacctgtatatgattttacagtggtacatgttgatcatttggaatatactgattcactaaattaaacttccaaatgttgacacatttcattatacactagcagaaagtcatagtccttaactttataactgacctcattagaaaacttggcagatacaagttttccaaaatttgaatttttgcttgaatacacaagttttactggtaataaatattgtcagttgttttccttgaagtgacaggataactgcatatgccaaaatcttaatgaatagtttaagtaaaaataatgttctgtgaaaaaagtggctagaaacatgctgccacaaaaacttgttcatgaattttcatagcagcattattcaaacaaaaagtagaaacaactgaaatgtccttcaattaataaacagatatatgaaatgttatatatccatacaacagaatatttggctttacaaaggaatgatgtactgacacatgctacaacacgaatgaaccttgaaaacattatgctaagtgagagaaggcagacacaaaaggccatatatatgattatttaagtcaatatgaaaatttcagaataggcaaatccatacagacaaagtagactggtggttgtgaggggctcagaggaagagagaagagggattgagtgagtgctcagaaagtacagtttctttttgggataatgttctcaaattatatagtggtaatgattgcttaacatagtgaatatactaaaacccactaaattgcacactttacgtagttaaaatggctaaatagttaaattttgttatatgaattttatctcagttttaaaaaatgctagatcagcctgcaatctaattgtacaagtaatttcttgagacaaccatcatatcatggttttgcatctttcccatttcattacacagaatattaaagagatgtgaattcaagaatcaaaacttaatataattaacgtttttattatttcaccttcttcagtaaagcttctctatttttcttaaactatgagtgtgtgactgtaaaaattataatgcccattaacaaagtttgcaggcactgccttgattcacgttgatggcagttttacccatgtttgcttttgtgtcaactcaatgaaaaaggaaaatgatgttttattattacaaaaagagttgtaatatcataaaacccctaaaagtctaccagaaacccctgtagaccacactttgaaacgctggatcatatataaactagactcgagtttatacagactatgtatgtttataaatgatctagtacaaaaggatatatgttatactgttaactatagtgattatccgtgctgagataaaacactcaatagtaagtgtaacatgactgggcatggtggtgtgtgcctgtagtctgagctactagggagggtaaggtgggaggatcacttgagctcaggagtttgaggttggtctgggcaacagaccccatctcttaaataaataaatgtatgtatgtaacacgaagttttttttttttaaacctgtatatgaaacactttaaaaccctcttgaaggacacaaaaatagacttaatcagaagaaaagattcaaaataataaagatgtcagttctctctacattaatttataaatataaggtaatagaaatagaagtactaatagatcttttttctgctcaaactagacaatcaaatagttggaatggctcacgactatttagatcaactaatgaaacaagataaaaaagatcaaagcaggccaggcgcagtggctcacgcctgtaatcccagaactttgggacgccgaggcgggtggatcacaaagtcaggagtttgagatcagcctgaccaacatggtgaaaccccatctctactaaaaatacaaaaattagccaggcgtggtggcgcacacctgtggtcccagctactcaggaggctgaggcaggagaataacttgaactcgggaggtggaagctgtggtgagccgagattgcactactgcactccagccttggcaacagagtgagactctgtatcaaaaaaaacaaaaaacaaaacacacacacacacacacacacacacaaaacaagcataatgggaaatttagaatgtaaaaagggtgacatctcaaagttgatgagtaaagacggactttaaaataaatgatgttggtagccattgataagaggcaaaattagattcatatcccacactgcacaccaggacaattccataaagatcgcaatttaaatgtaaaaaatgtgaccactaaattattggaagaaaacactgagaattcctttataaccctgaagtgaggaaagtcttaactatgactcaaaattcagaagctatgaaaaaagaagattcacaagtttaatttcttaaaaatcttccacatgacaaaaaatataataagccaagtgaaaagacaactgacaaaccaggaaaacatactttcaacttatatcacagacaaagggtaatctctctaatgtacagagttgctacaaattgagaaggaaaagaccaaagccaaaagaaaaatgagtaacgaacaaaaacagactgcagttaaaaaaaaaaaaaagcaaatggtacttgagtataagaaaagatactcaatctcactgacagtatgagaaaagcaaataaaaactgtgtagagatacaaactacaaaatgagactacctttattacagagaaatgaagcaatatttatcaaaataacaaatgcattcaccctatgacccactaatttcaattctgggaatccatcacacacacacacacacacacacacacacacacacacacacacacacacacggttattcattgttcactctttgtaatagcagaagactagaagcagcctaatagtccggtaaggaatggtagccagttgtgaaatagatttctgtgtatagctactgtattagttttctattgctgctgccacaaattaccataaattcagtggcttaaaacaacacctatcatttgttatctcacagttcagtaagctagaagtctgacgcttctcagagtcagagacttttagtctcaccaggctaaaatcagatattgacaagggcgtgtgcccttctggatgctctgtggaacaatctgcttccaatctcattcaggttgttggcagaattcagttccatgtggttgttggactgaggtcctatttccttgctgactattagctggtagttgttctcagcctctagaggccggtcacattcccttgctcaacaccctcctttctccatcttcagagacatcaaaagaggattgagtccttctcatgcttgtatttctctgtcttctactacctatgtctcctgcatcatcttctacctcatctctcttactgactcttctgtcttcctcttcagcttttaagggcctatgtggttacactgggctcatctgcataatccaaaataaactgttatgttaaagtgagttgattagccatcttaattccatctgtgaagtcccttcacagcagtacccagattatgtgtgaatgaataaccaggtgacaagaaccttggagggaacatctttagaattctgcctaccatagacagagaagggtcttctgaatatattgttcaatgataaaagcaaagcacaaaagagtactagctgttattatataacatgctacattttatgtgagaaaggatagcaaataagtttatactggagaaagaaacactagaaagttataacaaaaatttaccactagaagacaaagggggttggagttagacttctcagtatatatattttaaaaaaaagtttgaatggtaaaaatatatctattagaaaaaacactgtaaaaataaattatatcagtgcaggctaaggaattcttcttttattcaatagttctactctcatttagtttgatgctctaattatcacaaatttgtccagtggcacttcctttgagctaaataaataaaaagggaatgcttgtctttagagcaaaaattcaactaataaatgtagaatgactgatggaatttttaaaaaatcactatttagcaaccatcacagcaattgattcagtcaagaatcatcaagtaataacaaaactagtaagagtttgaggaataagaggacacttatttacatggtctgaagtatatccccacaagataataattacaagggaaaatagtatctttgctgagttttttgaaacaaccttgcagatatcaaccacaataggacaaatagatatcatatatctcctgataccacacaatgaaaaatcacagcatttcttctgtgatgtttcatgccaaaaatgtgtaatctgaatctaatcatgaggaaatataagacaaactcaaatggaaaaacatgctctaaaaaaactgacctatgttcttcaacaatgccaatgtcacggaaactaagaaggctaaggaactgttcttgattaaaagagatttaaaaggcataacaattaagtgtaacaaatatcttgttaaaaaggaacaatagtgggatgaatggtggaatctaaataaatctgggttaagggatacggtttatttgtacttctcttgcaacttttctataacactgcaattatattatgtcaaacaaaaagaaggggagaggagggaatggaaggaaggcaaaaccaaaatgaaacaaaaagaactgatccaggacagtgagacaattacagctgctagaacaagttggtagagagtaatgaaaaataaggctggacagtagtgtagcagggaccatgaaagtctttcaagtcactcaacatttactcattcaattaaacatttatagatgcttactatgtgtcaggaactggcatgaacttgttgtggaaaagaatgctaactgcctactaatatccattctttgtttcttccttaaatacagatttcccaagccctatctgggcatgtgacaatctatctaaactttacttctcagcttctcttgcatctataaatggctgcataagtagctctgaataatgaaatgtgaacatatgtgatgagtgacacttccaagccatgcctaacattatgggctctcttgtccttttttctgtcctgcaagctaagatgggaatcaagaaattgagacctgaagcagtgattttgaaagtctgtattactttcatggtaaaagtggttaaaaaaaaaaaaagtggtaaaagttccaaagtatagtggaagcacaaagaaaggagtaattaaatggttccataggaaaaaaggtgtcacagagggaatgcttgagatgaatacaaagaactgagcaaagacaaaaaaaagaatgatatatttagggaatagtaattgtttctatttaagctggaaaatatgcaacaatagcctttaagactttttagagtcatgtgtatataggggtatacatgtacatatatatttgataaaataaaaagtaatttaagagatttggtactgatacaagaataaacacatcaatgaataaaaagagagactaaaaatttaaatccaaatacattaagatttgagtatactgttgtctctcagtagctgtggggaattagttccagcaaccccctgcagatacaaaaatgcagatgctgaagtcccttatataaaatggcacagtatttgcatattatttagacatatctgcatatccttccatatactttatatctagattacttacaatgcctaatacaatgcctatacatcacttcatttgtgtggattcactcaatggacagcaaattcaagtttgttttttggaactttgtggaatttctttttctaaatattttggattcatagttggttgaacccatggatgtgctgggccaactgtactataaaaatggtatttcaaaccagtgaaaaagaaatatatcattcaacagtgggcagacaactgatacactattaaagaaaaaaagcatcatcccttggtgccttggtccataactcgatcttgagactaaaataaattcaagaatgattaaatatttttgtaggaaaaaatgaaataataaacatactaggccaggtgtggtggctcatgcctgtaatcccagcactctgggaggctgaggcaggagaatcatgagcccaggagtttgagaccagactgggcaacatgctaagaccccatctctacaaaaaatgaaaaaatatttagctaggcatgataggtgtgcgtgtggtcccagccactcaggaggctaagatgagaggactgctcgagcccaagaggtcaaggccgcagtgagatgtcattacgccactgcacttcaggctgggcaacagagcgagacctagtctcaaaaaaagaaagaaagaaaatgtactggaaaaaaggtatgaatggacaggtatggtggctcacaccacccagtactttgggaggttgaggtaggtgaattgcttgagcccaggagtttgagaccagcctgggccccatggtgaaaccccatctctacaaaaaatacaaaaaagttggctaggcatggtggtgcactacttgggatgctgaggtgggagggcacttgagcctggcgaggttgtgaggctgcagtgagccgtgatcatgccactgcactccagcttaggtaacagagtgagaccctgtctcaaaaagaaaaaaaaaaaagaaagaaagaagaaagtaaaaaaaaatgataataattatgtaaataatttatctaagaaggacaaaaaactccagtagcataaagaatttaaaggaattaaaattagtagtaaataaatctactataaacaaagtaacaacataattccactcagaatatcctgaaaacagaggaggaatgtatgtgtaatacatatgtgtataaaatatatataatcatttatatataaatgattttatacggacactgtatttctggaataacaccaaaaaactggtaacagtatctctgggaagaagggctgggaaagaggtctactttataatgtatataatttcaaattatgtttatgtgactttctcaactgaaaaaacttagttcaaaatttatgatgataaaacagaactagaccaagaatgccattaatcctgattgacaccattgcctgtatcaaaccataatggcacaaaaagattggcagtcattttttttcttaagaaattaagtaaataatcaactaacttaaaaaaaatcaagggaggaaggaaaaaaaatacttcaactcatggttcatccatcctagtttcataatatggccttgctctatggtatctcaaatattcccagataataacatcttctctcacagatatccttctaattataaatcacacaaacgttattttcctctactaaactctaatattaaagttgttttcattaaaattttcattaaaaattactttattctgtaggtagaagagaggacttgctatgttcccaacacacagaaatgatactcaaggtgatacattccccaaataccctgacttgatcattacgcattttattcatgtaacgaatactcacatgtacccccaaaatatgtaaaatatatatcaatttaaaaattactttattctgaatggatataatataaacccctgatcaaaaggtacacaaagcaaaataagtctttttcctgtctctgtaccccagctgtctagttcctctttatagaaataatcactgctatcagtatactcccagatattttatatgtgtgtatatgtctgtgtgtgagtacagatattaaaatttttaaaaacatatgcaaatagtagctttctatacagtgtttatagcccttgtactttttttctttttttgcacaaatagtagctttctgtacagtgtttagcccttgtacttttttttttctttttttgagacagagtctcgctctgtcgcccaggctggagtgcagtggcgcgatctcggctcactgcaatctccacctcccaggttcaagcgattctcctgcctcagcctcccgagcagctgggattacaggcgcccatcaccacacctggctaatttttttttgtatttttagtagagatggggtttcgccatgttggccaggctggtctcgaactcccgacctcaggtgatccacacctgcctcagcctcccaaagtgctgggattacaagtgtgaaccaccgcgcctggccagcccttgtactttttacttaacaaaacatcttggtgaatgtccccttttcctttaatgttatgctacatcctattatatagatgtatctaatttatttaatcatttcccaatctatttaggttgttttcagtcttttgccattacaaactcttcttcaataaagaacctcgtgcatgtcagcatgttactgtgaaaaagtgtgattgatatgcctactaaacaaattcttaggtatgttattgctgggtcagttttttttttcctttaacgtttttaaggtttttaatacatcattgctaaagtacattctccaagaagattatgcaaattacactcctatttgtattattgaaaaatctgtcttatgtttccaaactctaggtaactaatttattttcagctttgttcaatgatggaaaaagtagaaaatcactgttacttcactttaatttgactgctaataaacatttatttgtgtatttctagacatttctatgaattgcacttattacagttcctgaattataataaaatagttgttgaataaatgtattcatatgcttgtacatttttattttgaagtgttgttctttcccttattgatatgaataactaatcttttaaggcttaaagtatataaagtgcctaaacatatctgttagtaagaggttctctgtcttccctatcctttcctttgtatacaatctcatttattttcacaaaaatctcagtggtgggtggcattattcctgctttacagatgaggacattgagactcagagcttaagttgtccagtgtttctcaatgagaaaatcctcttggaaaaccaaagcaaaccaggctaaggagttaggtatactactttcaaaattctgtacttgtgaaaaggcagaaacttcgcaataggcaaataatctataaaacagtcagatcgcacttctaacacagatagtggaaaagctgcaagtaaggatgtaaaaagatttgggaattttgtttacaagcaagaggggatgatttataatcctgaatattagtaaggtagatgataaatattctacaattagaatttgcaatttttggcagggttgaatccaggttttgtaggccctaaagtttaaagtttccagaagaaagtaaagacgataggaggaggaggggaagtgggaagtgatggcagcaaatgtagcttaaacagaaggaaccagggggagagtaggaggaaatgaagcttagagaggcagtcacgctcaagatcatgtcaagccttgtaggcatggtaagaactttgggtttcattctgacaaacactggaaatcactaaacagttctgagtagagaaaggatatgatttgatttttatgtttaaaaagtaactatggctattacatagagaactataacgggagaagagtataagaaggtagaccagtatgagactcatagttcatcggactgctgttgatagcagtggaggtgatgtgaaatggtaaggtattcaaaatattttgaaggtagagtcttgatcagactcctcccaaacgccttcatatgaacatgcaacacttaagccaatcaaagcaactggctcaacatagcagcttcttcattcacacacatttgtacatactgtttttcccaatggctagatattgactgtctaaaccactactcacttgtcaagaattagcaaaagtatttttctcttctgtaaactattccttcatttcccctttctgtatccaacagcactttgtattattcctactataatatttatcatacctgacagtaataatttgaaaactttttactgcctccacttgtagattatgcacaccttaagggcttaattcatccttgtaattgcacaaattatcataaaccacataatatatatgtgatatatattttgtatctatgtttctatctattgtattatatatatgatagatattataaatgatgttgtgtatatgatgtatatatgataacatcatatattggatatatatcatatagatgtgtctaatttatttaatcatttccctatatatttaggttgtttgcagtcttttgcttttacaaagtcctcttcaataaagaacctcatacatgtcagcatgtcagcgtgaaaaagtgtgattgtatatattgtgtgattgtatataaacatgaacaatgataaaatttgttcaaatgccttcagaaatgtcttttgaattgaaagtatttataattgtaaaatcctaaataacccctgttttctttagaagggagagaaaactcctgaagagctccttccccacccctagttctgaaaagaaataatattttttctttcatgagtaaacaatttcagttttctgccattttaggaagctatcattgataacaagtccagtcacatctaatcattctaaatttttgtaaagatataaatatgattattgcctaggtacctgataaacttatttcataaatatatccacatatatattgtatgatatacctcagacaactgatctgaaaattacttttttaatttaaaaaacagattataacttaccaaatcagtttcctttttccttcttttctttctttctgtttttggcacctgacagggggacaggagatatatggaaattgtgataacaaagactaacatactttcttacttcattgcaaatgttaagatacttgctcaacaggtaacacaatagtcatttctttattctccaagaggaactgtgcagtgctaataagcaaatgtgagaaaaaatttaaaatctgataaaacataattgccaatgacagcaacagaatggaaggatactttagagattattcttttttaaacctcagttctgcccagaagccaccgccatattaatttaaatgattgttttattttaatcattaattgatttttttttttttttgagacggagtcttgctctgtcgcccaggttggagtgcaattggtgcagtctaggctcactgcaacctctgcttcccaggttcaagtgaattctcctgcctcggcctcctgagtagctggtattataggcacacaccaccacatctggctatttttgtattttttgagaccggctggtctcaaacccctgacttcatgatccacccgcctcggcctcccaaagtgctgggattgcgggcttgagccaccacgcctggctggtattttttttttttttttttttttttttttgagacggagttttgctctgttgcccaggctggagggcagtggtgcaatcttggctcaccacaacctccacctcccaggttcaagcaattctcctgtctcagcctcccaagtagctgggactacaggcgtgtgccagcacacctggctaatttttgtatatttagtagagacggggtttcactatgttggccagtctggtctcgatctcccgaccttgtgatctgctcacctcagcctcccaaagtgctgggattacaggcatgagccactgtgccaagctgattgttttaaagattttacttcccgtattttagctgtagaaaactaccatggagctaaatataaaatatatacaaaaaggcaacatttgggacacggaaaaactcttttccatatgacatttcctgataaccatagtacagaacaatctaaacccaaccttttaaacttaaaaacaaacgtagtagaagcctactaagaatcttcttcagcataaagaccttaacctagatctagaactgaagaactgtccagaacttatttatatctgaaaacttcaaaaatgggattgaagaggttttggaaatttaaatacatataaggtagaataactaaaaataaaatggaacataatcaatacaaaatattgatggtattcttgatatgaataggtatctaattatttcatctggggtactgaaaagaaacacattgataactttgtctaagcctgatgtctcttctgtaatatggattttataaaaattatttaataaggctgaagcaagaattaaataaaatacacaacaccgagtacgattctcaggccgtaacaggcactcaaaataaaaaggttattattattatacagacttcccaaaacacgtattttcctaaaacctaattcaagaataaatataatttgtaggtttttataaagaggccactgggtaatacaatgaatcacatctttaactataatttttcaaaaggaaattcagatacttatctcttttttttttaagacggagtcgcactttgccacccagggtgaagtgcagtggcgtgaccttggctaactacaacctctgcctcctgggttcaagtgattctcctgcttcagcctcctgagtagctgaaattacaggcgcctgccatcatgcccagctaatttttgtatatttagtagagataggtttttgacatgttgaccaggctggtctcgaactcctgatttcaagttctctgccaatctaggcctcccaaagtgctgggattacaggcatgagccaccgccccaccccgatctctattaaagctaagagtataatcttgagggcagaacattatgttttaactcagtgaacaaagtattgattacagacggtttagaaaatatggtctgataaattataagacagaatgaagtttggaggatctaaagtggcgctaagttgacatgttccctgtaatgtttttctcaaaataaaatttttctcaaatttctcaaatacaagatgtcccaaacgctcttaaaaagaattcataattaaatcctttaagtaatcaaaatatatcacatttacctttgtggctgtgcaatctgaagtcttgaattcattcatatattcatctaaaaacactttaaaagtgttgacccaaactctcactggagattcacccagtgaatcacgctgctcaagcctcatcgtcttttccagaatctgttcaaatagtgcatagaggtctttataccgtatgcttttcccatcatccatctataagcaataagaaaagaaatgtatggttttataaagaaactccttaaatatagaggaaagattacacttgtaatggggtagtatttagaataaagattaggatcctgatataatttctaatgagcatgcccatgaggtcatgtggtatttgtaaactcccattctagtatgggatgaatgcagaatcaaacatgctaaattttagtaaaaaacctgacggtaataatttgaggaagtcttgagaatttctcttctaagtgtgactttttaattttatgtagctataaaggttatttgcatccctcttaattactttcctccccagaaatgaaccttgtttagatggttctactctaaaattgaaagaatgaatacttgaatcattgcctaagcatatattaagtaaccaatttatttttccaaagaagagtgacatgcccagaataacatcatattatttgcaaggaactgaaatagaatttcttttatttaaatgagatctggaatttttttttttttttttttttttttagacggagtcttgctctgtcacccaggctggagtgcagtggcatgatctcggctcactgcaacctccacctcaagctattgaatgggttcaagccattctcctgcctcagcctccccagtagctgggattacaagcatgcaccaccatacctagctaatttttgtatttttattagagacggggttttaccatattgcccaggctggtcttgaactcctgacctcatgacctacccgcctcagccacccaaagtgctgggattacaggcttgagccactgcgcccagccaagtagagtataaattaaaaagctttccagatttttctcttcacagtgaattaaagaatatattgaacaatgaaaagccaataaaatatgaattcttttacagaatatgataattcataaacactaatgcttctatagaccaaagcattaattgcacacaccaaaaataaattttctaaaacatgaccagtatcatgtgaaagtataaggtaaatctcaaagtgatataaactgatatgtagaaatcagtgtccataaactaactgccctaattccattaaaagaaaacatataatgcattcctcacaaaggaaaattagacattatagcctagcaatagagctaaaaggattatgaaaagtcacaggcaaaaacagaatcatacccaggacatctgaagtcagtatcttaaaagatgaaaaaaacagctgtaaggtgggaaaaagctactcaaggaaattcaagggagcttttaatctgaaaccattcagtttccttgtctatccctaaaacaaaaaccattcattttccttgtctatccctaaaacaaaaacaaggcactggagaaatctcttacgaaacatggcttttgtattatcttctacagcgctatcaaatttttcatatgttgaactactaaatatctcctaacatagtccaactcaccgccaatgcagatgaataaaagctgaagatattctgccgaaattccttcagggcttttttaaatacaacatccactagtgtatccttcttgctgtcttcattatctaggtcattcacctgggaaccacaaaacgagttttagtacacaatcaactaattgaaaagaagtaaatacaacagtaggcatgtattgttgcttccacaatgactgtcctcaaagtgcaagccacaggctattataggactcaggtgaaagttatgactagacagtcaaactataattactactctatgatttctaaggttccttctaacattgtatgattctatagttctgttacaagaaaactcccgtgtgcaacaagctgtaccttcccatatgaaatttgacaattttaggaaaattaaagtcactactaaagcctacaaccttaaatcctgtctacccagtctaactaatgcatatcctattattcacacctttctggtaaagaacagatcatctaaagcatggaagcatatgtaattttgatatctagagagtatatcctgatatacacaagtattccatacacagagctgctccagggcctgacgtggcaaataaagtgtacctttttcagaagaaattcatccatgctttttaaatcactgacacttgctatgatctggacagagtcattttgccaatgcatagaatccaaagccacgttgctaatcttcacacttcgcttgcgcttagcctttggagaaggttctttgttctctttgaattccttccggcaactgccgggcagttctgggctcaaaggaggtgttgggtgatatgcagctaattctacaattcaagatagaagacccaaaaggacacatttagtaaatatattgataatcttcacatccttctttttaaagttcctttaacaagtcactgaaggaaacatgcaaatatatgaatagcaaagtaacattaatgtttgaggttaggcagctaagcaataaatccagacagcacatttgtacagaaagcgtatttaaaaattaccacttttcaaagggagatgatatcatatctcccaagaagctgaagtctgatattaaaaacctggatagaaatgctttgcaggacgtcaagttagatcccaaagatctcagtcccaaagaaaagaagagaatataaaaccatactagcatattaaatgcttactgttaacaaagtcatagctttgctacatgtttgaaacaatatgtgtagctatatacaagtccaacaaaccagtggagtttgataattattattatttctttactacagtctaaagtcctgaatacttctgtgataacatttggtgattgctggcaacctgttagggagccaagtaactcaactggcttacttctgcttgggtctcttcagcatttaggattttcttaaacatcccccaaataactgtcaatttattttctctacaatttttctctacaaatgtttacaacggagaaattagattctatgtagcccattacaacttagaactagaccagatttgccaaaccctatctggagctcgatgaaaatgtttacctcctctcatttcacatgcttgtcttcccaatgtgtatgctcgttaccctctgtccaatggtatatcctgattctatccaaactaactttgataataaaggaaaaaagtagccccctacatgctaaataccacctcaggcaggaattgagagaaacccaatttcaactatgacacaagagtaaagaatataaagatacaggatacaattatattcaaacatatatcaactgattttaattctattatacagcttagatatattaagtatctattttatttagcaaagtcagtatctttcttattaataaaataaatgtttactaaagaaattatccataatcccatattagcattaaaaacaaggcctaccttaatacattttttccaaatataaataaaaagctataatcctaagttttatacatgtgtcattatgaagcaaacacacaacaaagtctgcttataatatgaattttcaattagagtttatacttctttctcaagaattagcagcaaagaatataattgtgggaaataaaaaacttagaaggatgactgtcaaccagacaagatataagaaactgataaccttagccattcaatagtagggaattcccagcttcctaaacctgtagtattcatttaacttgttattggttttattcacatccatttctcaactgatagaagcaaagccataagatacaaaaacaggggtctaactacctttccaccattctttcctctggcatagagagctcaagcccattcacccctctgggaagcttgatgatctttcctccttgtttctctattttatcctagatatgagaagatgctggtttcttactgtaactgggtctgttctatcctgccttaagctttcttccgaggacctctttctattttagtcaatgctggtatttcacccacattaccatatatccaccttggatgtatatctctgttgaagaagttggtatctttacgtagtagctaaaaactctcaggcatacctgagaaaagggcttgagaagtggtaatcttctaacattaggataacttggagagtaagtaattttcccatttagagaggtcagttttctgaacgatgaactaactgttgagtacttctcaaatgtgttatgctgcacgcccagaaagttaaaataagagctatgggactgggcatggtggctcatggctgtaatcccagcactttgggaggctgaggtgggaggataggttgagcccagaagttagaggttacagtgagctatgatcacaccactccggcctaagcaacatagtgaaaccttgtctctaaaattgaaaaataatagctattataaagtgccaggcatctgctaggtactgaaatatagcaagtacttaatatacaacacagtggttaagactatggactctggagcaggactgcctagattcaactcttagctcttccagttactatatgtgcataaataaataacttttcttttttatttatttatttgagacagggtctcactctttcccccaggctgaagtgcagtggtgtgatcacagctcactgcagcctcaacttcccagactcaagcgattctcctacctcagcctcccaagtagctgggactacaggcaaatgcctccatgcctggctaatttttatattttttgtagagatggggtttcactatgtgcccaggctggtgttgaactcctggactcatgtgatctgcccacctcagcctcccaaagcgctgggattacaggtgtgaaccatcgtgcctggcctaataaaaaaaattctctgtgcctgagttttctcatccataaattgggaataataatcatactaactctcaaaaaactgttgtgaggagcaactgacttaataaccataacatgcttaccacagtgccttgcatgtagtaagcattcaaatattagctgctattagttataaccagtaatacatatttgttaaatgaatgaataatggctacatttttttagtttagaaaattaaggctaacctatgatacacagtcatttttgaggtggttgctgcttcattgttttgtgatgcattttttggaaacttctattgtaggaaaaatgtaactttattttttagttaaggaaggatttaacaatgctggtcctatctcattagaacatccagccaacaggattgacattatgaatactacaggaatagcaaactttcagaaagagtgaacagaaattatgaacacaagttccaccctttggtcacttttaccatctggaaactgatgagctggaatcacatctgtgcctgcaaagagtggcgaaacctctgactgggtagtaggtttcactctggtagtcttcttctccccttgtttccctttggcccagaatctcatcttagctctctgaggtctgtttaaagaaataaaggtaaaaatggaaattaagagtatctcagtgataatatttgtatatatcactttaagctttacaaatcttctatgtatattagctcatttaagcttcacatttaaattaagtgtatttatctttacttttgcatttaaacttcacctgaaactgaaaggcgaaaaattatttaacttctctgggttttgttatttctatattcagatgaggaaacatcttgaatacagaaataacaaaacccagagaagttcaatattttttctaagatgaaacagccacaaagcagtggagctagaattctaactcaagttttctaactcccaaactggtttattttcattcttgtcccccatccagcttggatttagtatatacacaatttaacaacaaagaaaatactttttaaagaaatcacgaataatcctaccactctaaaaaacattagtttacctttgtttgtcatttccttccagtctttatccataagtatggcaagttttacatcactgttatcatgatgcacatagcattttaaatctttccactcaccattacataataaaagctttaatgtcactatttacattcatgagttattagtattattaacagccacttatttgaacttgtatctttctccaggcacagtgcttacaaaatttaattacaatatcaactttgcttttttcttttttcttaaagaacaggtgatagtaacaactttgcttttaacaaactactataaatatgttacaggtgaaaaactggagacttatatattaggtaactttcccaaagtttcacagtgagtgaaaaattcagaaccacatctattatattgtattgcctcttcttagtgcttgtacacgctttcatcatctacatcaaagaagtaccttgcgataacaatggcatgtagttactgaccatatattatgtattctaacctcatagttggaggtttatttgtaaattaatttatctgttcatttgtctgttcaatcattcaattaaaaaattttgagtatgtactaggtgacaggtactatgccttatatatgatattcctaatttcacaactactgtgataaacagtattatccttactttacacatgagcaaactaaggcttacaggcctgatggagatggaagttaaaatcaagtctatctggttttgaagcccatgagctctttctttcttcctttttttttttttttttaaaaaaaagcttattactaaactcatatatttatacattaaaaagagaaattgttctacaagactaattaaaaacaacagtatctctctgccatgctcaccccattttctgctccctagaggcaacacttttgaattgctttaactaattcttctgatatttagtgtgcttctgtaactatcatactcatggccacagataatgattaggcatgttccaccattccagtcctaaccataaacatgtgcccccaaaagaattatactgtaattttagttagatcaatattcagtatttacttttaatgatattcagtatttatttttattatgtaaataatattcacagttgagggatgtaattccctaaataatctactttattctagaggatttttaaaatttgctcatgaaaactgtttgatttttcatttcctcacttttctatatacaattcacctccacgtgtttccccatttctatcaactctcaatacattcaaatgtattaggtactttatcagtttcatcttgttgaaaaaaatctctcccagagccttctaacttgctccaatttggagtggtttccctcattgcctgctgtgcagttgtcatttgaaaagctactttcatcattgtaacagattccttttgtctcttttgtttcataacaacatgtcttttggtatgggtctattttcatccactatgttgggcactcagtggcgtcttcaaatctggaaaatcgtgtccttcggttctgtaaaatttggctgaattactttttcaataatttatcctccgttttctcggttctatctttccaaagttcctaccattgggtcattggatctcctgaatggagcctctaatattcccatctcttccatttcttcattttttgctcaacattctgagatatgtcctcaaatttccttttgattcttgagttgctcctttatcatatttttaatcttcaaaagctctttttattatgaatgtttctctttcatgcaccatttggtttcatgaatacaattgtatttgttatgcaaaaggcctgttgatagttacatttgtctatcttgaagtgttctattccctgtatagtttatttcttccaagttgtattttatctgttaattttggtttcttcaatataaggtatttcctcaaatatacggtgatcagtggtatgtgattattatttaaagtagggtaaaaaaaaaaaaaaaaaaaagaaagaggctgcttggaagctctagtgtgccttggtgggcctgctaaagtatggtcttccttacagggttatctggttggttgactttgcagggagagctcctgatagtaatatattcagggttttccctaagggctagacagaagtccccaaaactctttgaaccatttgcttagaaccatttgcttagagggtatgggaaatgaagaaggctggcaaatcttaacattctgtatataaacagtcattaaatccctatgttccaaatatgtgccccagccctcaattgtatctagtaaactccaggtccagagatactctgttttatactttccagataataaatttcttgttctgctataattggggaaggtcagccagctagatgtatctttctcagctttacttagctggattaggatttggctttctagtatgtattaacatatttaaaatttaaagtccatttactttttggattccacagttttattgcagttgttttcacttctaagtttttttgagggggagaaaagtccttcgtagattttgtcattttagcaattgtgggggaggacgtggaaactaaatatatataatctattatttccagatgtatgttcttctactgtgtcacatcttatttctcaatatttggtttctagtattatctgctctggatttggattaccttagattatacctctacagtcagcgaaaaagtggtctttaatatggttatgaaccagaaaaatttcaacataatcttgtaagttttctgcgaggcccaaatgcttatacaacataatgagggacaaagatatttatttgaaaaataaaaattccataagctctcttaaagagaacagaattatctcctgaaaggccttttcagttccatttctaaaatgcttacctcagaacagaatccaagtccaaagctggcacctattttcaatcttatttagtctcattctcttttacaacaaaataccataagtcatgtaacaatttggagactttccccaaatcatactgctaagtatagagggagataaagcccattatactgaagggaaccagtatgtgccaccccaaaatattcctctttgagataaatatttttaagctaaaggcaattaagaagtagatgcagaaaagctctctaccctcccctgttcgcctaaaagcaggatataaatttgaaaggtgttctttcttccctctctaccaacaaggacagaaaatcactggagacagtgtagacctttattagctagaaatgacatcagaggaatctaccaactttactccgttagtttccccataaatttaccttcccagttttgttacctttggaagcctgaaactgcttatctttgtcttgtcacttctctaaaattaattgttcattgttgaagacaatgtataagccagattcctaaaccactgttttgagttacctttcctctgcatgatgtgcatgcactgtatgcactaacttgcttatttttctcttgttaatctgtcttttgttacaggattctgtcccaactatgaacttatgagggttgagggaaatttttcttttcttctcttcaacacatatcttaactactatgtgcctataaacagtaggtacttaccatttcttgaaaaattggtaaataagtttaatttcaaaagtggcctatcaattatggtttttttaaaaaagctcagtacttaactatagtcagttatcaaataaaattatataacccctgttaactccgtgtatactttataccttatatctgaatctgaagccttctgtctcactgccaacttggtaatctctccttgagacatagtcttatgaagttttgcttgttcatcaactgacgaaaatcgctgtgatgtctgtaataattacatatgtgaaagatttaatgccaagtaaatatatgatagcactgtaatttaaattcaggttacagaattacttgagctatttaaaaacacacaaaacattgatattattcagagattcattgaaataatagagcctactgaaaactctatataaagtaatctgaaataaagatgacttggtcaatgaaaataaacaggatctaccagttcatattttctgacaatttaaaaaagaatctcaagtggaaaggcaagaaagtgaaaaccatttaaagatagagacaaaagatgcaggatctaataaatctagaacgctaagtattgtttttcaaatctccttttatttatcccaaaaggtggttattactttcatggcttaacttgctattataagttcttcatatatctaatcaataatttaaaagagatggaatatgcaatgatttttaaagagccaaaagatgacaggataaaggctcattaccattattaatggtctaaattataaacaacttataaggctatcaaactgtgacctgatttttaattggcagttcttgttccatttgtttaaaatgtgtccctctaaagacaatcctgttctgaggagagaatttcttgttatctattcaagtcatttcctaatatttcatttttctgtagttataatattctttctttagccttttggtctgcctcactatggccttattaacagaaagaggaaataccttaagttggcaaagatgaagtaatagggatctggtctacccacttacctgaaaccaacaaaaaacccagacaaaataatatgaaaccgcaatgtttaaaacaatggacagatacccctgagagatgggaaaaaagggaagtatgttctacacttgtttctaggctgtgatgcagagaggaggaacccaggtgaaacttgacagactctaagtggaacacatgaagctgaaagtccaaggtgagcacagtgactagagaccaaaagacagagtactggagaggagtgagaagcacaaagatagaactctagagatctacagaaggtccacattgaatgttcagcttgagtactaatcaacactttgtatgagaaaacaatccaagaccaagaaaaagatcacttgaaaggattaaaggtaattgagcccatcactcacaaaaggtcagtaatagtgtctatgcccaagagccagagcatataactttatgattcccagggcactgggcaaagtatagagaggatctcacctcaatagtcaagaataattagccctagactgagtactgtttgggtctaacaaacctttttttttttttttttttttttttttaagagacatggtcttgctctgttgctcaggctggagtgcagtggtacaatcacagctcactgcagccctgcactcctgggccccagttatcctcctgcctcagccttctgagtagctgggactacaggcacatggctctgtgcccagatcttactttccagacctctgtgcaaataaattgaaaagttagatgaaattgataattttataagaaaaaagggtttaccaaaattgaccctgttagataaaaggtttaaaaaagactgatttccctagaagaaaaaaagaaaaacttatccaggaactacaccacaaaaaagtaccaatcccaggtggtttcatagaaaaattctgccaaatcttcaaagaacagatagctgcaatgctataaactggtcctgactttttttagagaaataaaatacacatataaatactaagtgtatagtcaacagtgtggctgctgtcttaaggctgccaatccaaaactcttaagtaatgaactttgttcaataacaaccagttttctaccacgcaagaccaacctcaaaatcacctagcccaggtcctaaaactttatgaatatcctctcctgacttctcccttgtgagatattactaagacacagtcaaagtgggttttctcttactgtaataagctaataaacagctttgtttgatcaacaggtttttctggcagtctatggagtagacatcagagagaaagaaaattcaacacagacaaggatcagagagtatctcagagaatagcagaaataggaatataagaagtgacagcagtttggggggaataatgagaaatttagttttactatgctagaagtaatgaagattgaaattctggagagccattcagaagtcatatccatagagatgactgctttaaatctgggggatgataaaagaaaactgtacagagaaaagtataatgtttcctatactaatcctataaataaggaatagaaatgattttactaacccgcttaccattcagaagacagaaactaaaaaaaaactatcttaaaaacaactgcttagcagaaaacgccattcttcttgagtaaatgccaatgtggtgtgtataaaaatggagtgagagcagcacatagagactaaacagttattcaaacggcagcgtttgaagtaagaggttaaaaaacaccaaagtcactaaggagggaaactactacacttgtttcccctcccacagcaggtaacaactgattaataatttaaaaactcaaatctccttcaattcatttgtgaatgtctttatcccattagattgggttacttcacaattagaaaggtcatacagcaatttcttccaagatttaatgacacacttcagagtaataaaatcagtttgtccagaaaaaaaaaatccagcttttaaaactccatgtacctagaaaatcaaatacatttaaaatccagaaaatactgtgagattgtagtagattttatttagacacaatacatcttcatcttcacaatatcagataatgttagaacgtggaatattctcaagataaataaaaagagaaacacatttaaaaattgttcctacccaccccatccccaaccctggtaagtaactatccacatattctacaaagcaaagcttcttcatgcagtgtccaccagaaacaagcaccaccacctgttcctaaaatagctcgtggtgaaagagaagaaaatgagaaagctggcgacgtgactaacacactgtgcagggaagtgctctacaactactggcatgcagtgaccgtcaagcaggtgaacagaggctagaacactgaaaggagctgaatgctccaagcagaaagcccaacttcctggttcatctcagtaaaagttcccagtgtaaaagaagtctatcaccaaaaggactaagggttgttacaaaggaaactctcagaaacaaaacagcagtcataatgccaaagtttttctgcaaacaataaatctatgtatactagacaaagcaggacttttcatcaaaattagtttgttccattacataatttcgtatttaactgttaatcagataacacagtatatttccttatttataactcaaatacagggcacctccaaaatgctattattttattctacactgaagattttggctctaattatacatattatcagatacacagaatgtttccaatttctataatcctacagttcggctcaggttaatgactcatttatctaatcaggggacttgttttgcatttttctctttttgttgttgttgtttttgccttcataaaacatcacttttgtcacttaaaaactgggtctacctccaacaaaagataaaagacaacgagagtattctggacaataggagaaatttcaattaattagatctttgacaattcaaacagcttaaaacagttcaaagatagaatatttaatgagtcaaataaagaccattctaaaatttttctctgataattgacagacactaaagaatattagagagctcagttacagatatgtatggaaataaaatgttatttcactctacttcatcagtgatgttctggttcatattagacatacggtctttatcttatatatttctaggacaattccaaaataaaattctttgcattaatatacccatcaatatactataatacttgtcaaaccacatatacacctgatttgggctgagaagatgatatagttatattcttagcttaaaatggtgcagctttattcaaacacaacaccaatgttatattgtgtgattaatacaaattcacattacatatagccttctatttggctgggttggtccaggaagacactttttgctcactatatgttttaaaattcatgtttatttcttattagtggaaagtgaggtggaggaagaaagtttacaggcaaaaaatgtaaaagtgcattgtagctaaaagctactggattattttagaccaaggatcagtaaactaaaccacggatcagtaaactatggccaacaggtcaaatacaatccactgtctgtttttgcagttttattacaagacggtcatgcccatttgtttacttagtgtctatggctgctttcacactacagtgggtgagttaagtagttaagttaggtagttgcaatagagactatatgacccacaaagtctaaaatatttgttatctggccgtttacagaaaaaatgtaaggaccactgctctagaccttttaggatacaacatggaaaatttctacattagtgccaagtcaaataatcttaattttgcctaatttgtggctttttaaagtgccctttatttgagttctattaaattaaggtttagcttagttgctgtgttcactgaggtttcccatgcacaaaccattacatgggaagaagctgtgaaggttagctttagattagcaaagactatttccatcagatttgcttgctatttttcttatattgctgtaaaattaccatttcggagtcactgtgagaggcctgacccaggctgggtgcaggccctagctcacagtgagaagcttggtcaagggagagaaggggctcaataatgtcatcgtaatcatcttcctctgtatccccctccccatcggcaaaagtacctctagtcaagaaatcggagcgcgtccgcgccattcgagctttctttttatgggccggtctggcaacctgcttgaccaaatgataaaacaaataacacaacaatgtttggggtttttgttctttttgagatgatgccaatgaaagacatcagagggctcatgaatttcttgaaatatccctccacccaaccatgccctttccactagcagaagtgacagggatgaccaaaaggaatctgtatacattactctggatgaaggactagaatggaagctaaatctacactgttctacatagccaaagaagtcatctttcactgccatagtaagtcaacaaagtctcttgcacaaattgccttctttttcttagcaactgggtttttaggcaccattccctgcctggagtacaccttcataattataacaatctccgctcatggcttctttctctaaaaacacttgggagtaaatgggtagatgaggtgctctacctacaagaataataatttccaaaataatgtacatctcttttgtatagaagatagataaacaaaaactcaaaacttacctctctttggcctggcccagctaacttcacaggtttccatgctggttcatcttctttatggagttgaggatttttactgtttaaggcttctttgctgacactttaaataaaacaatgaaattacatttcagttcttagcagatatcccatggcagccaggttaaagacttccagcaaattccataaatattttcagatcttagtcaattcccaagacaattaagtcatattttttctgcttagctaattagtaataataatcctgaacctacgcataagactgaattactaaaggccttgtcctgatgatcagtgggtatattccactatgaatatgacatatgtttaagaatagtagctgcaaaataaactcaagaaataaaatagatctgatgatggggaaaggaaaataccaaacccctgaatctttagaatactagtcttacaaggggcctttccatctaatcattataaaatacctgaaaaatagccatccagggatgaggatctcattatattttatactgagatggttcttattggttagaaaactccttctgaaatctctctttgtagttttcatccactgtctttgagttttaaaacttgacgttgaggctgggtgcagtggctcatgcctgtaaacccagcagtttgggaggccgaggcaggcggatcacctgaggtcaggagtttgagaccagcgtggtcaacatggcaaaactccgtctctaccaaaaatataaaaattagctgggtgtggtggcaggtggctgtagtcccaggtacttggaaggctgaggtaggagaatcacttgaacccaggaggcagaggttgcagtgagccaagatcgtgccactgcacactctagcttgggtgacaagagtgaaactgtctcaaaaaaaccaaaaaacaaacaaacaaaaagcttgatgttgaatagcctaaaatcaacactggcagggtaagaaattgttatcaaactaaaagtatgctccagacaatacaggtgttacagtgttagcttatgaaaatttaattttgattgaaaaactgtatgatgagaatgctttatcattaaattctgggcagaaatagatgccagaatctgatgaaaaagtgtatataaccttcatggccccaattacctatattaactcagtaccatgagtctcatcaacaacatattgataatctctcctgagcagaactgtaagctccttgagaatcatatcttacttccaaggatagtgctagctaaaattagacactaacttatgatactagttggtagattaattgttcttccattcaaaatctttcatttaatttttataaaagtaagtctaggagccataagaaattatcttgccctttgcctctatgcaataagcccgaaacaaacacaaatagatgcaatctttgctagctataggcttcttagagatctccctttttgagcaatgtatgtacaatgtgtataagcctagcaatcctagcttgttctaaaggattctcttctggctatcaaaatctctcttgccacagttgagcctattggaccttcatttatcctccaaagagaaacaacaattaataggatcttgatagtacttgaccactgcaattaaccttttaactcacaacattttctttagacttcaccatgaattctttttgtcctttctcattaaacagttaaaaactactgtgtactcatcaccactacagtacaaaagggacactaacctagtattactttctaattataaaacccaatgccgatccttaatgatgaaatgcaagttctagtcccagccatttctctaaatacatgatcttgaataagtcatttcacctctatgggccccagtgaccttatctgtaacatgtgggaactggattacataattcagaagcaccagcatttatgattctacaaaatgttaatgtttctaatattacttatacaacaggatgagatttaaagtatgaattttatctgtagagtttaatataatctaatatataataattttaaagataagtagatcattaataaagcaataaaagaaatcaactcaaatacacctacaactatgtatcttggaaaaataagataaatatttcacaaggatgattaatattttttagaatccacaatttgttttttacaaaacaaattcatggatccaacagctactttataagtgtatacacctataatacatacacacacataaatgtcataattaatagacattaaagaatattaaagagctcacttacagatatgcatggaataccatgtatcactaaacttagaatgacagggaatatgtttttaacactctcttatggatgcatatgctacacagagtctttgaacttctgggaaatctgtaggttaatgggtgggaataatacttaaaactgtcattaagctcaactgcactttgtaatactatagagactcttggaaaaatatattattgatcatctcttgcccacatttacaaaggatttctctaaaatccatatgaaattttaaagggtggaacatttaaatgtttgggttatatataaaaggagagaaaaggttattttcattgttaatgtaaaatttatttttaacccaaagatacagccctcctttcatttcaatgatgacattctccataagaaccaaaagaatctaccaaatataaagataatacaagtatcttcaattttgttaaatttgtttttacgtaccacttaaaaatgcttttctcatgactacctctagtttaaaaaagtataaagaaattctacttacggctgggtgcggtggctcacacctgtaatcccagcaatttggggggcagaggcaggtggatcacctgaggtcaggagttcgagaccagcctgacaaatatggtgaaaccccatctctactaaaaatacaaaaattagccaggcatggtggcgtgcacctatagtcccagctactcgggaggctgagacaggagaactgcttgagcctaggaggcagaggttgcagttagctgagatcacaccactgcactccagcctgggtgacagagtgagactccatcttaaaaaaaaaaaaaaaatttcatttctatttatatgaagtataaaaagtaaactcttggaaacagaaagtagaatgatggttgccaggggctacaaggaaaagcagagttgttcaatgggtacagagttttattttacaagaagaaaaagttctagagatcttttgcaaaacaatgtatatacagttaacactactgtactatattatttaaaaatggttaagatgggaaattttatgttatgtgtttatcacatacaaagaagtataatgaacgtaatgatgaccataaataggccaacagctgtaacaaaacaaattaacttctttaaagcctgaaacaaacaaccttcaactactaaacttcacagctgtaaagcaaccagtattcggtgaatgcctactatgtttataggcactgtactgcccttcacaaatgcttctcacttaatggggaggaacccagtatttactctgctattcatgatcagtcaaggattcctaggatataactacatccaacttcaggtgatggtagagtcaacaattagggaatatttttacaaagagaaaatggccaagttgagcagccactttacacaaatagttggagcagaacaaggcaccttaataaaaatactccaagaagtttcccatttatacataaataaacatttcacttacaggggaatactcatattgtcctttggagtgaagaaaatgggcctagcatttccctctctggaaaggtcatcagaattgtggctgtaagactgagttggcctaaagtgttctctttttgaaatgcgattatttgagagtttacaggctacattcagctgggtgcccattctgtctgtcttggataattccttgacagtactagattggcatggacttccttttctttcaaagaacacggtgacaggtcggtcctttgggggtaagtgagcagaggaactgtctttttgggcaagagctgcatcttttaatgatagggaccccagtacattaagttctcccttatttgaggtatttaagctgaggagagaggatggcctctctactctttgctttgactgataggaagatggtgccaccaaacactctccaattcttggcttttcaattgtcttgaaggctttgcgctccttctctaaaatatctgtttgctggcgaatctgttccatcatctctttttcattctgttgctgcaactgtttttgcctttcttccttctcagtgtttagcttttctaacttcttaagcacaggattagaagactctgtattcaaagaaggaacaatctgatcttttcctgagcagtgataccttctagtttccctgttgatatccaaagtaagagcttcccccgctgtgtcttcattttccaatagtttgtttctttggatacttgtgtctagttgggaatttgttttcagtgggtcttgttgggggatataaaaaaaagtaggtagactatttgaaatgaaggagtctttcagctgtggtttacaggtaatagactcagaactgcagaccaccatttccttcatagttccatccttcaaatgctctgcactgctagtctcatttgaggcactgagggcattgtcccgtgaatcaaattttggactgctggatatcttaggtgatggaaactgcaagtctccttcatctgaaatgacagactctagtttgctcttttggctttcctcatagctcagaagttccaagcttccttgagagctctcactatcaggtgtaccccgtggagactgaaggccttcaggcaccaattctgtagaccatctgcgatcctctgaaggagaaataccaccaagagaacgaactttcagcaattctaagctaaatatagcttgctctagttctctcattctcctactttctctcttagcccggcctacttttttctgatggagatcctccaaggatctgggtctctctcttacaagcacatcttcctgcaagtccacaccactctggctttgggctctctcctgctgcttgtttggtgactccttcaagcagtccactgaactttcacggctaattcgattactctctattacagatttacattcctctatggcttttattctgttgtcaaaagaacaatcctcccatcctgaagggtctgaaccctgaatttccagagatccatatcccttaatattcaccaatccaacttctggctttgtttctcttagcctttgttcttttaaagctttaaatctatataaaaacagacaaaatgggttatagaaatatcttagttaccactgaaaataacatatttcctgagaatttaagaaaaaatgcagagttgtaaaatctttttataatacctaagttcttcttaaactaacttgaatgcacatttcataattttcctatttccatgagtcagatgatatttcattaagtgtattacttctacctaggcatttcagtcaaaatgtaaactaattcagaagtaaagctctcattttaataatgcctttattttaaagtaaacctcaaattaaagtgaaattttaagtgtgaaattaaagtgaaattttaatttaagtgtgaaattaaagtttctgaaagtaacaacagttgaatattgccaattttataagattcagcctaatgtagaagttaattcttagcagttatgatcacagaccatgtagattttcaatccaatttaattcaataaaaccttatttaacttccattatagacaatacaatgtgggttaaaatcggtatcacagtatagtggaaaagacaaattgtatacaaccaattctaatacaaattagacaagtgttaatgcagaggtataaacaaagtacttgggaagaagaaaaaaagcaattattatagtaatagagattacctttgtcttgctctgaatcctctacatgttgattgcaaaaggataatttttttcctttgttcttggtaccttttactttccctgtaggctttccatcttgcttgtatgcaaatagcagccatgtgcctgcgcctatagtaatctctccatttctgctggataacgatggctgcagcccgtaactccaagtaccgctgcctctctaagtgagcacgccaggaagcttggagaagagcagctgcactagccataacaaaagcatccttctgcacagctgcatctctgacttgcttctgatttaggtaattcctccagaatctctatggggaagacaaaataacagaaactggttgtcatatcttacactgcattttcacaggaaaaaaagagaataaatttcttatgtcataattacaggttaagtggctatgcagctaaattcttggtgattaaaaataagttttctggccaggtgcggtggctcatgcctgtaatcccagcacttttggaggctaaggcaggcagatcatgaggtcaggagatagagaccaacctggctaacatggtgaaaccccgtctctactaaaaatacaaaaaaaattagctgggcgtggtggtgggtgcctatagtcccagctactcaggaggctgaggcaggagaatggcgtgaacctgggagctggagcttgcagtgagcagaattcacgccactgcactccagcctgggtgacagagtgagactctgtctcaaaaaaataaaaataaaaaaactagttttctacaaaagcagaaagtgtacctgaaaaagataaatagaaaaaagttttctcttccagatatgtttggctaaaacagctattttaaataatataaccttgaagaagttaattacagaacctaatttaaaatttttggatgatttcatgtccttcaaattattagtaactttaacatattatattcttttgttacaattttcctaaataacactaatgggtttaaggtaatcctgacacacattccaaagatgaagatactaaagattttcttgcacaaatggaaaagatcttatggaaatgatataaatcaatgagggagttaataaaacaaataaaatgtaaaataaggtacctatcatccaaaatgagtgtctaaaaccaacggtatatatacaactctcaaacatcactccaaaaactattaaataaaaacaactatgtcaacaaatattaggtaactccttagcccctacacagatctcacaagacattataactacaaattcaatttaatttaaattcaatggaatcaatatttattaatagtctattatatgccagataatctgttgggtgttatgagcacttcaaaattgggtacgacatattctcatttctgaagttcacattattactgaaaatgttttacagtaaaaaggttctggttactaaacaaaggccaaataaactagtcaatctcatgcaaagaatcctttgcttctcacctggataataacagatgcttgtctcagatggaggaaatgctgcctacacagcaagaccctgaaccatcgctgcaacaatatgattctgcggagcacctcttggtgaagcagatcttgtaagtgctgtcgttcctgctcctttagaaagacctaccaaaaggaagaaagatgaggaatgcagcttaagaagaaatgagaaatttatttcatgaatcatcctttctgtgataagcttttagagaagaacaaacacagtggcaggcatgtaaatgaagtactgataaatattcctacagatttatccaaagtagtcattctcaaattgaaatggagatagtagaatacggaaggtgagctgggtgtggtgctacatgcctatactcctaactactgagaaggctgaaacaggaagtttgctgaagcccaggagttccagttctacggcaaaatagagagacctggtctccaaaaaaaaaaaagacaaaaaaaggaaggtaaggaagggaggaagggagggaaaaatgacaaggtgagcaagaatatcaaaattccagtgccagagattatgatacattagtccattggggaaaccactgctatgagtaaatgtattactggtaataagtcatatttttcaagcgtgttgggatggggaaaaaagttgaaaaccatagatcttgaagcttgaatcatataatgaataaaccaatgataacagtctttttgaaatccagcgtgcattaaaagcttctcactgtccaaagttattaataagtttattttatttactccttcattccactaatgtttagggtttgtgaggctgcaaaggtgaaggagacatatccctttagaaacaggaattatacctctcatttgagagcaggtagatattatatacccgaagaggaagatggtaaactaataagggccagagacaaaagatcccacctgagtaacacagagagttgaaaataataataaaggcatgcacaggagacaacgggacaattaatctccataaaaaagatattaagtaatgtgaagccacaatatgaaggttctcaaaaaagagaaagatgtttggatttaatgaggaggttatcaggaggttattatcaagcaggaggcagacataaagaactaagtatattaagataataattttaatattatgagtagaataaattaaatggaatgacaaatatactagaatcagataagtaagctgttcactgtataagcaatgtagatgagaagagataaggaataaaaataaaatggaagcagtagtaatggagaaacagaaagcgatgtaagaatctctttgtaaaaggaaaaaaaatccctaaaactttgtgaaaggattaaagtgaacggtatgccaaagacaattatggtttctagactgagaaactggaaaaagggtgacagagaaagaaagtatttgataaatttaagaacagatgaatctggatatggtcaccttgggcaagctggcttggagattacagtagagtatctatggagagatgatttttaggcagttaaaattatagtcagaactagagcactggccagagctctgtgattaatattgactacataattaaataaaaacctgggcctaaccaattgtcttctgatatctgattcactatctttttaataaacaatctcataggcaaaaattattattttttaaataaatgcactcaattttgaccagagctatacagattatatttaccatggtttttccaacttgataattatctggattaagatttattttcctgaagaaatcctgaatgttaaatttggatggaataatatttcggggaagaagtacatggaagtggctcacaaaatcctgaaaaataatttaaaaatattgtaaaatcagaaaacagtgtatgtaaacaagaccttaaactaattatcattctattaatcttttctctttcttttaaacagggtgaaaccaagacgtgcatgttaatttaagatatgataaaaggttaattcggaaaacataggaggtggagaaagatattgggttctacatatcatgacatcaaaagggaatgagagaaaaaaaaggcagaggctaattatcccttttgagaaagctttataaaagaccaaagaaaagggtatttaacaagaccctaaaatttctatcaggaaaaaaaaagcaaacgtggcaggatggggacagggtatcactgagaatgaggctttccgtcccagtaacagcaaagacttgctcagttgctgaacagcttcaatatagtttccatacccatagcagcaattgctgatacgagtagctgtgagccttgctggcagcttactatgaaagaaaatcctgctgagaaaactttagggaaaaccaaatagaatcttttcactagataattctcattgaactatttcagttactggagaggtcagtgcaaagaattgttatatcaggagtaaatttagtattagcaaacattccgagcaaatgagaatagccaagtactggattctattacaataagcttaatgagattgctgccattcaatcaaagtaaatactgtctatcccttttcaattccgtatacaaaacgtgaaatggaaaggaagaattaaggaaaataagtaagccccaaagaaataataagcaagatatgtgggaatcatttacttgatgtgtctaaatatgtaaatatcactataaaaacagaacctggaaagaatatttggagctgtatcctgattggcgaattcgaactgtttccagcatcccggtgtatcgaagctgtctaagtaccaagacatcactgaaccttaagggcagctaaagcaaatggaaaaaagattaacccagaacagtagatctccaaattaattatctgtttataagcatgactaactgttgagtatctagagattgactggaggttgtctggttaacatatacagtaactaagtatattaaggcaagctcacctctcagctggtagcttcagaaaagttctgactgcccaaccctagggaaaagagagaaaccaagcttccaggcttctctggttgtgaagagagaggaccttaaaggctcaaaaagaatgtagtcacccacagaggccacatagtccaatcactacaaaatctgtaacaagataacctacaactgggtgtagtggctcacgcctataatcctagcactttgggaggccaaggtgggctgatcacctgaggtcaggagttcaagaccagcctggccaacatggcaaatccttgtctctactaaaaatacaaaaattagccgggcgtggtggtgcacacctgtagtcccagctactcaggaggctgaggcaggagaactgcttgaaaccaggaggcggagattacagtgagctgagatcatgccactgcactccagcctaggtgacacagtgagactctgcctcaaaacaaaaacaaaaacaaaaaagaaaattcttttctgacaggacttcaagaggtatttgcttctcaaattctgggtgatgctaaatcaaatccaaataaacaccttacaggcagggaagtgtggaaaaatccatttaaagtgtttataacatactattttccttataaatattatagttagtgcttcccctccacttattctgcttaaaagtatttaaagctcagtttgaagtaagctgagatatgtgctctcatttataggacatttttaccttttcagcattagagcgaatgcattttacaaaatatggttctgcttgaccaagtgtttccattagcttgcttaatgatgcctgcaacagaaagcaatataattatcatactcttccattccaaactattaacaaataatttataactataatcaacatgctggcaaaacattcaaaaagtagaggtacacatagaaagaggtttttgaaaagcacattgtgtatattctcatactggttaaattatggataattaaggataaagatggtagtttaatattaaagcagatagcctggaaatagtaaatattgcagatgttttcagaacaatcaaatatagaatttttttcacttttcttcacatttcatcaaacaattttattcaaactcatgtatcctacaacttttaaaatgattcaggagggtatccagtaaggtagtaagcccttgctttactttaaatgtctacaaagtatgtaatgatatccctttttttattcctgataatggtaatttgcacattctctctttcttcctgattagtggctagaaatttatcaactttttgatttgctcagcccaggcatggtggctcacgcctataatcccagcattttggagggccaaggagggcaggatcacctgaggtcagaagtttgagaccagcctggccaacatggtgaaaccccatctctactaaaaaatacaaaaattagccaggcgtggtggtgcccggctgaggcatgagaattacttaaacctgggaggtggaggttgcagtaagccaagatggtgccactgcactccagcctgcgcaacaaagtgagactctgtctcaaaaaaaaaaaaaaaaaaaaaaaaaatttggatctgcttaaagaaccagcttttggtgtcagtgttttgtctatttttctgtttttcatttcattgaattctgctgttatctttattatttacttttctctgcttgtattgggtttcatatattctttttatagtttatcgaggtagaaatttagattattgaattgagacatatctccttttctaataaaagcatttagtgctataaattaaccttggagcactgctttagctgcattgcacaaattttgatatttcattctatttaaaatattataaaattttccttcctctaaaatatgtattatttagaagtcgcttttacatattctaaatatttggggattgatgtctttctttgatttctggtttaattctattataaatacaacattttgtatgattttaactcaaaattgttaaggttttatggcctagtttacgatctaccttggcaagtatttcatgggcacttaaaataaatgcatattctgcaattgttggctagggtgttctacaaatttcagttaggtcaagtaggttaattgttctatttaagtcttccatatccttcctaattgcctacttaccctgtcaattaccaagaggtatgctgaagtttccaagcataactgcagatttgtccatttttcttttaattctatcagtttttggttcagatatttgggagttctgttattagatgaatatacatgtaagacttggtaaattgcaccttttatcactatgaaattatctccctttatccttggtaattttctctgttctgaagtctactttgtctgactctactatagtcactatagctttcttttggtttttgttcgcatggtttattttttttcattttttaaccctttagtatcattgtatttaaagaggtttcttgtagataacatacagttaggtcttattttatccaatcagataatatccatttctttcttttttttttttttttttttcctgagacagtgtctcgctctgtcacccaggctggaatgcagtggcacgatctcggcctactgcaagctctgcctcccgggttcacgccattctcctgcctcagcctcccgattagctgggactacaggccccaccaccacacccggctaattttttttttcttttttttttttattattatactttaagtgttagggtacatgtgcacaatgtgcaggttagttacatatgtatacatgtgacatgctggtgcgctgcccccactaactcgtcatctagcattaggtatatctcccaatgctatccctcccccctccccctaccccacaacagtccccagactgtgatgttcccattcctgtgtccatgtgatctcattgttcaattcccacctatgagggagaatatgcggtgtttggttttttgtttttgcgatagtttactgagaatgatgatttccaatttcatccatgtccctacaaaggacatgaactcatcattttttatggctgcgtagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctaactggtgtgagatgatatctcattgtggttttgatttgcatttctctgatggccagtgatggtgagcattttttcatgtgttttttggctgcataaatgtcttcttttgagaagtgtctgttcatgtccttcacccgctttttgatggggttgtttgtttttttcttgtaaatgtgtttgagttcattgtagattctggatattagccctttgtcagatgagtagattgcaaaaattttctcccattttgtgggttgcctgttcactctgatggtagtttcttctgttgtgcagaagctctttagtttaattagatcccatttgtcaattttggcttttgttgccattgcttttggtgttttagacatgaagtacttgcccatgcctatgtcctgaatggtaatgcctaggttttcttctagggtttttatggttttaggtctaacgtttaagtctttaatccatcttgaaatgatttttgtataaggtgtaaggaggggatccagtttcagctttctacatatggctagacagttttcccagcaccatttattaaatagggaatcctttccccattgcttatttttctcaggtttgtcaaagatcagatagttgtagatatacagcgttatttctgagggctctgttctgttccattgatctatatctctgttttggtacccggctaatttttttttgtatttttagtagagacgaggtttcaccgtgttagccaggatggtctcaatctcctgacctcgtgatctgcctgcctcggcctcccaaagtgctgggattacaggcgtgagcctgtgcccggccgataatatccatttcttaattggactgtttagagcatttacattgttaataattagtatgattggatttagggctaccaattttattactggccttctgtttgtcctctctcatttgttcctcccttcctcctcttactccctgtctgtttaaaatagacttttggagcagttttaggttcacagcaaaaatgagcagaacatagaattcccatatgcccctttaccctcacatgcacaatttcccctataattaacatcttgcattagtgtgttatatgtgatgaaccaatactgacatgattattaactacagtccataatatgcattagggttcactctttatgttgcacattctctgggtttaaacaaatatatagacatttattcaccattgcagtatcatacagattaatttgactaacctaaagtcctctatgctctgcctactcatcctcccccaactagatcctggcgactactgatcttttttactgtctccatagttttgttttttccagaatgtcatatatttggaatcttatggtatgtagccttttcatattggcttctttcactcagtaatatgtatttaaggttcctgcaagccttttcatggcttgaaagctcatttctttttagtgttgaataatattccattgtctgaatgtaccatagtttatccattcacctactgaaggacatcttgactgtttccaagttttagcaattatgaataaagctgctataaatatctgtgtacaggttattgtgtggacataagttttcaactaatttaggtaaataccaagaagttgttactgctggatcatatggtaaaaatatagtttataagaaactgtcaaactgttttccaaagtggctgtaccattttgcattcccaccaccaatgaatgagtgttcctgttgctccacattctcaccagcatttggtgttgtcattgttttggacttctgccattccaatagctgtgctgtggtatctcatttttgttttaatttgcaattccctaataacatataatgtggaacatcttttcatatgcttatttgacatctgtgtactttctttggtgaggtgcccctcccctctgttcaatatactttagtattccatattaatttatctacttttcaactatctttgtactgcattttagtagctgctctagggattacaatatacaaacctaacttgtcacagtctacttacttaagagtcgatatttcacaagttcaagtaaaacaaagaagtcttacaactatatatagacccctgttactgttgtgaaattacatcaacatacaaatttttaaacttttaactgttcgtttttcttgcaaatgctattgtagtataatatacatagggcttggcacagtgtcacatgcctgtagccacagctacttgggaggctgaggagggaggatagcttaagcccagaagctggagtccagccagggcaacattttatttatgagactccgtctcaaaataatgataataataatacacataaaatattaaaataataagtgtaaattatgactttttacaaaaggaagacattgttgtaactaaagccccaattttatatatatacacgtatatatatatacgtatatatatacgtgtatatatacacgtgtatatatatatacgtgtgtgtgtatatatatatacgtgtatatatatatataaaatcagaaactcagaagcccctttgtgccccatcccattgactttagcaagctcactgtacataagctatgtactcttatttccacaccccaaccaagggtaattattattcttacttttaagatgataagttaattttacctactattaaagttcatatgaatggaaaaatacaccatgtactattttgtatttgttgcatacaattatattttgtaaatttccagtgctgtatattagtgatccattatttggctatactggctatactaccattaaactatccattaagagatgagtatttcgttgtttccagtttattatgaaaaattttgctatgaacatacttatacttgcctcttttaactgttttccaatatgcttgtatcaatttacatttcaacagtaccatataaggttctgaatgctccccaatcttgccaacatgttgtataatcagtttatttcagccatgttggcaagtatgtaacagtattgctttgtggtattaattggcatttccctcatgaataataatgttgaacaggttttacataggtgtgttggccttctggatatcatcttttataaactgcctatttgagacttttgtccatttgtctattaggttttcttccttttaaaacactgatttttagttcttcatattatacaagtccttttttagtcttgctctttttcttcttttaatggtgacttttttggtttaaagttttattggaataaaatctacatactattaaaatatacacattgtagttcacaaatcaatgagttttagtaaatttacacagttatgccactatcactacagtccagttttagaactcctctatcacccccaaaaaactccctcctgcccatctgcagtcaataaccacttgagaagcagccccaggcaactaccaatctgcttcctgctgctataaactatcttttaaaaaaatacattcttttttagatggcttttcctgtgattataaaagtaatatgtagctattctagaacacttaatacatacatatatgttcagagaatatcagcttgggtttaatttgactaatgactaaattcttagagctataattaaaaccaggttaatttcttcaaaccaatcagccttttcaaagggaattcatacttctacaagtatgaattcaattcaaatatgaaaacaagcttaatgtatcctacatcttccttatacccacagttagaagactcctagggaagagaaaaatttaggtttcaccgcttgaagaaagagtatgttgactgttcacataacagcggatatttttcctagcaacctgtggatccctaggcagctgagtatggagaggagtagcagctttaccagtaagttttagtagctacaacaagcaacagcatgtgtatgactgattatattaggagaaagccacaaaacttcttttaaaaaactactaagtagagacatagtgctatgaagtgaccagactttgacatacaggtccatgcataaacattgcacagttctttatgatcaagttgtatcatcccagtcataacttaaggctttacctgctttgaaagtttggtggtcaaagggattgactcattaaaatctaacattagcctgcagaagacaaactctcaagagggaatgttttagagtatagtgaaggtggtaatttaccacaaaaggctgaaataatacagaaaatatacattatagtctaccatgttgttacttgtttctatttatcagtctgaattttctttttccttttttttattgagtatattttatggttccattttagttcagctattaccttactaactgttaactcttttttaaaggattattctaggatttgcaccttttatcacagtctaccttcaaataatactataccatgttctgtatagtgtaaaagcttaacaacactatatttccacttagccccactttaggtgttttgtgatacttttattatatattttatttctacctcacaatatactattatttttgttttctatagccaattattttaaaaagagaaaagttttttttttttttcttgagacagtctcgctcttttgtccaggctggagtgcagtggtgcaatctcagctcactgcaacctccacctcctgggttcaagcgattctcctgcctcagcctcccaagtagctgggattacaggcgcccatcgccatgcctggctaatttttgtattttcagtagagatggggattcaccatgttggccaggctggtctcgaactcctgaccttgggtgatctgcctgcctcggcctcccaaagtgctgggattgcaggtgtgagccaccaagcctgtccaagaaaacatatttttaaaatattagcctacatttctatcaatctgccactattcatgttttgtgtaaattcaaacttccatgtggttttcccatcatttttcttccatgtttaaaatttctgatattatagatctgctggtaataaattctctcagcttttttggtctgaaaatgtctctacttaaccttagtttttaaaagatacattcaccacacatagaattctagggtgactttttttctctttttggtcttttgaagctatcactcttgtcttatggctttgatagtttctgatcatcttcacttagttacacaaaatgtctcttttctccctctggctaagtttaagatgctctctttttaactggttttagcaatttgatataatgtgtcttggtgtgtttttgtttgctctgattgaggtttactgagattctttgatctccgtagttttttttttttccatcaaatcagaaaatattttgctcattatttcttcaaatatatttttctgtgccctcctccctttcatctcctgagattccaattacatctatgttagactgcatcatattgctccataagttattgctattttcgtttttttacatctttgttgctttctctgggctttaataaactatgacttcaaatgtactacttctgaactgtctaaccgatgttaatccaatttagcttgttttttattgtcaaatattacatatttaatctctaaaagttccatttgagtctttttcatatcttcagttttttcattttcataatacaaatggcccttattggttgcaacaggcagtgaaagacaggacagaacaactccatctcctgagaaagcgtccagagactctgtcatcaccttccaaaataaaaaatctattttgttcttatcatattcatgttttttgttatgtctttgggcatatttaaaagatacattatagctaatttgacattcttactatttacatcatctccatcattttaaagtctgtctctgattattgatttttttttcccccttgttatgggttatttttttcctgactctttgcctgccttgtaatttctcatcggatgttagacactgtgttttacattgttggattttgttgtattcctttaaagagtgacaaacatttttcttaacatgctgttaagttacttaggatcagtctgattcttttaagacttaatttttagttttgtgagagcagggccagagcagcctttacattaggactattttggtcccattgctaaaacattgtctttctgaggattctacctaatgcctcatgtaataaaaggtcgtttcactctggctgatgagaacagaactactcctctaatcctgtataagtaccagaaattgttaggtctacaggatttaggtgattagaataatcattctttccccaatctcatggaattttaactcacatatgcacagatcagtagtcagccacagagactcaaggagacccctcagcagatctctagctctttctcttcatacaatttccttctcctctttactctgcctcacaaattctagttgcctctacctttctatctccatctcttcaattagcaagaccactggcatttgtttgggtttcctcttcctgagccgtagcaaatcatctttaggtgttaatctggggctttcctcatttatttcccctattctcagagattggagtcccgtaatgcttactaatatctgaaaatatttgactcatatcttttgtccagtttctggttgtttatagcagaagggcaattcctataccaattaatcctttgtgagttctatggtatcattttcatgaaaataagcattcaaggaagggcacaaagacggctgggtgccatccattttgactacctgcaatttggtcatctgttacttggtttcctcacctttataataagtataatagtaattatcctagaataattggagaagaacttagacaacacctattagacaatgcatacgtgtaaatttttggcaaagggcctggaaaacataccatacattggtcattatctatggatggcagatgactttcacttgttcttactcatgtatattttctaaataatcaaaaattaactcattacttttgtaataacttaatggccgattagaaatatgaaagaggactctttttctaaaaattaaatataattcatgaatataaattgagaatatgtaaatttggaaggattttaaaagacacaataggattgtgattataactaagtttttattgtactagctatatggtattcttcagattaaagaatgattttggtatacatggcacctgtaaaagatccaaggtaacaaaacacttaacagcttaataattctacctttcataatcacgagattaatgttcccttttcagacactgagctcaccaaagtactttttgaccagaatttggcttcccatgtggatttgctaatcaggaaaaaaatatgctaataaactaaaaaattgtattaagtctgcttatgactcatatttatgttgtatattaataaacttatattactcaacatgatttttttttctataacccattaatctttgcatttctaatctacaaagtgaacatccagactctggattgtgaggacagaagcaaggtaaagacagacttccccaagcactatcttctcattcttcccaaccaaatgccattaacccatatgattattaggaaggatttttaaaattcatggcagtgatttcattatactcaattccctttcctttaagcttatttgcacataatgagttatttggctccttggtcttgctttttcatttctttttttttttttttaaagagaaaggatgtgaccaaatagcctgcacagattcaaatttttctttaggcccatggtgagaattacctaaaataaaatgacatttctagcccacaatttgaagaactgtgcttataaatcaaacaagatcatatacaatgatacattagtagatagcttatgttcaaacatcctagctgcaaaagaagcattttaaaaagtgttaacatatacagatacacctatcatgaataaggaaatttttatacaacagtgaacactgcttctgtgatataaacatgaaatagggtaaaattatgcaaagcatttgttacctaccagatattttgcttactttcataaatatctaccaaatgaaaagatcttaggagatagatgatttgagaagaatggaagaggcaatttaaaaaggaatttgaaaaaattattctggaagaaatttggttaactattatcatatttattcctaaaagccccaaaaaagaactggatttctatttatacaaaggtaaaataaatacacaggaaaaaaaccttcagcctcatttagttaactattgatggtagcagcatgaggtttaagcagggaaaaaaacatatatcattatgctaacagtgacattatctaagcagcagggtttaaaggcagatttgtttataacatcaattttctgctttctcctcacactgaaaataacaaatattgagatatccattatccagacatatgtggatgaaaaacaaaggcatctgactttttttttttcatctttggttcttttttccaaaatgatcagtaatatatggctttttagtcacataaattaaaatcccattcaagtaccctgcagatcactttaacctttcaatgacaatctgaaagatacagattcttatttgttttaagcgaaacaagaaataacctgaaactgggcactgatgctgggaggttttttcttcttgtgtaaatgaagaagagacttggtaatgcgatcttgtagtgtcagtcttgtcaggtgctttaaagaatttacttctagcaagtgctgaaagaagagaaaaaataaattgctcacataaattaatctaacaataagccaaaattctcagccagttttcatcatttcctatctatatgaccatttcccatcttaaatgactgtagtgaatatgaaagactgatatccaacattcattctattctcctgtcttcctctagaagctagaaagctaaaaagaaaagtacacttcacaaactctcttgcatctagagttctggatatggtttaagtttactaataaaaggcccacatgtgaaactgggaaggtataactgaggcagaggctctggctactagttctgcttctgctagcaaaaatgcatatactttatgtaccttttttctgtggttccagcatccaggcactagttttgtaaatgctcagaggcagagtgcagaacatttgtgttgtcatcacaactatactaaatgcagcttagccctggagcaaatagttgtagcagtttcttccagatggctagattacaccacaggcagtatgtaccgcaagtagcagctgcactgacagcttcctgatttcctagctttctaattacatttagggacatttctgcaaatgttattttaacatgtgacttctaatgattttataagtgcctgcttaattccctttctacttaaaaatatctactgtaattactgttatctcaatcctgactcacagagacaacaattaaataccagggcgacagtcggtgtgccagggacatacacaaaaaccaagtaggctgggcacagtggcacacgcctgtaatcccagcactttgggagactgaggtgggcgggtcacgaggtcaggagtttgacatcagcctggctaacacagtgaaaccccgtctccactaaaaatacaaaaattaggcaggcatggtggcacgtgcctgtagtcccagctactcgggaggctgaggcaggagaactgcttgaacccgggaggcagaggctgcagcgagccaagattgagccactgcacaccagcccgggcaacagtgagagactctgtcaaaaacaaaaaacaaaaaaaccaaagcatagtccctattaaccctcatcatgatgtactacactaaaaattaggaaaatgggagttagacatgaagcaactaaagtatacaaagtaaagacagtacaagtatttgggagctttttgagccaatcataattttttaaaccacacaatatttatggtagtgagtttgtaaatgaaaagaatatatctatacagatgtaaactatatgttatttaaaaagtaatcaaaaatcttaatgtatgagaaacaaaagattgtgttaaaaacatgacaaattttcaagtctaaaggtatctattttgacaatataaacattaataaaaccatgcaaattgaaagaagtacaacacacatgtaaacaatctgaattaaggaaatgttatttcctacaaatgaaaaggcttatcatctgtatgtaaaaaaaaaacttttaaaaattcttaaaaagacagatatcacaataaaagaaagggcaaagattatctgacaaggcaattctcaaagtaaaaatggcaagtaacaaaaccacaatccattcaatctcacttgtattgaaggaaaatgccatttcttttaaaagaggttttctgcatcagattggccaatacaataaagactgacaagagccagtattcatgaggtggtggggaaacagacatatactatatactcactgttcttaggaatgtaaattattataactttcctgacaagaaatttcacatctagatatttattctaaggagttatcaaacaaatctatgttgtttataacaatatacttcaaaaaataatgaaaaattatagatatgcaattatatagaattatttatataaagtatgcttcatttacacaactgagtactccacagctcataaagttactgtaaatctgtatttcctgacatgggaaaatatttgtaagcactattgatcaaaaaaaaagccatgtaaaacaacacacatgtaaaaagggcatttgtgctaattagaaagtttttgttttacttttattggcacttttgaattatcacagcttcacggtatgtatattcatgaaaagtaatttttcatactggtcaagaatcaattagaataatttataggttacccttatgtgaaaacaaattagcattgaagcctaaaataattcccccacttccacttttaagatactatggagaaaaagaccttggaaataaagtttgagtttaaattgtttttcactatgaaaaaaacaccagagggactatgcaaaataaaataactattagaaaatctttgctgtcatgtatattgcaaaagtttgaaaaaccaaacatgacattcatttctgcctcagagtcattccaatttttttcatttgcttggaatactctatagccgggccctcacaagacttggttttacttggcactgaatttgtagtttaaatgtaactttctcagaaaactcttgcttaaatactgaaaaaatagcccacttctatgtcaattacatgtcacttaattttcaacactgcacataatatcatctaaattattttttcatttatttgttaatttgtatattgtcttctttttctctaaaaaataacctcctgcagtgccacgcactgtggctcagggctataatccgagaacggctgaggcaggcagatcacctgagctcaggagttggagaccagcctgggcaacatggcaaggcttcatgcctactaaaagtacaaaaattagccaggcgtggtggcgagtgcctgcggtcctagctattcgggaggtggagataagggaggattgcttgagctcagggggcagaggctgcagtgaaccaggatcgcaccactgcactccagcctgggtgacagagcgagacactgactcaaaaaacaaaaaataaataagagataacctcccaaaggattctaactgtactgtgcatccctgtaccctcaatttctaaaatactgtctggtttagagtaggattcaataaatattagtttgaatgaattaaatacctagcaactggccaggcgtgaggaggccgaggagagtggatcaccagaggtcaggagttcgagaccagcctggccaacatggcgaaaccccatctctactaaaaatacaaaaaattagcaaggcatggtgacaggcgcctataatcccagctactcgggaggctgaggcagaagaatcgcttgaacccaggaggcagaggttgaagggagctgagatcgcaccactgcactccagccagggcgacagaataagactccatctcaaaaaaaaaaaaaaaaaaaaagctagcaactaatgaactttgagcaatgctttccctagcaagtggagaccagacttcttcccatatacctaacaataacctggtcaatcaacaaatgttcagagtcattactaaaggtcagactctgttgtaagtgctaaggatacattgcattcaagtccaggctattaggacattaaaaaataattcaatcatgcataaggtttatgaaaaaaagataaaataggaccgtaaatctagaggtaaagggatacagaattatttcctttcttagggcttcagttccttgtctacttcattcctttcttaattccatcattatggttgagtttattaagcttaattaaccagtttattatttttttcaacaattatctaccacttgctgtgcaaggtgctgtaggcaaaaagattaatgagatattgcttgaatatagtctaactgttttgagtctcccaaaattcatatattgaaacctaatcctggtgtgatagtattaagaggcgaaggggaggggcccttgggaagtagctgggtagtggtattagtaccttgataaaagaggcccaaaagagctgccatgttaaaacacatagaaggtatcattccatgaggaatgaaccatcactagacatcaactctgaaaacttgattttgaaattccctgcctcttacactgtaatatatttcttttgtttataaattacccaatctaaaacattttatcatagcagcccaaacaaactaaggcatttctcatgttattaaaaaggactaaaatggctaataaaattaacttcaaggttgggcacagtggctcacacctgtaatcccagcacttcggaaggctgaggtgagcagatcacttgaggccaggagttggaaaccagtgaggtcaatatggcaaaaccctgtctctagtggaaaaaaaaaaatagccgggcatggtgacgcatgcccgtcatctcagctacttgggtggctggggcacaagaactgcttgaacccaagaggcaagcggtcagcaaaaatcgtgccactgcactccagcctaggtgacagagtgagactttgtctcaaaaaaataataacttcaagatttgagcccaagtgactataaaaacgtactaggggagcaacacagtaaaattagtttgagcatgaattttgagacaaggaagatatcaaagtacaaatatataactggacaatgaagctgtcactaaaacaatgtaactaaaaaaaataggtcatgttagaaaagtagatctaatacaggtgacagtttcaagttaggagggaataaattctaacaagaaaaatgggaaagtattaccaaaacagagctatcatcttgtggaaggacgaacttgagttcatgaaagctgcctctgcatttcaagtggatgcttgtctgaagcaaactaggctaacttgttatccaaaagggaagagctgtgtgtcatctcagagtcatagttgtacaaactaagtgctgactgtggctcctgtcaagaggtttgatggaaaggctccctgtaataacaaggatctcagatcattttgacttatcctgcaaaacccaacctagatgtcatcccttccacccactccttctcccgcactccatccctacctaactcatccctacttcttaaatagagaacttagtctgagacgaaattagtgagttgaggatatttggcctcctactatatactcaaaaaattcctcaggatagggatatatcttatctagcatagcctgtgtaaacaggagatatttttaataaaaagttgaaatgaattaaaagtagtaagaagtttaaaagatatatattcaataagtaaaaaggtcaaaaagttagtatgagtctaaattcctttccctcaatgatcttttttccaatagctttactgaaacaaaataagctgcacgtatttaatgtatacactataagttatgacatatttacatagctatgaagccatcaccacaatcatgataatgaacatatccatagcccctaatgctttctttgttccttctctcactttgcaagtcctctcttttccctaaacactgcatgctgcttcctggcaatctttttctacttttttttttattttttgagcatggagtctcactctgtcgtccaagctggagtgcagtggcgcgatcctggctcaccgcaacctccgcctcccaggttcaagcaattctcctgcctcagcctcctgagtagttgagactacaggcacgtgccaccacgcccagctaattttttgtatttttagtagacacagggtttcaccatgttgcccaggctggtctcgaactcctgagctcaggcaatctgcccaccttggcctcccacagtgctgggattacaggcgtgagccaccgcacccagcctctggcaatctttaatctactttaggtcactgtatatttttggtttttcatcttttttaaaatgatgaataataattgtatatatttatggggcacaatgtgatattatgacacatgtatacattgagtagtgattaaatcaggctaaataaaatatctcacatacttatttctttgcggtgagatcacttgaaatttacttgtacagcaactttgaaatatataatacattattatgaaccatattcaacttgctacacaaaagatcactagaacctgtctaactgaaacattatcctttgaccagtgttgtccctttccctttcccacccttataccccaaacctttgggaatcaaaactctattatatactgctatgagtttggctttttgttgttgttatggttaaaagaaaccttttatttaaaaacaatatgacattttaattttaattagcattcattaagtagccagtttttaattcctggggagcaaatatgtacaaatatcaagcactaaataattgataattactaatgtacttaacattaggtaatttagtgtcttcctcctttccaatttctatgccttttttttctttctcttgcttacttgctctggctaggacttccagtactatgttgaatagagaaagtggtgaaagcgggcatccttgtcttattctagatcacagaagaaaagctttccatttttccttgtttagtatgctgtctgtgagtctgtcatgtggtctttattatgttgaggtacatctgttctgtctatatcatgagagtttttatcatgaatgagtgttgaattttgtcagatgctttatctgtgtctattgaaataactgtataattttttcccttaattctgttaatgtatcacatttaccgatttgcatatgttaaaccattcttgcatccctgggatgaatcccacttagtcatgatgttatctttttaatgtgctattgaatttagtttcctagtagtttgttgaggatttatgcatccatgttcaatcagagacactgtcctacaattttcttttttgttgtgttcttgtctggttttcttatcaaggccttgaaaataaatttggaagaattctctcctctccatttttctgaaatagttttaaaaggactgagactcattcttcttcaaatgtttggtagaattgagcagtgaagctgtcatgtaatggacttttcttcaatgggagactttttattactgatttgaactcagagttgttactggtttcttcagattttctattcatgattcaattttggtaggttgtatgtgactaggaatttacccatttcttctaggttttccaaatagttgccttatagttgttagtaataggctcttatgatcccttatatttctgtaatatcagccataatgtcaccttttcacatctctgaatttgaatcttttccttttaaaattttgtctagctagaaatttgtcgatttttatcttttcaaaacactaactcttaatttcattaacgttttgtatttttaagcctctatttcacttatttctgctatgatctttatcatttctcttcttctattaacttaaggtttattttgttctcatttttcctagttccttgaggaataatgttattggtggtttactggagatctttctcacttactaacgtagacaattattgctataaacttccccattagaactgcttttgctgtagaccataggttttagtacattgcatttgcattctcatttctttaaatttttttttaatttcccttttagtatctcctttgactcatttgtagttcagaagcatgttgtttaaaaactatttgcatatagtttctaaagaacctattattgatttctagtttaatcccttgtcacaaaagatactccccaacttgaaattttgtttattattattattattatcattattgttattatttttgagatggagtctcgctctgtcacccaggttggagcccagtggcgtgatctcggctcactgcaagctccacctcccaggttcaagccattctcctgcctcagcctcctgagtagctgggaatacaggcgcctgccaccatgcctggctaaattttttgtatttttaatagagacagggttttaccgtgttaggcaggagggtctcaatctcctgatctcgtgacctgcccaccttggcctcccaaagtgctgggattacaggtgtgagccaaggcccccggctcccaatttgaaatttttttaacttattgagacttgttttgtggcccaacacatgacatatcttaaagaaaggtccatgtgctaatgaaaaaaatgtgggccaggcgtggtggctcacgcctgtaatcccagcactttgagaggccaagatgggtggatcacctgaggtcaggaattcgtgaccagcctgaccaacatggtgaaaccccatctctactaactacaaaaaagtagccgggtgtggtgacacatgcctgtaaccccagctatttgggaggttgaggcaggagaatcgcttgaactcgggaggtggagattgcagcaagccgagatcgtgtcactgcactccagtctaggtgaagaatgaaacttagtctcaaaaaaaaaagaaaaaaagaaaaagaaaaaaatgtgtattctacaactgctgggcagaatgttttgtaaatgtctgttaggttcatatatcttgagtgcagtttaactctatcgttctttgctgattttctgtctggttgtcctatccattgctgaaagtggagtgttgatgtcccctataattacagtattgctatctctctctccctttagggctaataatatttccttcacatatatacatgtgtatatatacacatatatacatgtgtatatatacacatatatacatgtgtatatatacacatatatacacatatatatacatatacgtatacacatatatacatatatacatatacgtatacacgtgtatgtacatatatacgtatatacgtatatgtacatatatacgtatatgtacatatatacttacatgtatatatacatatatacgtatatacgtgtatatggatatatacgtatatacatatctatgtatatgtatatatagatacgtatatacatgtatatctatatataacctttcttcctctcttactatttatctgtctgttttggtggttttctggagagttaagctttaattcttttctctttcttatttatgtatctgctgtcgttttgttctttcaggttactatggggcttacattttaaaatcttgtatttataatggactattttaaacagataacaactttgcatacaaatacgctagacttttatccccatccccccacaatttataacttgctgccttaatttacatctttttaaaatcatgtgttacttaacatttaattgtagctatagacatcacttaccattttgagttataaccatcatactagagatttaaaagactatatgccaccattacattaataatatattctgagtttgaaagtgaaattacctctaacagttctaaattggattctgaattgacttctaccagtgagttttattcttttgcatatttttatcacggtagttatcttaccatatttcttgtgtccccgtattgacctgtgccattaggtgaaacagctgcctcttccaattttatggggtaactttcttaagaagacattttctgtagatggatcctaaggtggtaaatgggtagggtgctttagctttggttctaggtaggtgcagcagtgtagtctctgtgtaatttctttacctgtagtcaacatccgatgttactgcctcagtgacttaggctacgggtgtttacaaagttggtgtgcttttccagtactatgttggtgccaccaagcaagccagtcctctggtcctggggggcatgcgcaaggcatgagtgacagttccaagccatgcaccgtggtatatgcctataatcccagcaacttgggaggctgaggctggaggatcacttgaactgaggagttcaagtccagacagggcaacataatgagaccctgcatatttttgtttgtttgttttaaagtgcagtgggccagacacagtggttcacacctgtaaccccagcactttgggaggccgaggcagaaagactgcttgaggtcagaagttcaagacaagttcaggcaatagagtgagatcctgtctaccaaaaacagaaaaattagccgggcatggtggtacatgcctatatttccagctacttgggaggctaaggcacgagaactgattgagcttgggaggtagaggctgcagtgagccacgatcgtaccactgtactccagcctgggtgacagtgtggctgtggggaaagccgccacacaagctatcttgatgccaagggtgtatgtccaaagcatggttgttctagcaaatgaaaaggcagtgtcaccaggagcagagctaccagacagcctggccctcagaccctgcagggtacacatgcaaagcatagtggttctgtaggtttcagaggtggcatcattggatacacaccagtccactggctctggaaggcacacacaaaatgcaccagttcagccagttgtagggacagcgtcatcaggggtggggatgctgggtgggctggccctcaggacctgggtaagagtacaaatccactcatcatgggggtggcattggcaagagtggggccaccaagtgggcccatcctcaggccctcggggagggcacaaatccaatgatcacaggagctgcactgtcaggggtggggctgccaggtaggctgatcctcaggccctaagacatttctttggcaaaatgtcttttggctatttttaaattaaattatttgcttttttgctattaagttgtttggactgcttatatattctagacattaacccactgccatatgcatagtctgcaaatattttctcccatttacagtttgtctcatcattctgttgattagttcctttgctgtgcagaagcttttgagtttgatgcaatcccatttgtctattactgctttcgttatctgtgttttgggggtcatagtcaagaaatcaacagccagaccaatgtcatagagttttccccgtatgttttattctacaattgtccctcaatatccatggggattggttccagaaccacgctgagataacaaaatatgtacatactcaaatcccatggccggccctgcagaacccacaggtacaaaaagttggtcctccataagggtggattttgcatctcacaaataccatattttgatccacatttggtcacagatgtagatccccctgatatggatgactgtatttattttttttaaacccatgtataagcggacctgcacagctcaaacctgtgttcaagtttaacagtttcaggtcttatatttaagtctttaacctacttggttggattttttatgtggggtgagatatggtcccaatttcattcttctacatgtggatatccagttttcccaacatcatttattgaagagactatactttactcattgtgtgtccttggcacctttgtttaaagtcaactaaccataaatgtacgggtttacttctgagcttttaatacttttccattggttaatgtatattttcttctgccagctccatgctgttttgattacaatacctttctaatatatatatatatatatatatatatatattttttttttttttttttttttttttttttttgaggcggagtctcgctctgtcgcccaggccggactgcggactgcagtggcgcaatctcggctcactgcaagctccgcttcccgggttcacgccattctcctgcctcagcctcccgagtagctgggactacaggcgcccgccactacgcccggctaattttttgtatttttagtagagacggggtttcaccttgttagccaggatagtctcgatctcctgacctcatgatccacccgcctcggcctcccaaagtgctgtctaatatatttttaaatcaggtagtgtgagcctccatccagctttgttctttttgttcaagattgctttggctatttggggtttttttgtgtattcatatgaatttcaggattttttttatttctgtgaaaaatgaaaatggaatgttatagggattgcactgaatcagtgaatcactctgggcaatatggagattttaacaatattaatttttccaacccactaacacaggatatcatttttcatttgtgttgtcttcaatttctttcatcaatgttttatgatttttttgtatacagatttttaacctctttggttgaatttactataaaatagtttatattttttgatgctattgtaaatgggatggtttccttaatttctttttcagatagttcatttttagtttataaaatgctactgatttttaggctgggtgcagtggctcatgactgtaattctagtactttaggaggccaaagcaggaaaatcatttgaggctaagactttaagaccagcctgggcaacacagagaaagaagattccatctctacgagaaaaaaaaaaaaaatttaatagccagatgtggtagcatgcacctgcagtcctagctactgaggaggctgaggtggaaggattgcttgaacccatgagttcaaggtacagtgagctacaatcatgccactgcacttcagcctgagtggcagagtgatacactgtctctattaaaaaaaaaaaaaaagcaagaaacactgctgatttttgtatgttgactttgtatcctgaaacattactgaagtacattacggaatttatatatcagttctaacagctttttagtggggtcttgaggattttctatataacattatgttgttgacaaccacaatatcacttcttccttttgaatctggatgccttttatttctttttattacctaatttctgtggctaacaattccagtaatacactgaattgaagtgtaacagaagtggtgacagtgggcatccttttcttgttcctgatcctaagagtaaagctttcaacttttcaccaatgagtataatgtcagctgtgggcttgtcacatatcgcctaattatattgaggaacagtccttctatacctaattcgttgagcttttatcatgacaggttgaattttgtcaaattctttttctgcatgtgttgaaatgacagtatggtttttgctattcactgtgttaatatgataaatcacatttattgatttgcatatattgaaccattcttgtatcgcaagaataaaccccaactgatcatggtaaatgatcctttcaatgtcgtattgaatatggtgtagtagcattttgatgaagatatctgcactatttacaacagcaaagactactgtgaatagtgctgcaatgaatgtacaggtgcatgtgtttttggtagaacaatttattttcctttgagcatgcacccagtcatggcactgctgggttgaatgggagttcaactcttagttctttgtgaaatctccaaacttctccgtagtagctgaactaattttcttgtagtactttcgtatggctttgctatcagggtaatgctggccttataaaatgagtttgaggtattctctccagttcaattttttgaaagagtttgaataggactggtattcatttttatttaaatgtttggtagtgttgcatcatgaaactatctggtcctgggctaatcttttatgaaagaatttctattgctggccaggcatggtggctcaatgcctgtaatgtcctgaagaatgtcctatgtatgcttcagacgaatgtgtattctgctgctgttgactgaaatgttctgtatatgtctattaaatgcatttggtccactgttttcttcaaatccattgtttccttattgatttttggtgtggatggtctgttcattgttgaaagtggggtactgaaatcccctaggattactgtattgtagtttatctctctcttcagatgtctcaatatttgcttcatgcttttagatgctacaatgttgggtgcatatatatttaaaattgttacatccttttgatgaccatacccctttttattattatatgttgaccttctttatctcatctacagtttttgactttattttgtctgttataaggataactactgttgctctctttaggttttcatttgcgtgggatacttttttccatcccttaatgttcattctctgtacatcgttaaagctaaagtgagtctctcgcaggtagcatatagatgagtctctctttttttaatgcattcaggcactctgtggcttttaattggagaatttaatccatttacattcaaaccagttattgataggtaaagatttactagtgccactttgttcattattttatcattttgtagagcctttcttccaataattctgtcttccctttgtggtttgatggttttctatagcagtatgacttccatccttttatcttttgtgtatccactaaaggtggtcaccttgaggcttacataaaaagccagtcatatacttacaactggctattttatgcttacaaaaactaaactttcattgcatgcataaaccctacacttttactcacccttcatgttttatctttttgatgttacattttatatctttttataatttgtgtcccttcacaaactattgtagctgccattgtttcaacagttttgtatttcaacctttatactagagatatcattgatttacacactggcatcacataattaaaatgtttgaattagacagtgtacttacttttatcagtgagttttctgctttcatgttctcatggtactaattatcactgtcctttagcttgaagaactttctttagagaactctcaagaaagaagttcaagaaagtagaactctacttgtaagtcaggtctagcagtgctgaattcccttagccatcatttgtctgagaaagttgttatctccttttcatttttgaaagacaaaattgctgggcatagtactatggttggcaggtcttttttctcagaggattttgaatcccactaactctggcatgcaaggtttctcatgaaaaatctgatgatagtcttgtgggggacccttgtatttaacatgttgctttttcattgttgctttttaaaaaatactctgtctttaatttttgacaaattgattataacatgtcttaataaggatctctttggatggatagtattcggtgtcctttgaattttctagatctggagttctatttccccaggcttgagtagttttctgcctttacatctttgaaagtgttttctctcactttttctttcttctccttcaggtattttttgaatttatcttgtttctctatttggaacatacttccccatttcttcatttgcctttaccctctgtgttgttttctgcacattagataacctaatagcttctcccaatcttgtttagtgtagaagaacctaaccagtcagtctggccagaaattctagggtacctctcaaacctttgtgtttgtccaaactgctgcctttgttttttgttgtctccaggaaattaggatgtgccaagttccgttagtacctcaaaagtctggccagaaattctagggtacctctcaaacctttgtgtttgtccaaactgctgcctttgttttttgttgtctccaggaaattaggatgtgccaagttccgttagtacctcaaaacatttgagagagaagtcattccccctagacacagctagaaaggttgaagtgttaagtgtgttccagttccttctatcctcgtggtgaagctgacagtaggattctctctgcactacgctgaagagaggaattctagcaaacgtctatattttagatcagactgcattatctcatcttgggggaaaaaagtgggcccactgaatgcccatttatttgttttcagtggtctagagactcagaaattcagtgtcccatcaattcccagaactataaggttaaggcggctatcccttgggagggagcagtggcagctgtgatcaatccatgaataaactccttccaaggataatctacagagataatctgctctagctttattgctggagcaagccagatgaaaaaactcaggaaacgctggaactcacagtcagtatcccagggttctgctgtttctttgcccattggctactagatgcagcctagagaggagcccaatcctcaaacaatggctagagaagtatacagacaaaccccttccagaaattaactggggagtgtgctttttaactgcttatctgcattgatccagggggctgtagtccctggaaatgtctgtgtgtttaaaaccacctctttgttctctgtcactgcaattcatattttctaagatttatatacagtatctactactgcatgtaattattttgagattcattcacgttgttacacgcatcaatagtttattcatttttattggtgagttaagtattcaattatatggatataccacagtgtgtttatccatatttctgttgatgaaagtttgagttgcttcaagttttttgctattacaaataaagctgctatacacattaataaaacaaacaaagcaaaatgaaacaacaacccctgcaaaaaaataaaaaaataaaaaaaaaccagagctatattaacagaggggcaagtactgctcaccaaatcctgcccactatttatatattgtttatatgggttaaaataataatattttatggcatgtgaaaaattatataaaattcaattttcagtgtccattaacaaagttttattggaatgcaaattatagctgcatttctgctacaacagcagagccaactagttatatcagaaaccataagcctgaaaagacaatgtccctttatagaaaaacctggcaaacatttattatagataattggattaggtgagcactaatcagaaattattttaaaatcaggtaccattcagaatttgaccttaacttggctcaaggagaaatgaaaagaccttacataaagaggcaataactaaacaacatttatattcaggagctattaaaacgctagaaaatggtatatatcacaaataaatatttacctgaaccattaggctcagccatttcataacagtgttatttctaaaatggattcaactaagtgcacgatcactatcttggatacaaataaggttatttcttgttttttgatgtatgaagattgtatgagtaataaaaaataattgtgtagcagaataccaatacaaaaaaagttttcatagtactcacctttggaagggcaggcttggatttgaaatttttgtttctcctatagagataaatcattcattaaaaaaagctactgtataaaaacaaaaacaaaagctactgtagagaagaaagatttcaaggtctctcctaaaacaacagattatatacccattaccaagactgtaggttctttatatgaaaacactatctgattcagccaagcaggcaccttgggaaggaagaataaacaaggaaaagatacctgccttgttatataagtataaacagatttacacctgatgattagtaacactgtgttgtacattctaagccacaggttcattttcttcagttgttagtagtttcttgtacctacagaagacttatttctatcatatcaaaactaaatgagatgtctaagtttcataaattttaaaaaaacgtacttatcaccaaaacgtaatcttccatttttggtaattaaaaattctattccactcatttttttccttattcaaacctcaataccatacttaaatcaagtctttttaatttatttttagccttttttatggccacagaaaagaaggaataaagtccaacgcttatgaatatgggctgggaagttagaaagacctggacaacaatctatggtctaccatctattaaggtatgattttaacctctttaacttttcattatgtaataatgtaaaacagggaggacaatactacctataacttaaaagttgttgtgaggattaaatgagttaatgtatatctctgggctagagcaagacctacataaatagaacctactaatattattaagcagtgattcagacaaggattatggaatccaattcagtcacacctctagctagcggtcaaacgatatgcttgggaaatatctaaaacatgttaatgctaataactaataactttttttcctttttttttttttctcagagacaggatgttaatcggttgcccaggctgaagtgcaatggcaagatcatgactcattgcagcctcaacttccttggctcaactgatcctcctacctcagtctcctgagtagctggaactacatgcatgcactaccacacctggctaattttttttcttttcttttctttttttttttttttttttttttttggagagatggggtctctatgaagcatggtagagaatggttatagctatgtcttcaaaccaactctgtaatcagttaatgagaaatggaaagcttggataagtgttatatatcactcaaccattcaccatttatagattttcttgcctaatttgttaagattgctagaattaatggataattatagtaaaaattgggaatcctaaaaggagctaacagttttttctttctctgaaggtagggcctgtctaaacaataagacctttattatcatctccataacaaatatactcagtcatgattctcctggtaatatgggggagaaaaatcaacaaaaacacaagctttataacacatgagattcatggctgtaaacgctacctaaataactttgagtcttgtttcagtcaaaattcttcccatgaaaataacatttcaccatcttccttcttcatttttttctgccagaaattttaaaccagacaaaaaacaaaaaacaaaaaacaatttacattactgattagtactgacgtgagaattccatgggctctctccaggagtttgctgctagttgaattagcaaatattccatctttatcaagcaaggaggtgccacttgatagtctgctctggcgaatcccagttctgccattccaggcaatatcaaatgtatcactgtaaaaaatataatttgctttagttaatgaagacgtctctaacactatactgcttaaataagtaaaataaaactttaaatactaaagttaaaatttagaaaaaaatgctaaaccaaccaaaaactgatttcatccaaatgactgccaatcagttgggactaaccgttgtctcattcagaacaaattcctatgaattccatcatattcacatacaaacgtgcatgtagatgagcatatcatgtagctgatatctttaaatatattatcattcaacaactagtaactaataaaatggattatagtatcttccctctttgttagattttagaattttcaaatgctactataggaatttgtcatcctaatacactatcccatcctatggaatatctaatttcctcctgaaaggtcttatttacacacacacacacacacacacacacactcactactcacacacccattaaactaagtcctatgagactctaaacattgcagatatagcaatgaacaaaacataacactatcacagtgattgtaacatcataattaatggaggactcaccaggtaaagtagtagtatccaacaacaaatgaatggataaagaaaatgtggtatatacatacaatggaatgctattcagtcattaaaaaaagaataaaatcctatcatttggacaacatggacaaacatagagtacattatgttaactgaaataagccagacacagaaagacaaatactgcatgaccccactcgtatgtggaatctaaataagctgctctcacagaagtactgaatagagcagtgattaccagagactggaaaaggtaatgaggtggaggggtgcagtaagcagagaggttggtcaatgggtacgaagttacagtaagacaacaggaataaattgtggtcctctattgcacaatgaagtgattatagttaacaataaggtattgtatacctgaaaacagctagaagacagaattttgaaagagaaatgttcccaccacaaaaaaatgacacatatttgagacgacgaatatggtaattattttaatttgatcattacacaatgtatacaggtatcaaaacatcacactgtacctgataatatgtataattattatgagtgaactaaaaattttttaaaagaagtatcaggagatagctacttacaacaatttcacatttgtccatatttataaatctcagcttccatttgcttagagcatttattcaagatatataaatggcatgtaatcaataaaccatttagaaacgcttgtattttcattattttgtgctaaaccattaaaaaaaagtcagtgaatcatcatccctaagataatgtgtcttcccaaatgggagaatcatactgcacttaagatggtttgtgtgtgcacttatatttttctcatttacaaaaatgagtggtactctggctttagaaaaaaaaaaaagaaaacaaaaggagagagagaggagagagtgagaggaaggaaggaagcaagtgagggaagaaggaaagcaggaaggaaggaaaaacgaagggagggagggagggagagggaggaaaaaatgcagtaggaaaatacattcctggtgaagatactgtgaaaagtgttgaaatgacaacatattctgcagtagggactgtgaggaaaaaattcttttaaaaaaagaaaacagaggattcaaagcattatagaaattgagttgataaagcagtggcagggtttgagaggattgactccaattctggagttctactgtggataaaaggctatcaaacagcattggatgctacagggaaatctttcctgtaaggaagaggcaactgatgtgcaaatttcattgtcttattttaagaaattgccatagccactccaattttcagcatccaccaccttaaacagtcagcagccatcaacatcaaggaaagaccctctaccagcaaaaagattatgactcactgaaggctcagatgattgttattttttttagcaacaaagtattttttaattaaggtgtgtatgtattttttaaacataatactattgcacaattgacagactacagtatagtgtaaacataacttttatatgcactgggaaaccgaaaaatttgtgtgatttgttttactgagaattcgttttattgtggtggtctggaactgaaccagaaacccatatagatcacttcaggtatccaaaatggaaagtacaaagaaagaagcacaaactagaaattaggaaacttaaaaccactaaactgctttgtgaaatgaggcatattgcggtttcttttttatataatcaagaaaattgggttcccatctgatgaccagggtgagaatactgccaacagatgaaactgaaggtacacaggtcaaggttaactatctaatttgtgttcgggtaaaatttaacatgcaaatatggtggtagataccatagttagccaaatactactgttaagaaaacaaaggacatacaatataaagatagcaaatagcttaatttgtggcattcaaagtgaatatatttgtggctagatacttgggctgtgacagatcttgcatatgaagttagtgaacctagacttttaaataagcaataaagagtcatgaaaaagttactgagcagacaagtgacaattatgtattagaaagacacggtgactcaattggaaaaaatgatcaatgaagttataccttcattttaatgacagaccatccttattaccacagtattaggaagctcaattttttgatgatgtttaaaacatacagaatacattctagaaacaatgttctcctcatacaaattacaatctttattaaatagtatatataaaaaacaaaattttatgaactcataaaattatttatatttgttactgtcaaattgttctcaggaattcatcattgaaaatagtaaaaggtaagctttggtaatcgcactcacccaaaaaaggtattggatggtttgatgtaaatcaaactattcaattattacttcccaataagatttctccacagaaagcagcggaataacccttaaattttgtaaaagacataaaatgcaagaagggtctcagcaattaaaatatatgagctcattttaagttattctgaagaaactttttcaaaattgtaaagccattttaccagaagcaactgtagacaaatcttgttaactttaacctattaatgtgttattacatcacttataaaggattcaagaaataaaaaaacaaaacaagcctgaattacttcaaacttttaaagtcacaaaaatatcaataagaatgttagttatttcttctatacgtccttgaaaacataaaccaaacacacttactgttggtttttttcatttagagcattcatgccctggagatcagaaagaggtgttctgggatttttccgggttatacctagcaaaatttaaaaaacagaaaatttcaaatcagtgcaaagaaaaatgaaacgtgaaatagtttttctaaagacaaacgaaaatttaatcacgagtatttgctaaatatttcagaaatatctaaataattacatgacccaagtctcataactgtcatagatcttagttaacaatgaacccaattagaaaatttaataatgaaatattttcttctttcattgaatcattaacttcagaaaatacaagggtgactggactgaaggcctagaagtgtacaagttcatttttatttttaggttcagggggtacacatgaaggtttgttacaaaggtaaactcatgtaacgggggtttgttgtgcagattatttcacccaggtactaagcccagtactcaatagctattttttctgctcctctccctcctcccaacctccatcttcaactagacctcactgtctgttgtttccttcgtgttcataagtttttatcatttagctcccacttataagtgagaatatgcagtatttggttttctgttcctgcatttagtttgctaaggacaatagcctccagctccatccatgttcccacaaaagacatgatcttgttctttttatgactgcacaaattcatttcttattttgatgcatcattttttagccatacatttctgacatgttcagataaatacaatgagtatcaatgtattgagaattaatgttataaatacgatgaatataaaagaaattgcttccttaagaattactaatatttaaaaaatgtaatgttcttcaaatcatatgataaacatgtaagttccgtaagcataaggctatcaatttttataacacacaaacatgtaatatatgtaagatacactggaaaaaggaagtaaaagtatctctactcaagatgacaatcttgtaggcagaaaatcctatggaataatttaaaaaaactgattcgactaataaacgagttctgcaaaactacaagaaacaaataaatatacagtggtggccaggtgtagtcacagatgcctgtaatcccagcactttgggaggccaaggcaggcagatcacttgagctttgtagttcaagacaagctgggcaacttagacttcatctatactaaaaataaaaaatacatgtaagtgcttagaagagtgcttggcacatagtcaacactatatccacatgaagtgattgttatctttctgtatgaatgagggaaactgaaaacccacagaagactctttgtgctgtttaaatcatgcaaatgggccaggcacagtggcccatgctggtaatcccaacagtttgggaggccaagacaggcagattacttgagcccgagagttcaggacaagcctgggcaacatgctgaaaccccacctctataaaaaatacaaaaattagctgagtgtagtggctcacacctatagtcccagcttgagagtctgatgtgggagaactgcttgggccccagaggtcgaggctgcagtgagctgaggtcgtgccactgcattctagcctgggtgacagagtgagaccctgtcttggagcggggacggggttgggggaggaggggcggaaatagcaataaatattctgaaatgaaatttttaaaagtataaaatgtctacattgaaaactataaaacatcattaaaagaaaataaagactcaactaaatggaatactatctatgtgcctgaattggaaaatataatattgttaagatgtcaatgttccccaaactgacctacagatcaatgcattttctattaaaattccagataattatttttgtagaaatgaatgagccaatcctaaaattaacatggaaatacaagggatccacaagagctgaaaacaatcttgcaaacaatcttcaaggaggatggcttgagtccaagagttcaaggctacagtgagttatgactacgccatctcaccccagcctggatgacagaggaagactccatctcaaagaagaaggaagaagaaagaagagacagaagaaaggaggagggggaggaggagtaaatttctagacaatagattaggcaatggttaccatttttacatcaattattaagtattttaaacataaaagtggcctaaagaataatatactaaacacttatgatggatcactcagattaaaaaatgaagccctgtgtagctcactccctgatcccatttaaaaatcatcagatctggtcaggtgcagtggctcccacctgtaatcctagcactttaggaggccaaggtgggcacatcacctgaggtcaggagttcgaggccagcctggctaacacggtaaaaccccatctctacaaaaatacaaaaattagcccggcatggtggcacacacttgtaatcccaactactcaggaggctgagggaggagaatcgctcaaacccagaaggcagaggttgcagtgagccaagatcgcgccattgcactccagcctggatgacagggcaagactccatctcaaaaacaacaacaacaacaacaacaaacccatcagatcccaagattgcccatttgttcgaattagcaaaaaaagcattttaaaatagctatcttgagatggtatcaaatattctaacaacatttgtaactggagtttcagaaggaaaaaagaaattgtagcagaaaaaatttttgaaaaatattggccaaaaattttctaaatttgatgaaaaacaatgaaagtccaaaaggtacagcaaatcccaaagaaaattaatataaatcatatttagggacatgagaatcaaattgctgaatgccaaatatgaagagaaaattttaaagtcaaaggaaaaaaaggtacacgacatatgaaggaatgacaatgggatgacaatctgagtaatcatcacaaataaagccctaagaacatggaacatctttaaaatgccaaaaatttgatagtttgtaatgatgttaaacatatgcctacttcatgaagtaactccactcataagtatttactgaggaataaaaatatatgtctgcaaaatgactcaaaaaagaatgtttatagcactgttgttcacaatagctctaacaatatatataattcttaactacaccaacaaatcaataagcacaattatatacattatatataatcatataaattaaatacaatgtgtgtatatacatatacaatggaacacacctgagcaacaaatgatatatggaaaaatatgtatgaatacatgcataactatgttgcataacacaatcagaacacaaaatacatactatgtaatcccacttgcgtaaaatttttagaaaatgtaaaactgacttatagtaataaatctgtggttacctaaaggaggtgggaaaatgtacaagagaataaggataaattttgatataactctttcctaatattcttaatttctttgtgtttatatgctttaggtttgtctcttgtaagcattctacagctaaattttgctcatcttccttaatccataatgttttttaaactgttcagtttagtccattttaacttactgctataattgatacatctggaatttttttctgacatcttagtttatatttttttatttaccttaactattatatgctttcatccaggcttctattgttttctttgtactttgacttcttttgttccacaaattgtatactttctgctttatttatccttaaatgtttaacatactcatgaattctaaactaataatctgttctctttctctaaagagtacaagaaccttcaaatgttttaattaaagtcatccccttctcattagggatgttattgctacccaatacttacattcaccttgtttcttttccttcatcaagcaaattaggtataagttttataaaattgttgcttatttagctttatatatacatttaccaagttctttattaaatatcaaaactttctagtgggttcagcttctatcttgctcaactaaatttttaaaatctatataggtgagcatctgttcagattactatctagctttaataattgctatcattcatatttgcctggtacatcactgtccatccttttattttcacctctttaattaaaaatcatgtagctatcacttaaactactgaaaaattcattgagagtttaactggtgagtgtaaaccatttatattaattttaaataatacttgtttctggcatttcatttcatgtttttcatttatttcactctttcatttttttccttcttgattttcactttataaggtctcttatgctaccttaaaagataaaaattgttattactgtggttgtccttaaggtacacgttcaatttatttaattatactgatttcctaaacttgaaaagattatgttaattcaagagcagtagagctccccgctttcccttcagttttcaccaaaatgcatgccagtatcttctatatttgtctctgtataccatctgcaagcagtaattctgatcatatacaattttttattttggatattcttagtttcatgaaaaataatctcttctaggcatttacttgtaacttgtatcaggcttcataacatgtaattaaacatttttattggaataaaaatttcaaagttaaacatatatatgttaaatgtacagttaaataagttttgctaaatgcattcaccacactaataaccaccaaagaaagatacaaaacatttccatcatcaccaaagttgccttatgccccttcttggacaatctcccacacttacttatgggtaaagacaatcactaacttgctctccacacagattggcttgtattgactagaactttatacagatggaataaaacagtatgctttgaggataggccttcccttagcataccactttagagattcatacgtaaaagtcttttgtgaatatatactttcatttcttaggtaaataactgagatttgaattcatgaaacatatgggaaaaatacgcttatctttataaaactgacaaactgttttcggaaataactgtaccatttgacagtgccaagagacagtaggagagctccagttgctccacatccttatcagttcgtatttcaacttcttacattttagccactatagacgtattagtgaccttagtcagattacaatttgcctttccataatgaaaaagttgaacatctttcatgagaacacagataaatcttcttttgtggaagtgtatgttcaaatcttttgcccatttaaaaactggcctgtttatcttattattgtaggagtttttatattttgttttcaagtccattatcaggtatgaatattacaaattgtaataaatactgtttcccaggctgtggtatgttttttgttttcttaatagcagttaagaaaagtagttttcaaattggctaactttaccaatttgttaattttttccttttatattcatgctcttatgtctcatctaagaaacttttgcctgtcacaagattacaaaaatttgtttctcaggttttcttctattttaagacaaatttaatagttttggtccttacatagagctgtatgacacatttcaaaattaacttacatgtatgatataagggtcaaagttctcttataccttatggatatccagttgttctagtgctatttgtttaaaagactatcccttacccccactaaattatcttggtgccttaacagaaaatcaactgactgtgtatgtgtagatctacttctgtactttgtatttggttcattaatccattgatccttaacaccaatagaacaatgtcatgaatattttagtcttaaaatcatataatgtaaattatccagctttgttctgtttaaaaattgttttggacagtctgggtattctacatttctctataaagtttagattcagcttgttaatttctaccaaaaaatctgctattatacttattgggttgaattcaatctatagatcaatctgagagagagctgcatctcaaaaatacaaacataaatatgtatctctcttcattgtattcttcagtttctcctagtagtgcacaactcttaaacatatttgttaaatttatccccaagtatttcatgtttctgttaattatccactgcatattaaattactccaaaatccaacactttaaaacaagttatcatctcatatagtttttagaggaacaacaattcaggagtggcttagctgggtggttctgactcaacatgtctcaagaggttgtattcaagctatcagccaaggctgcagtcatctcaacattggaatgaaggatccacttctaaggtcactcacatagttggtgacaagcctcagttcatactgagttttggctactcacaaatagcatcttgtctctccaagagacagtgatttcagagaggcctagcaagtaaagcagtaccccagaaggaaattgcagtcttttacagaaatcgtaaaagtgacataccatcatttttgccatgtgctttctgttacacagaccaactcttgtaaaatataggagaggactataaaagcttgtgacatctaggaggctggctgccatagatgtacagtacatggaatttgtaaatcattttcttagtgctcatggctaggatattacaattttctataattacttggtatcccgtaaaaatgttaaactcactttttagttttaagagcacttttccttaaataggaagtgtgattccttcacacttcctatattaatgaatttgttgactacttcttttcaatctatgtacaatttctttttgttgcctttttgcaccacctgtgacctttagcaaatgtcaaatttaagtggcaaaagatgtctttgccttgttcttaatgttagggaaaaagtattcaatctttcactaataactatggagtttgctgtaggattttcatgcatattcttcataaagtagaggaagttggtctctattcctaggctactaaaagttttaaaatagaatgagcgtggtattaagacaaactttttctccatctactgagacaatcatatgtggctttctttttatatggttaacatggtcaagccaacctttctcatccctggaataaattccatgtggtcttcatgtattattcttcatgtattatctttaatatattgctgaattcagccagctattattatttctatatccaccattacaaagttatattggtctatagttttcttataatggttttggtaacagaataataacactggcctcatgaaatgatttggatagtgttcccttctcctgttttttgaaagagttgaagagaattggtataatagtcatttcttaaataaaattactaatgagcctatcttggcctaaacttcgtgtggggggaaaattttagttaagaattcaatattgtaaaaagataccgcactattcatattttctatattttcttgggttgattttaataaccgttgacgttcaaggaatttttccatttcacgtaagttgaactgattgccataaatgttcataatctctttgtcaaacttttgatttctgtagcatatataattgtgtccactctttcattctaggtaatagctttgtgtcttctctcacttttctagatcagaatagctataactgcactatccaatacagtagccactagctatatgtggctatacaaacacattaaacaaaattagaacttcagtttcagctgcaccagacacagttcaggtgcttaacagccacatgtggctagtggctacagtactgacagtgtagctggagaacatttccacatcgcagaaagttctactgcaccatgctggcctagagatttatcaacttcattgttcttttcaaaaaaccagctttaggccggatgtagtggctcacatctgtaatcctagtactttgggaggccaaagcaggaggattgcttgaagccaggagtttgagaccagcctggacaacatagtaagactccatctccacaaataaaattttaaaaattagcagggcatggtggcatgcacctgtagacctagctacttgagagactggggtgggaggatcacttgagccaaggaggtcaaggctgcaataagccatgattgtgccattgcactccagtctgggtgacagaacgagctcctatctctaaaatatgaaacaaaacaaagtaaaatggtggcatgcacctgtagtccgaggtgcttgggaggctaaggcatgagaatcacttgaacccgggaggtggaggttgcagtgagccaagatcatgccactgcactccagcctgtgtgacaagccagactccatctcaggaaaaaaaaaaaaaaaaagttttatttactttacttccttttacttatttggagtctaatatgctcttttcttcctagcttaaggtgaaagcctcaatcactgattattttaccttacttttctaatttaagaatttaaagctgtaagttttctcctaagtacttctttatttatattccctaagttgtaatatgttgtttccatcatctttcagatcaaaaaacttccaagttacccttatgaaattttttcaactcattagttacatatacattttatttttcaaatatgtgagggtttcccagatatatctgttaattgatttgcatttaattccattttgatcagacaatccactaaactttcaatcatctgaatgaccatcctgatacctgaggttagggacattaaagtaggcactgtcagcatggtgagggtaatttaggtggagtaagccctcagcccttccctggcaattgctgatccttcatcttgctgatgcacatcatattctcaatcatcccaaacaggactgaaggccaaaagaatgggttcaaattaaagttagattcttcttttctacccctgctctccttctgccatctgattccttctttctagggctcctgtcatttctggaagtgagctgtagctcatgctccccaaaacttcaatttttcctcactcctctaatttcctccctgagaaatttcagagaagagccactttggagagaaggcgagagcaccagaaagaaagagaaggaggaaaggccacaatacctttatgtcttaatattgaaggtcacacactgtaacttctgccacattccatttcttggaagcaagtcactaagtacaggacatgccttatgaagggggcagtatcaatttgtggacatattttaaaccaccaaaataatgtcagattttttactttaaacagtcatttttttaattaagagaagccaagaaaatatgtgtagtcatttatatttttatacatatttattagttctgccttctttattccttccagtaattcatgcatgtatcagcaaactagagtccatggcctaaaccaaacccactgcctgttttttgtatgacctatgacctatgaatggcttatatagtttttaactgaggagaaaaaggagaacatttttgtaccatgtgaaaattgtttgaaatttaagtatcagtgtccataataaagctttattggaacacagctaaactcatttatttatgtattgtctatggctcccttcacagaagagatgagtagctgcaacagaaaccatactggcctacaaagcctaaaatgtttgctgtctgctttttgcagaaaaaatttgccaacccctactatagacccaagttacgatcatggggtgatttccctcgagcctgaagaatttctattatcattttccatataatacatatgttgacaaattcccagactctgttagtctgaaaatgtatttcaccttcatttttgaaggatacttttgctacatgataacaggacattgtggataacacatcatagcaacagtggatactgttaggttcttctgaagattgttaatttttcttctgtcagttaatctgtctggactcaaactgcaaatacagaaattctggttcaaattttttttgtgagggggggggatgtgacatattaaacatgattttttgacaccttttggcctccattatttttactgagaagtcaagtgttaattatctcattattcccctgtatttaatatgtgtatcttttccaggctgctttcaagattttctctttatctttgacattttagcagtttatctataatgtgcctaggtgtagttttccttcgtatttaccctgctttgtggtcactgatcttcctggatctgtaagctagtgtttgtttgtttgttttgagacagtcttgctctgttgcctaggctggagtgcagtggtgtgatctcaactcactgcaacctctgcctcccaggttcaagcaattcttgtgcttcagccacacgaggaggctgggattacaggcgtgcaccaccacacctggctaaattttgtatttttagtagagacagggtttcactatgctgggtgtttttttgttttttttttttttaaccaaataagggatgttttctgccactgtcttcaaataattttcgacccctttatctctcatttcctatgggactccaattaaggcagaaagacttcagtttttcccacacaagctaagcacaggcagaaaatttcctcagtttttctaaaaagcagcaaacttgcatagctcagctattatagttatgtctttcaaggattatctcttatttgatttccacttttttttttttttttaatacggttcctggggtcttccctgcatactcacagcagtcgccagggatatgggcagagttcatactttaatttgggttttagccctttagcagctctctcagtcccaggattttcctcctaaaccccaagctgctctgaaagtcttctaacataataagccagtatggtggtggtggtggtggttttctatctctgaaactatgcaagttaggaaaccccttgtataaaaagctacaaattcacaattcttacccactgctttactacctttaaagaataaacttttccctactttctgcctacttttggtctttttccagtacttttaaatatttggttattttaaaaatttttttccaggttttatcactgttacttgtgggaggattcattcacctcaccaattcaccactacctaaagctggtagttccgttttttttaagaacaatttccaaaacttgaatctacagttttacgtataataaaatttataacgtgatacctttttataattagtatattgctaatactatcgtggaaaatggaataaattacataaaataatggaagagctccaacgtccacaaaagtagaaatttgcaagtgaacacacatagacacacaatttcttcatgcagcctatgctgaaactggtgccctcctattcaagatccatatgtagctggcatacaatcaggtctggggttgtcaggctgggtcatgaaaaaacaaagcaaataaaccatttgcaactatttaagagttaatagaaattaatttaagtgttccaaaatgttttatagactattttaaataatgtcccatggattaaaagacagaataggaagatgaataactggaatgaggatttgttacattcctcttagaaacaacagcaacaattaagaataattttaaggatgtctttttaaaacaaaacacttacctttgttcctcttaaaatgagaaaatactttaaatactgtttttcaaaacacattacacacttttgttttaaccaagacagcaatggcaattgaaaaagaatccacaacatttgttcttaggaattctacttatattctcctctcactgacaactggatagtaaaatttcatggaatttcaaccagaaaactgtgaaattagcaaactaaatcagtggtaatttattaaaagctcagaacagattatgtaggtccattatacgcaaattgctgagttgtctttgagtattttgaaggatccacttattctcacaatagcagtgcctcaataatagtaatcttacaactggcaaaagaatcaattttcatgcagaatgagtacaacaaataaagagcaagaaaggaaacggagaccaagggcatcttttcacaccaattttataaaaaagcaaacaaaaaagaacatgcaccatgattctgttattattcctcaagccaaaacattaatgcggtggttttgctctaaaccagacataggaaaggctggctgaagcactgcaatcaaactaagtggatttaccaatgatacacaaaaataacatttgctaatgttgaaatttcaagcataagcaaacagaaaaatcatccagatttagaaagggctatgacaaaactttttgggaatgctgaatatattcattatcttgactctggagataatttcatgggtgcctacatacgtcaaaacttaccaaattgttgtctttgcattcagttttttacttcaattagacctcaataaagttttttttgttgtttttttttttatgagcaggaaagaaaacattgttgattcctatccatcacttggctacttgaaagacaaatagaaaccaatccagtgactgtaaccaagtataattaacaatccaatgatcacaggcaaacagaaaagtcaccaaagttaaaaaagtatatcagtattttcaaaagaaagtactaaagactcaatagaaatattcaaagactgctcagaggtttatggaggccatgttgcccatacaatctatatcccaccctggtgtaggatgctcctggtttccatttccaaatggatatgtgataacagtttatcaggatttgtagccttactgtacttctcttccttgcatctctgcagaatctctaagctcctctggtggactgggtgttggagaaagctaaaactatccatacttttcaaaattgcacatggcgctgtatcatcatgtccttaggaagcaaaaaaaaacaaacaaaaaaaaaaggagaaaagaaaaagacattatataagcccaaaccaacagagaatcaaggacaatgctgccaactatttaagggtgtataaaaatgtatcaaataatagaggttatatgtgaatgtccaattattttgaggaaaatgcttaaaaataacaggaaaaaatacaggcatttttcagatattcaaagtgtccttttcagtactcaaagtattgttagttaacaccatactagaaatttctcaatacaagcaaaaattcaaaagcaatttgtatgatttattttttaaaaggacttatttttatcaggtctcaaatataattaacatatagttggcaacactgatggaaccccaaagagaaatatacccagaacaatttacttaaacaattctttcacaaatcctgcaattaaccacacttgtaggaattccaacaagtgtgtcaataatgaaaacatgaagaaaagcaccatagagcaggaaagcccagcagcacttctgtacttataaatttgaaaacaaagctgaagactctgtacctcattatcacttcttaggaaaataggatagaaatcagctaccagtgaaaaatagaagagagcacattcaagtaaagaccaaagccccagatcagtgttatttaaagtgagtacttaggaaataaagtgaatgggagatgagtgccataaatattagcaataaagagtttccaggctttagggtggtggttgtgtaacatttattcagagatcacctctagagttagggcataatgttcaaatttaaataagtttgcttttaaaaaacaaagtacataataatatagaggcaaattaagtaacacattaaaatgaactaaagttctattactgcattttactgtataattaggaatgagatacaacagaacaatctttggaaaaatctcatagcagaatcattttaaaagttaaacagtctcatactaattcaaagaggtttgtagggcatattttagtctcattctaattccctaaattggatttatatatccagagaataggcagccatatttggcaatggagagggaatctaataccataaatcatgtaatattatacacagaaaacaggcttttaaaaaataaagtgaatttgaaatatttttcataataaaagtaactaaactaataaaatactatattatttgtacaatacgaaaagtcaataggtacaaaggttgaatgtttcaaaaagagaagtataaccaagcttaacatcatttcttactcaaaagatacctcgataaacatactctgttctcattattaccagtaatccccccttgatggattgcttggagaaagaatgcttaggccttaaactccactgcacttggtttggcagtcagctgaaggggaccagttgaggaaaaaacacccagtgagttctagtcagactccattcaaattgtaaattgaagaagttatcactaaacaatcacgcctttcaacagctaatctgataatcagctagtcaaaaataattcaagaatattatgtgttaaagtattctgtataagagctcaggatattaaaatacactaatttattatgtagagttttaaaaaatcaatcaacattactacaaccaccaaactattttctatttcatctaataaactgtggcactgccatttaaaaatgggtatttttgtatctgtgactgctttgtctcaccaccatgcctagattagtttctttaacctctctcctgttctttcattctgctttctatacctttttacagttttgaacgttattttccagactgtgacataatttctaaatcttaaagtgatattccctgtttgttttatgtaccaaacccctgccaaggtagtttggtttcccaggatggtttatattttcagtggggattcttttctgaggagtctcatcaactgtttttttgttttgttttgttttgttttgttttgttttgttttttgagagggagtctcactctgtcgccaggctggagtgcactggtgcaatctcggctcactgcaccctctgcatcccgggttcaagcgattctcctgcctcagcctccggagtagctgggactacaggcacgcaccaccatgcccagctaatttttgtatttttagtggagatggggtttcaccatgttgagcaggatggtctcgacctcctgacctcgtgacctgcctgcctcaacttcccaaagtgctgggattacaggcatgagccactgtgcccggccatcatcaactcttttttctttttttaagatggagtcttgctctgtcgcccaggctggagtgcagtggtgcgatctccgctcactgtaacctccgcctcccaggttgatgccattctcccacctcagcctcctgagtagctggaactacaggcgccagccaccacgcctggctaattttgtttttgtatttttagtagagacagggtttcaccgtgttagccaggatggtctctatctcctgacctcgtgatccacctgactcggcctccaaagtgctgggattataggcgtaagccaccgcacccagcctactcatcatcaactcttaaaagagatttatttagtatttgcttatgctagttgctggactggttgtgatgataatttcttagtttgacattatgcaccaaacacatagtataaattcagaccccatactcatatatggtgcagatgtggggcattgatttttttaaaggtaacttctttttaaccttatctaaggcctaacacagattgctaaggctcctcattttttcttatgcaggaccagcaattttcaataatttttttagtgacagaaaagttccataactttgaaggacttggactatgtaacagaggctcagtcccagctccaaagtatcattcagaccttaggcaatatctttggccctataaaagtttctgtaatgtcaattcaaaggccttaaggccatttttaaaagccatatttcacaaacataaaataacgcttttcttaagtactcagtttgatgaatttaaacaaacgtttacatccacaaaatcctgaatcaagatagagaacatttctatcacccccccaagttattttatctcccttcctatcaatactacccttgcccctgatcccaccagaagtaatcaagttctgatttgtcacaatttattacctttttttttttttttgagatggagtttcgctcttgttgcccaggctggagtgcaatggttcaatctcagctcaccacaatctccacctcctggattcaagctattctcctgcctcagcttcccaagtagctgggattacaggcatgcgccaccaagcccggctaaatttttgtatttttagtagagacagggtttctccatgttggtcaggctggtcttgaactcctgacctcaggtgatccacccaccttggcctcccaaagtgctgggattacaggcgtgagccactgggcccagccatgttgtctgttcttaaactaaagaaataacacagcatatattctttcatatctagctttttgctgaggattttttgtgactcattcattctgagtatcagtggtttgtttcttttcattgctgagtaatgttacatggtaggagtatatcacaatttggtcatccattcttccactgatgaacattcaggaactattatgaataaaagcactttagaatattcttttttatatgtttgtaacagttttattgaaatacaattcacctactaaacaattccttgatttaaagtatacaattaaatgcttttagtataattcatgaagctacataaacattaccacaatcaattttagaacattttgatcatacaaaaagatactcacactctctatcatcctccccatctcttagctctatacctgaccctctagccctaggcaaacactaatctaagttctgtctctacagatttgcttattctggacaattcacataaatggaatgatacaatattccattttgtaatatagagtattgtatgattccatattacaaatatggaaactgtacttctttgatataatgagaaccaggcatggtggctcgcacctgtaatcccagacactcggggggaggctgagcagcgaggatcacttaaggccaggagttcaagaccagcctgggtaatacagcaagacccacctccaaaaacaaatttaaaaaaagaaaaggccaggcatggtggcatgtgcctgtagttccagtgtcttgagatgctgaagcaggaagataacatgagcccaggagtttgaggctacagtgaactgtgatagcaccactgcattccaacacatgcaacacagcgaaacccggctcttaaaaaaaaaaaaaaaaaaaaatatatatatatatatatataaaatacgcccagcgtggtggctcacgcctgtaatcccagaactttgggaggccgaggcaggtgggtcacctgaggtcaggagttgaagaccagtctggccaacatagtgaaacctcgcctctactaaaaatacaaaaatataaaaatagccaggcatggtgacgagtgcctgtagtcccagctactagcgaggctgaggcaagagaatcgcttgaacctgggaggtgaaggttgcagtgagccaagattgcaccactgcactccagcctgggcgacagagcgagactccgtctcaaaaaatatatatatctatatatatctatctatatatctctcttatatacacgtagcatatgtgtgtagcatatgcattagcatatatacacatatgtagcatatatagcatatattcatatatgtagcatgtatgctatatatgtatatatgtatgctatatatatatgctatatatgctatatatatatacacacacacacacacacacacaaatatatatatatatatatatatatcttaatgctttcaaggttcattcatattgtggcatgtaccagtatttcatttcttttatggccaaataacatgccatgtatggatataccaccttttgttcatccattcatcagttgatggaacatttgggttgtctctacttgttggctattagaaagatgttgtaaagaatatctgtctacacattttgttttgtttgttcttctaagtacatacctaggagcagaattggtgggtcaaatacaattctatatttaactttctgaggaactgccaaaacgtattacggagtggctacatcagtagtatacaagacttctaattttccatatcctcactaaaatatgtattaggcactgtctttactgatattcagccttttgtcttgtataaatacttctcaggttactgggagcctttgattaaattccagggttctgacaaagttgttttgacaatttttgccaattttctcattgctattatgaaaaaaaatttagaggtccttaccccaccatttcactgatgtctatccaaaacccttattcttaattgccctactatactgcccaatacagaagtaatttataaaaaaagtccttttttttttaacaaaagtttatttaaatctattaagtactaggaagaattgtgtacagagtacagcatagagattctagacttatggtgatacccaaatcaattttagtatctggtcatttttgaaaatagatggtcactagaacgcttctcccacttacataaacaaacagaagtacatcagagttacatagtctattgagtgggatgaagaagagaaacaggttctgtggaaaaccttgaagctctctcatctgcagacactatataaagggtttcagcttctctctttgtagatgaagaaactgaaaaatactttggaccctcttgttcacgtctcatcctgatggcacagctgaattacccatctttgcctagcctttttagactagtttaaattcctatttggctatacttttattaataactccaaaagaatcaaataaagcatcattgtactcagttctacatactgtataattcccagtcaggttatttctgtataattcccagtcagggtgtttcttgacaattaactaagagtccactgaagtttttaattaagatatcatcaaaggaaataaaaacatactgtaattctgcagatttcatcttctttcttctttagaaagtattatctttgccctcttattctcatatccaacatctagaattggtcacctcaccttttctgcctttcatattttctacttcgtcttaatctgtaattcctatttcatcttaatatgactgcataatatttacggtcattataaaaattctggatctaccatttaaaccatttttacaatctgttagtttttacagtgatacaatgttccaactttataatatgtttttatcctaaacctaccaaaagagagtaggtaggaagcggtgtggagaaaataaaacgttagggtgaatgctggcattgacactgatatattgtaatataaacaattactttcggaaacaaatctgctcaggcttcaaaatgcaaacaaactagagtttttcttttcctttataaaaagtaaaaattttaaagttttttccaaggagaaattttgggtggctggaatgttgtgtttcttaacctaggtggtagttccagggttgtgtttactttgtggtactccactgaactatacatttttgctttgtgtacttttgtatatgcatgttatgttgaatacaaattttcaaaaagagattattatatggaagctctgtactagccagaagggaaaacaagattagaaaataaggaatctagactttatcaaggtagagaaaatacaggttgtttatcattaataacattgcatgtcattgccgatattgataataacagatatgtaacaactagctttcacaaataatagattttaaatgccaaaggaatatacagataatgtgaataaagtaaataggctttgacagtaaatacaagaaaagtttcttctcttactcaattatgtcttagcaggatgctaatcaattttgagtggttttcttgattagaagtttgtcataataaacaagaaagcatcttaaagaaaaaaaattttccttaaagctttttacaaagataacctcttagaaatcactttgtaaaaggcaaagcaggtttgagatagtccttttatttctctaataaactataattctccctatacatctacaaagaccagttcaaatactttacaatctaaaaaatggaaactaggttcaattattttacatgtatttttagaaatacactctctcaaatatatctatttgtctcaaacatttaaaagctaaacttaaaagttttactactagtgcacatcccaaaaagccacgtaaatcactttgggagtcctgaaagcacaggtgagccctataacatttctactgaaaggcataaatctcaactgcatatgtatcacaaaatcttctctatgcagcaatggccctatctaagactagagctacagcaaacaatagtttggtttccagtaggccaaaagtgcttatgaagttgccctcccacagaaaatgagatgagagattttatgattgaagggggaggcatacagaaaaagtatcctgctttatctatttctaaatttcaaagtttttaaaaatccatgaactaagagtaaaggaaaagaaaatgaacacttcatgaacagatgctctgactttatcctcattattttaaaggcagtataactcttttacagaaaagaaaaactgttcatagtcacaaatcagttaagagatgacactagattgactacagaagcaggatttttgtccttgagaatctcatagcaagaattctactcctttttgtggagaagtagaaaggtaaaaaaaaaaaaaaagatgaagtatggtagaatactaataactactacttaccagtttttctgtgaatgtttcttttcccagcttccctgaaagcaaccatggctctgaaaaaagctcggagaattgcccatcggaaaacagctacaggatcaattccaatcatcccagagataaatgcattcttgctgcttctcagaagagctacaatgtctgggcgcatatgatctgtatttttttcccggaaatcctatatgaaaaaagtaccagtgttacttatgggaaaaaaaaattatgaaaaacaagatgacgggtgataacatactttggatgcttgtccctccaaacctcatattgaaatgtgattcccccatggtggagatggggcctggtaggaggtgtttgggtcatggaggcagatccctcatgaatggattggggctctcttcaaagtaatgaatgagtttttgttctgaattcaccaaaatctggttatttaaaagtgtggcactcctacttctccatctcgttccctctctcttgccatgtgacacatgtgcttccactttgccttccaccacaagtaaaagctctctgaggcttcaccagaagccaggtagatatcagtgctctgcttcctgtacagcctgaagaatcgtgagccaattaaatctcttttctttataagttgcccagccataggtgtttctttatagaaacataagaatggactaacccaagtgacatgtttgaacagtggttgaacaatgagatagaagaaatgtctgctccaggtagctaactggaccgggtatcttctataaggtctcatccaatcctaaaactattgatttctataatacatgtaagttagaataaatattctataattttatagcagcttgttaaactctggtcagggacagcctctccaaagaggtatcacatacagcaacaggagagctgaataacaaaaagaagccagagatgagaaaactgggaagagcaagcaagggtaacacctataacctatagatgatgataagctggacaagttaggagaaaaaggataaaaaccacaggctggagcactggggacaaggagaaagtgtggaagattagataaataaataggctatttagactctgaacttcagttgtttgttcagattttattcaagtataaaggaaagccctggaaaggtaacaacatgagctaactggtgtcttatacattggttgctgcataggaaatgaattattcaaagaaagaatggaaaaaaggaggcacaatattagagtaaaccaggtaagaactgctagtaacttggacttggtcagttgtaacagcagaaataaaaaatagctatatttgggacatgtaaaggcaaaaaacctgctgattaattagggtatgatgagaaaatgaggaaatcaggttaaaacttacattttggggttgggtatttagtggatggagatgccatatactgataaggagaagactagagaaaggaaagttatgaggataagaaatgaagaccaagagatcagttttttccaagtgaagtttgggccagtgaggataataatagtaggtaacacttgagaggttagtatgtgtctggcactcttctaagtattttacatgtattgtctcatgtaatctcatttaatactcctaataatcctttcagatagatattactactctcattttatagatgagaaaactgaatcagagagaggtgaaatatcttggctcctatcacacaataagtggaagagcaagggctcaaaaacattcactcataaccaaatggatgtgtgagtctggagtgctagggagatttcagaaattatatttggttattatcaccatatagatttttttttttaaacaaggtctcgctcttcaatacagtgcagttggcaccatcatagctcactgcagcttgttaactcctggactcaggcaatcccctgcctcagccttccgtgtacctgtgagtacagatgtgcatcaccacgtctggctaattttttttcattatttttgtagagacagagtcttgccatgttgcccaggctggtcttgaactcctggcctcaagtaattcccccacctcagcctcccaaaatgctggaattacaggtgtaagccattgtgcccagccagcacacagatttttaaaactgaataagaaggattgtaaataggcagggacaaccatctaccaaagaacagaggttggaggagctagaacataagaaaatgggttaaaatgcaccataaataaatggggagagtaagcttccactctgggaacaagggcccagcctgatattacagcataggcattgactataatcttaccaaatggaaggattaaaaatttggtaagtaaatcgctccaagttggtacagcttcatagaatatctctaactcagaattctatgagaaacatacctagtatcatgtcatctatcctcatgtacagaagtcagcttgcacttatcctattacttttagggttttcctttcctaattcttctttattctcctgagaacaaggaaaaacaggaaacaagccaggaattttggtccttggcttgtccttacatacccttagagcaaacgtatgtattataaaagaaaattagaaaaactgaataagagtactcaaatccaaataacctctgacaccataatcagcagctaataactactgatggcagacaagctgtgaggcatgaacttaatgtattttacgtaacttatttttacccagttctaacaactactcaataaagcagatttagtcataagccataatttactgataagtaaacagaaaggtaaagcagcttgccaaaggtcaaagagacaataagtaccagtgcagaaactgaaacaccagtctgccctactcctattaataactacactgtacaacctaaaaacctaggattcttttcaatgctgactgtcaagtgttgagagtgaccagtgaccttcattttcaaaatgaaataatctgtcttcatatttctagatttctaagtacattatcaactgaccatatcattcttcttcaaaatctctctctagtttccacaagaacatactttgtggtttaccatttacctcctatactgcccttctaagtcctcattgctagttcatattggaaattcaagggtgggtttaacagtgtgtactcatttctctttttttggtttgtttgttttttgagacagggtcttgttctgttgcccaggctggagtgcagtggcaccatctcaattcactgcaacctctgcctcccgggctcaagtgaattctacccctctgcctcccaagtagctgggactacaggcacacaccaccatgcccagctaaccattggtattctgtgtagacactaggccttcccatgttccccaggctgatctcgaactccaggacttaagtgatccacccacctcggcctcccaaagtgctgggattacaggagtgagccaccacacctggctgtgcactcatttcttcactcaaccctcttatatcaagtgatcagaaccagagttacgactttattttattttatgtatttagagacagagtttcgctcttgttgctcaggctggagtgcaatggcttgatcttggctcaccgcaacctccacctcctgggttcaagcaattgtcctgcctcagcctcctgagtagctgggattacaggcatacacgccaccacgcctggctaattttctatttttttagtagagacagggtttcttcatgttgatcaagctggtctcgaactcctgacctcaggtgatctgcctgccttggcctcccaaagtgctgggattacaggcgtgaagttatgactttaaattaacaccatcgcccaaatgcaaatttccagatcagatctttcttattatttcttgagatccattaacaaatcttaaaggatatgtctaatttgaaagaaaatgtgtaagaccagtagtacatttaaatgtttggaagcattcactagtaaaaccatgtgggcctgggatttcctctgtggaaaagttctgaactactgattcaaattatttagccaacagaattttcaggtttttctatttattctggtgttagttttggtaaagtgttttttaatggaatttatccattttttgttttcaaatttcctgacaaaatatatgcatatccttctaatatctgtaggttatgtagtaaagttcttttttcattcctggtatctgtaatctataattttttttatattatcagttattttcctattgcatttaatttatattattttgtgttatcttctcaaggaactaacttttggcttagttgatttctttgttcaatgtctgctttatattgcactgatttctggtcttatttttataccctttctctaattcctttgagtgtgatttctcttttcctagtttctcacatagaagcttagagaaccacttttcaatcaagcatggtggctcacacctgtaatcccagcactctgggagactgaggtgagcagatcacttggggccaggagtttgagaccagcctagccaacatggcgaaaccccatctctaccaaaaatacaaaaactggctgggcgcgatggctcacatctgtaatcccagcactttgggaggtcaaggctggcggatcacgaggtgaagaaattgagaccatcctggccaacatggtgacaccccatctctactaaaaaaaaaaaaaaaaaaaattagctgggcgtggtggcatgtgcctgtagtcccagctactcaggaggctgaggcaggagaatcacttgaacccgggaggcagaggttgcagtgagccgagatcgcgccactgcattccagccgggtgacagagtgagactccatctcaaaaaacaaaaacaaaaaaattagccaggcatggtggcacaagcctgtagtcctagctacttgggaggctgaggaacgagaattgcttgaacccaggtggtggtggttgcagtacgccaagatcgcaccactgcactccagcctgggtgataaaacaagactcttgtctcaaaaaaaaaaaaagtttagataaccacttttcaacttttcttcctttccaacatatgtatttaaagttataaactttcctacattccttgctttaactgtatcctacaagtttctgataggctggatttcattaatgttcagtataaaatattataattttaataatttattataagtaatttatattgtcatttcttttttgactcatgggttattcagaagagttttgcttagtttctaaatatccaatgattttctaagttatccttatgatgtgctaattaggtcacctatttaacagtgctatttgtattgattttgtgttgcttgttctgttagttactaacagaaatgtgttaaaatctataattttttcttttttaagtttttttctttttccttagaaaaatattgaagaaaaaaatctacaattatgatggtgcacttatctaggtctacttttgctttccttttgctttatatattttaaatcagtcattagctacatataatatcaagtggctcatgcctgtaatcctagcactttgggaggccgaggagggtggatcaactgaggtcagatgttcgagaccagcctggccaacatagtgaaaccccatctctagtaaaaatacaaaaattcgctgggcgtggtggagtacgcctctgatcccagctactcaggaggcagagaatcgcttaaacctggagggcggaggttgcagtgagtcgagatcacaccacttcacttcagcctggcaaaagagcgaagcgagactccgtctcaaaacaaacaaacaaacaaaaaccccaaaaacatttagtgattacgtcttcctgttgaactggccccttttatcattataaaatgtccctttgtatctctagtaatatttctggtcttaaagtctattttgtcctacaattttttttttttggagacagagtctcactctctttctcaggctggagtgaaatggcactatctcggctcaatgcaacctcctcctcccaggttcaagcacttgtcctatctcaccctcctcagtagctgggattacaggcgtgcaccaccatgcctggctaatttttgtatttttagtagagatgaggtttcaccacgttgaccaggctagtctcagacttatgacctcagatgatccacccatctcagcctcccaaagtgctgggattacaggcgtgagccaccatgcccagcctgtccagaaataatatacaccagcttttatcctttctccatctttttactttcaacctatctgataacgcagatgaatatcccaggcaagtgtgtgtgtgtgtgtgtgtgtgtgtgtgtgtgtgtgtgtgtatgattctatttatctgaaatttaattaaaagtaaaattaagaatgataaaaattagggcagtggtaatctctgaggggagctggctgggaaggggtataaaagaaatctaaacactttatttgtgcactttatgcacaatatcctcaagtttttctatagctcaagcttttgttttactttttaaactatagtcttaatttctattctaaaatccattccttccagtattttccatcttaggaaatggtacctccaaagcacccatcagctctagccagaggtcacttactcatttagagtccatcaataaagtctgtggatggtttaccgccagaaatacatctcataatcatctggatcccccccaacctctactgccactccagtgcttcagtttaccttaagatttcacttcaatttaaaaaaaagtgacttaactgatcttccagattccactcttaccctctgctatcccttctcctcaaggtaatcaatgcaatcttttaaaaacacaagtcgtatcctctgcttaaaatattatcacagtgccactaatttggataaaagccaaactcaacttggcttacaagccctaaataataaccccctgtctattctctaagttcatttcatgttactctccttagttcattataatctagtagcacttacctgttttcaattatttcaccatatcaaactcctatctcctggcctataatattcatcatccgaactcctcatcaaggtaacatttatttcaggtcatctctcaaaatttaagtttcttagagaagtgttcatgtattcacaaattcaaaatccactattttactactttctctcataggacccattaacttatttataacacatagcccatttatctatgttatacaaatagatacacacacatatatatatgcacacacaatatgtatatatgcacatatgtatagagaatcaggactacatctgtctagtttatcattagatcattccaaacaccaagcacaaagtctgacacatgttctgtgttcaacaaatacttcttaaataaatcaataaatggatgaataaatgatcttaagacactcgactcaagacccaggagaaaacatttaattccactattctccatatcatcagctgccttacctgggaaattaaatgcctgaaatagcaggcttaaacatcaagtagttaaagaataacagactcacaaattacacaagaaatggacaacattattaagattccactccacataagagtttcaatatattcatgaaaagtacgaactgacaaatccctaatggtgaacagagacatgaagaccttatgagtgcagagaagggaaaaattcaacaaattatgtgcataaacaagtgagtttgggatatacagatgcaatctattctttcagatctaaagtttatcaggatcaactgacaacatcaggtttatctccaggcagaaaccaacagaaacattaccttacctaagacagtaatgtgctgaaaagcagaatctaagttttagtagtatctttatacaatatctccagttattactgatcaaaagcctccacaaactacaaagagggcagtgtgctggggacagttaagaacacatctctgccctgtaagcatattcagtgagaaatttactgacctttaccccatattttacttttccagcataatgttttataatgaaagcaggctccatcacggctggaaattcgatgtaagaattatcttcatgttgatgcttaaacttgtctagcaatgtttgatttgtagcctgtggaaagctgaattaaaaaaaaaagaaaaaatatcattacagaaagatgagaaagatgcggtaattagtacagcccttttcaaagtacattacaattacattgccatcttacatagcagtttacaaaagttttcacctatattatctaacctgattctcataacaagctaaaaagtaataataaatattggtgttactattttatagatgagggatcaaaagttatgatttgcctgtactcatattttgcaagtagtagtaccaagaaattaactcattacatatttagcttagattgcagtgttctgaactactataaaacccaaaggaaaataaaatccaaatcatatactctttggggccaacaacttccaaataagagaataatatctcgattctcataggtactaaaaatccataagaattatttgacttcctgttcctacatgcataaataagtagccattttcttactataccaattatttgtactcattgattgtactgatcaactgagcacttaatatccaggaatcacacaaataatatctattatttaatcgcataataggaaatatggaaatacaaaagttcaaaagaggaaaaaaatcatcactggtgtaaataatgaaaaagttcacacaggacatagtaggtgttaagactgtgatgttaaaggttgggaagggtttcaaagagagaaaatatcattgacagaaaaaggagaaagaaagtttcagaaaatagcttcatttaatggtagctgaaataatgaaaaataatgtgacatgaggttgtaaagttgcttaatacaaatctaatgtgtaaaaatcattccaaaattacaacaaacatagttaattacatagtatgcattgcaaaccatacagagaatggcctttagcatcagataatcatagtttacattacgcattctatcagtgacctggggcaaactaggtaaccttctttgagaaggggtcttctaacccacaaaatgagataccagttatcacagtgccagtagaattaaataaaactagtaaaaacatctggcaaccgcaggcatcctctagggattaaacaaacatcgacttcatgttgccaacactgatattttcttggtcaccttgacctgcttttgtattcaaatatctcttcctcaaaacatctctaccatctagctcactccaaaactttaaagccattttacaatggaatataacttactatttcaaacagagacaacagcacagctcctataacagtctcaccaatcttctttcaagtcaccaaagcatattatcaaaataaattttcctataatagtgctttaatcatgtgccccctctgctccgaaatgtatagatcaccaaggcaaaaagacttgattccaagctccaaagcataggccagctcaacctctgcaaacttatatctcactacttcacagcagtgtgcctctcttaaggcaggatgctcacttcgtcgtctctaggtcagggtttatttgccttctaatcatctgagtaattgaaaagcttatgatatactttctcttacttttaaatggataatagaaattttcaaaggaaggaagatagacatgaaaacagtcattacttgaaactaaaaaagatggaaagttcctgcattcaacagacatgtatggatacttattacattaccaggcaaaaaaaaaaatttggaacacaagaaaatcattcattattgctcatatcaaagctcttcatctagtgttcctcaaacactatctggaagggtagcgtcaggagaacctctagagatttgaaaactaccaatgcctggatcccaactattgcaattctgacttaaatgattagggagatgacctagcatcagtggtatttacaaagtcccaaggtaattctcatgagcaggcaagattcacaaaatgctgccttaaatgaatgctctaatcctaacttcggttgttaaaatgtagattctgattcaacagatctggaatgaaagcttgagattctacatttctaacaagaatcaaagtggtccactgctgctgatagaagatgacactttgaatactatgggaagattgatactattcctaacatcctattcatatgtaactctgatacaatattcctccttcctaaatgccaccctacatcctacagaatctagctaaagtaacctgccccataacatacagccattaagtaggaaaggctaaaccaagacctctgattctaaacccatacacctagagcactacaaacacactgcatgaagaacacaactaaggatatatttgacattatatattccctataaaaaatatttttagagaaaaaatactcaatgtaagtcccaaaatagttcttcctacatgtgactaatttattttcaatctagtttttttacaggtaaatgggagagaaaaaaatatttcatgcctttgcatcttctggaatgttaaagcacagaaattctttacaaggacaggtaataactacaggactgactcataaaaaggttattcagtccagtatcctacctacaacaatacgctgacagatgatgcaaagtaattataataataggaaattacattaattgttaaagcagctgccaatcagctctaataattataaagttcttcattttattgagccagaatttatctccctgatatttatggccacatggctcaaccctcgtagctttcgggtaacagcaaataagtgacattctcggccgggcgcagtggctcacacctgtaatcccagcaatttgggaggctgaggcgggtggatcacaaggtcaggaggtcgagaccatcctggctaacacagtgaaaccccatctctactgaaaaaacacaaaaaaattagccgggcatgggggcgggcgcctgtagtcccagctgctcgggaggctgaggcagcagaatggcattaacccgggaagcagagcttgcagtgagctgagatcgtgccgctgcactccagcctgggcgacagagcgagactccgtatcagaaaaaattaaaaaaaaaaaaagaagtgacattctcattattgggttaaatctatgtgaagtagcaactggtcaggaaattatagtctttgtataataagatgtgcattcaatgaaattttgtttaaagaatgacaggacaggacaggcacagtgattctcatatgtaatcccagcactttgggaggctaaggtaggaggacagcttgagcccaggagtttgagaccagcctgggcaacaaagttgactccttgtctctaaaacaacattttaaaattagccagacgtggtggtatgtgcctgtagtcccagctactcaggaggctgaggcgagatcactcgagcccataaattcaaggcttcagtaagccataaccgcaccacggcattccagcctgagctacagagctagacactgtctcaaaaaaaaagaaaaaaaaagaaaaaaaaaaaacaaagtaattctactacctcagttgctgtttacaaacaccttaagatatataggacggaacatcatcatgtaccattgtcatttgccttctgcatacaagaaaactgaggactaaggatattatgagatctgccaagggtagttttgatatatacagttgtgatattataaataaataaatatatatatttatttttatatatataggttttcatccacggttcctggctcataactcctgcagcccttggtgtagtcttttgttataatgttggggtgctttaggcctcaggagcaggcctcaggaaacagaatctctctctctaaccttcttctgtcctccttttacctgcccaagggaggcctctaatatgattgccggttaaaagaccctcattccagaaagggtccctccccatattctgaaagaaaaaatgctgcacaagaagccaggaagaatctggacagacaggccttgctgggtttcccactcatgagatcatgttcttttgtccaatcacatttctacacagggtcaatagtgcctatgtaatgaagcctccataaaaacccaaaaggacagcacttagagagcttccagatagccgaacatatgggtgctcctggaaggtagagtgcccaggaaggacatggagactctctactccttcccccataccttgccctacacatctcttcattgtatcctttgcaatatcctttataatatactggggtaaatgtaagtaagtgtttccccaagttctgcaagccactccagcaaattaattgaactcaaggagaagctggttggtcagaagttctggaagagtagattattgactggtgtttgaaggtggggtggggtgcagttttggggactgagtcctcgatctgtgggatctgatgctacttccaggtagatagtatcaaatttgaattagaggacacccagttggtgtccactgcttgctggtggggaaaaccccacaaacgtttggtcacagatgtcttcatgttgattgttatggtgtgagagcagaggaaaacatggttttaatgtttttcccaaataactggtgtcagagaagtgagatttgctaaaaaggccctggctcactgaaacatgtggtttgggaagaaaaaggataaaagggtagaagatgagaaacctttgttctggtgtggccacatggtcacccaaggtatgaagccatagctgctatgctcggttattaaaggtaaaagttatcagtggaatttagagatggttccaactcctggggaattggttcactggctgcataaggaaatgcaaactaataagaaaaaaaatgaactggctgttataaataaatagccataaaactagctattataaataaataatcccttaattattgttatttataatagctaaaatgaaatttaaagagagtactgtgttggtccttgaagctggataaacctcagatcttggtctgtttgagctcaggctgctggcctcaaagccaccctccaaggacagaattgtgcaggggcaacaaagtacctctgagacatgtggttaccaagaaggtagtcaatgtggaaaaagggcaaaacgaagtaactgcaccccaccccaccttcagacaccagccaataattcatgcctccagaacttctgaccaaccagcttctccttgagttcaattaatttgcatagtgtgaaggaatagttccattttgtagattggtatcattagcttcctaaagaacctttactaaaatggattatgagagtaactacattaggggcagtagctttggtttaaatgctaccgtggaaaacatgtttgggttgatgtaggacacagggctcactactaagcaatctcagacatctatacatgattgagacacacaggacgttattcccaaggcaacagccagcatagtggactggataaaagccactgtatgatctttttactctggaaagggggattgcccaactttccctagaaatgccaagcagaacaacccagatgaagcagctgatatgcttcatatgcaagctacgtaagactagctttatgatgataaggatattcgcccaatgaatgtgtctgttatctacttacgaggttacagtaaatgctgtagttaagggggtcccttctacataggtccatgaaatgagcagatatgggggtactacagcagtgctgagaagcgctaaatctagacattcctcttacaccttctctcaagcacaaaatgccaataagaactgttctttttgtcagcaagagagtctgagacttccaatggctatgtggcagtttccttagtgggaagaccctgaatgtagaaggtaagtgagactgatgctggtagccctggggggctacaaatgaatgggtcttgacaggaatagtcaccgactctgaagtgagctttccttacccagtggaagatgcaaatgctcagagtgccatttaaaaaacaaacaaacaaacaaaaaccaaaaaacagaaaatatcgcatggatttggacaatcatcatcttttcagaacgagaaacacattgtacagcctaccatgtccaacaaagaggaaaaaaaaatcctcctcagagtaacagtttgatgaaggagtaggatgggcaattaaaacactggttgtctaaaacacaggaagataaaagaatgaagggctggcttgcatgctttcacgagtgtgtgctcacattcaacatgagtgggactaaaggagcatccccttagatttttcttgtttttctggttcatctgggaaagaggcggttggggaaggtgctggtatgactatccaattcttcccaagggaggagtacactggtataacaactataatttttttcttccccagatgacctcaaaaagaaaaaactttttttctctccgctaccagatgcagtggtcctaggacaagggctgcaactgcaagtgctggaagcagggatgatttctaagcaagaaactgtaactacatttttaaaccttaagtcaaaattcctaagggcataatgggggtgggttgtaccttcactctatctagcaaaattggggctaagagtgaatgcaactactacttttcctggccataaaaacagctcactagttctgcacccatgtaatttaccctatctaaaggggagtggactgaggaggaggtacttgctagactagagttgttgtctgcaatctaaaccagcacagtggcaattcttaatgtgccttccaaaggaggaaaagtttgggaactactggagaggaggaatagcagctgagggtaaagacaggaataaatgggttattcattgagggaaatccaacattacattaacacatttaaagaagctcagagcaagagatgacactgtctttaactcagttataagagatgctcaaaaggtaaaagttgtatgtttgcggagactgctcctgcttctggaatctgacaagactgaaaggaagcctgcaaacttgagtggtctctccctgggagacatattcatacaacatgataatgaactggactaattactaatgactgaatgggattctagtaatgtagcagtatgtttgagttgtatattcttttgatgatgtaaaggatccatgtttgaaagccagggcgtggcctatgacatgattttatcgtgtgtgtgtgtgtgtgtgtaggttttcgtccatggttcctgacttattaactaccacagccctttggcctatgacgtgattttatcgtgtgtgtgtgtgtgtgtgtgtgtgtgtgtgtgtgtgtaggttttcgtccatggttcctgacttattaactaccacagcccttggtgtagtcttttgttataatgttggggtgctttaggtctcaggagcaggtcacaggagtgctttaggtctcaggagcaggtcacaggagcaagcctcaggaaacagaatctttctctctaacctcctgtcttccttttacctgcccaaggcaggtctctaatctgattgtgaatcaaaagatcctcattccagaaagggtcctgccccatactctgaaggaaagaatgctgcacagagaggccaagaagaatctagacaaacaggccttactgggtttctcactcagtctattagtatgagatcatactctttttgtccaatcacatttctacacagttgtcagtaatgcctatgtaatgaagcctccataaaaaccccaaaaaagagcattcagagagattctgaatagctgaacatgtgggagttcctggagggtggtacacccagggaggacatggaggctctgtgctccttcccccacacctcgtcctacgcagctcctcattgtttcgttttccctgagttctgcaagctgctcgggcaaattaattgaactcaaggagaacctggttggtcagaagttctggaggcatggattacaggcgggggtctgaaggtggggtgaggtgcagttttggggactgagccctcgatctgtgggatctgatactacctccaggtagacagtgtcaaatctgaatagaggatacccagctggtgtccactgcttattagtggggaaaaaaccccacacatttggtcacagaagtcttctgtgttgattactgtggtgttagagtaaaggaaaaacacagtttgagagtttttctgtaacagtagttatagaaatgggatacaagtcctggacttctgactctaacacctaaatattacagggaagcaatataatacttcaaagcacaagcttattagtcagaaatacttgacaggtttgactctcaggtcctccatttcctacctatataatcttttttcttggattgtttcttaaactttcttttgttactataaaattccccaaacaaaaagaaatgctaatcattccattatcaaccacaacggttctcaacacggaatatcaaaatcacctataaagccttcccaaataaacatataccagaggtagggtatacaaacagtgaattacaaaccttacaattttatgagagacaataattatgttggggcatatagagtaatgcaagaaacttttacaaaactctggacagaaaattaaggtactttttacttgtgttaacagcattttaatttctttagattaatggaagttgactagtgatagagtaggtcagagtgacactaaactgttagcagtcttctttctgttagctttttattctaccaccttacacaatcatcttacctctaatagtaaatcctcaatactttctatcttgtctaatgaatattaaactagaaatcaggtaaataaattcaatttctaaattttttactaaacagtcataaaaacctcacaaccacctcatctcagtttctccaaatctagatttgccatctcttaggataatcaactgtattttatacattgttgagaatactctgaagaatgctacataaagcattatttctgaagcatatatttaactcagttatattgaacagtgttatcaaggaatagtaaataactggcagatgttgccacttacactgcacgatcatggcagacattactaatttaccataacattcttttttctgttttgtttttttggagacaaagtcttgctctgtcgcccaggctggactatagtgcattggcgccatctcggctcactgcaacctctgcctcctgggttcaagcggttctcatgcctcagcctcctaagtagctgggattacaggcctgcactactatgcccagctaattttcatattttcagcacagacaagatttcaccatgttggccaggctggtctcgaactcctggcctcaagtgctcctcccgccttggcatcccaaagtgttgagattacagacataagccaccacgtttggcctatcacgatattcttttctgctaaacatgaaaactacaaacacatctcatacatgaagctcaatttacaaagaaagaaacatgtaaccaaaaaaaaaagtcaacaagtttgacatcaaggtgtattgaataaatctagaagaacttaagaaaaaaatgaattcaagtaatgaagcccatcctaattacctagaaacacacagatataaaaaaaaattgtggccacacgcggtggctcacgcctgtaatcccagcactttgggaggccaaggcaggtggatcatgaggtcaggcgatcgagaccatcctggctaacacggtgaaaccccgtctgtactaaaaatacaaaaaattagccaggcatggtggcgggcacctgtagtcccagctactttggaggctaaggcaggagaatggcgtgaacccaggaggtggaggttgcaatgagccgagatggggccaatgcactccagcctgggtgacagatcaagactccgtctcaaaaataaataaaaaaataaattgtacaaaaaaaatttggctctttatttggtaatgtaagaaaaaagtttaaacttaaaaggagataaaaagccaaaacagccaataacaaaattgaaaagaatcacactcacttgctttcttcatccaaaagatgaagcagtcctgttggttttttgctaataagatttatgcagcaggtattatcaatgtaatctatgttgtgccagctgataccttcagttctatattcctcctagaaaaaccaaaaaataaaataacaatttattcatcttgcagaaaataggtatataatatagattgaaaagcttttaccctgcttaaaattctaagattttaaaaatcaccaatccacacaatgaaagaatgtataatttcagttgtacaaatcttaatacaacgtatttgttttctcttaaaaagacatgccacaaattttttttgttagaatgccagttctaagttcattctaatcaaaatgtagggctagatttgttttagtctcactacctgatgactccactaagtaaaaacgtacaatgaagaaaaaaggctaatatctcccacatgactttaagccatcaaaaagcactatatttcctggattatcaacaatgaatttaatgaaacaatttctgggaaaagtgggaccccatcaccctccagtaattatatggaattcatacacactaaactttggcaaaatataatctttaggactttttttttttttaaagaaaaggttttgaattctaaggttaaaaaactcgaggttcaggtcttgagtaactacttaaaatcatcttacaaagcgctccattttttcttattctttcctgtatggagatatattcttctattcatccttgtgatactttcactttttagatggtttttttaaggaaaaaatgcacctgagaatgtaaaggagatatgtttctgcactgcagtggtatttaggcatcaggtaaaatatcccatgtacctaattgttttagcattcacttacagtacttgcagcacaagtcaactgccaatctgcaaatagtgattttgaaattcttttttgttgttctttttgattttgaaattccatcattctttctgtattcattattatccagtaaagaagaatgaacactaacataaactatagttactctaactaggaaaggtaaatacttaattcttttcttttaattaacaatttcacacataagaaatagtcatataaaggtcactccccaatggcagtaagaaaggtatttccccccaattttttgcagcatgaaaaatatacacactagatagtatgagcttaatgatttttataggcattactagaagtccaaaagtcctcctcattatctcttcccaaggactatccaaaccctcctacccaaagtcagcttctaatacaatcaataagattcccctatttataaatagtatctaaatggaatcacataacacatactcattttgtctcttttcttttttcattcagctaatgtttcagagacacaaccattttgttggatgtacctgaagttcattcattttaattgcattgtgaaacaacacaatcactcagctacatattgtctatggctactttgtcaatgtaacagctgagttgagacatatggcccaaaaagccttaaaagatctggcccttatagaaaaagtgtgccaaactctgctacaaagcattagttctaaaactttaacatacaacggaatcacaagaacggcttgttaaaaaacaagagtattgggactccatccccagaatttctgcttaagtaggtatagagtacttagaattttcatttctaaaaaggttccaggtgatgctgatgctattattgaggagagagaaggaataaactttgagaatcactgctgtagagtattccattgtatctgtatacaataacttgttcacccattctacttttttctttttttttaagagacaggatctctctttgttgcccaggctggtctcgaactcctggcctcaagcaatctcaagcaatcctcccacaacactgggattataggcacaagtcaagccccactctactactgatagacactgctcttaattctaatatttggtcattaaaaataacgtcttatgaccatttccacacaaaacttttggtgtgcatttatacttatctttgagtgaaaacacaggattataaactacatgtttaaccacagcagataatgccaaacagcattctgatgtggttgtggcaatttacatacccaccccagcgtatgtccctatagacatatctctccaatactcgtattgtctgtctttttcattttagtcatttcggtgaatgcctactagtagctcattgtgattttagctttgatttccctgatgaataacaaagaaaaaacattttcctatgtttactgctcatttggatttccccttgtatgacgtgcttgtattcatgataaaaactcttggctgggcacagtgtctcacatctgtaattccaatgctttgggaggcctagctgggaagatcacttgaggccatgagtttgagactaaccaggacaacatattgagaccctgactctacaaaaataaagaaaaaaattagctgagcatggtggtatgcacctgtagtcccagctacttgggaggctgaggcaagacgacctcttgagcccaggagatcaagtctgcagtgagctatgattgcgccactgcactccaccctgggctgcagagcgagactctgtcttaaaaacaaaaaacaaacaaacaagcaaaactctcggaaaacattattgccttgttcttagtctcagaggaaaagcactcagtctttttcattcaataagatattagctgtattttgtagatgtcctttatcagaaaatcattttctactcctagtttaaaagaaaaaaaggaatagctacacagttttatcaactgctttttatatatctcgagataactgtgttttctccttatttattaacagatgattaaatggcttgattcagttaaatgtaaagcacatgctgaaaaaaaaatctccctttggttacaatgtattatccttttgtacatattgatggattttattaatgtttgtttagaatttttgtatctgtgtttatgagtgaaactgacctataatttccacttctaatatccttaacagatgtgtgtatcattgttatcctggccccctaaaatgtactgagaattgtccttttttctattccacctaacagcttatgtcagactgacactctttcttctttccatgttggtataatttacccgtggagccaccatggcttgcaatgttcttcagggaaaggttttaaattacatattcaatgtcattaatagttatagaaacagattttctatttcttctatgtcagttttgaaaagctcttttgttcgtatcatttgacaagtctattaacataaagttattcagtgtgtctatctttttaatatgtgtaggatccagagtaataccctctatcactgggattttggttatttatatccctctctctgtcttgtctctctctctctctctctctctctctctcagatgaattccttgaggggttcatcaatattattagccctttcaaagtattacttttggtttggttgatcctctcccatggtatatttgttttcacacttttattaatttcctcttttatctctattatttcattttctctactttcctctggtttagtttgctgatctttttcccaactgttgacagggatcactgattttaaacaaaaatcttctaagagctatgaaatgttcttctaagtatagctttaggcatttcccatagttttaatatgtaacgtgtcattaggtacaatatattttctaattgttcaacctctagcctatttagaattttttttttttttttttttttttttttttttgggacagagtctcactctgtcgcccaggctggagtgcagtggcccaatctcagctcactgcaagctccgcctcgcgggttcacaccattctcctgcctcaccctcctgagtagctgggactacaggggcctgccaccatgcctggctaacttttttgtatttttagtaaagacggggtttcaccgtgttagccaggatggtctcgatatcctgacctcgtgatctgcccacctcagcctcccaaagtgctgggattacaggcgtgagccaccgtgcccagcctagaatatttcttaatttttaatcatataggtatttttcagttattttttagttactgatttcaggtataattttattatggtattaaaatctgtgtcatttcaatccttggaaatctgactttcgctttatggtccaggatataaacaaattttgtaaatatcccacgcaaacttgaaaaaaaagtgcattctgcagctgttgatgcagtgttctatgcatatcagttatatatttgatttttaaatcttctatatccttaattgattaggtttcaggcctaagggcaggaaactgacattctgctctgaaggacagtcagtgatggatgcccacaaaggcactaatctcatcttctagatattttaaatcttctgtatccttaccaactttttgaacacttattctatcagcaagtcagcatggtatgttaaaacattccactatgatggtaaatatatttttcttttttgagttttattcattattgctttatatattttgaggttctgctatcaggtgcttataaattttggactgtatactacttcccaaggaagtgaataatgctaaagggtaacattattaaatattcctttttatctctagtaatgcttgaaatatgatattaatatagctacaactgctttttttcttaaggtttactaaatctttgctcatccttttaatctttctatatacttatatttaaaatgtctctcataagcaacaatcagtttagttttgtattatatctagtctgacaatctttagcttctagttagagcaatgaatcaattatatttaatgtaatcactaatatttgtgagattaaatcaaacaccttactacttgttctttgactttcatggcattccttttatttcttgctttcttctggattgagtgttcttattttacttatcctctgtattttttttcaagttttatattattttactatttttggcaattctagaaaacatgtatccttaacttatcactaacagaaataatatctctgtaacttagcatttaatacaaagatcttagagtatcttaaattctatttactcctaacttatatgctattactgtcatgtattttagttacatttaaacattaaatagttttttattttttttatttcttttttttttttttttttttttttgagatggagtctcgctctgtcacccaggatggagtgcaatagcgtgatctcagctcactggaacttccgcgaacccttcccagctacaagcaattctcctgcctcagcctcctgagtagctgggattgcaggcggctgccaccacgccctgctaatttttgtagttttagtagagtcggggtttcaccatgttggccaggctggtctcacactcctgacctcaggtgatccacctgcctcagcctcccaaagtgctgggattacaggcgtgagccaccacgcccagcctaaatagttctatttaagccataaaagttatttttaactttgcctcattaatattcatttagattcaacgacttttttataattttcattgctcttcattccttcctgtacctgagctacaataggaaacaacttgctgcctaaacaatataccttggttttaaggaaaatatgccattgtctcctagcttccactatttccactgaaaggctgactgccaagtcttattgttgtatctttaaagatagagatgtccctgacttacgatgattcaactttacaatggggtgaaactgtcataatttctgcagactttatctttgcctaggctggtgatatgtggtacatgagatattcaacatttttactataaaataggtattgtgttagatgattttgcccaactgtaggctaatgtaagtgttctgagcacatttaatgtcctgcacatttaaggtaggctatgtcaagttatgatgcttggtagtttagatgcattaaatgcatttttgacttaaaatattttcagcttggcaaggagcaactgtagtctctggtttcctctagctgctttttagacttttttcattgtctttggtttagtataattttctaggtataaatatctttgtatttaacatgccttggattcttaaagagcttttcaaatgtatgcttgttgggtttgtttttttgttttgacagttttggaacattctcaaccattatgtcttcaaacacggcttctaacttattctacgtctctcatacacatctttccaaaattcctatggcacatgttagacctttttactatgctcttagagtataagtctctttcttatcttcattcattaggctcagtattttcttctggtctatcttccaatttactaattttactaacctgtatcttactattaaaaaccatctgtgtcttttcaatttcacagtactttttagttctaggttttccccaatttgggatttttaaaagtaatttgtagttctttaataaaaatattgcaccttattttttaaaatttcttgaaagcatggttagtttccagtccatgtctagtgctaatatcattggctggatccactgtggtattattatctcatttctcttgggatattttgttgttgttgttgagacgcaatctcactctgtcactcaggctgcagtgcagtggtacaaactcagctcactgcaacctccgcctcctgggttcaagcaattctcctccctcagcctcttgtatagctgggattacaggcatgtgccaccaagcccagctaatttttgtatttttagtaaagatggggtttcaccatgttgaccaggctggtcttgaactcctgacctcaagtgatccacctgcctcagccccctaaagtgctgggattacagacgtgagccaccatgcccggccacatttctcgtggtttttattcatgctggtttgcctccatgtatgtctttatgtctctgtctgtctctctctctctctgttttggactgagtgttagatcctgtatatgaaaaattataaagataattttagcagttggatgatgtcttcttctggtggagattgtatttgctcttggcaggtggttaagaatactacaaattgtattttaacctaattgggaactgagatgattttaaactgggcttcagtccttctgatgccaggtttacttctgatttacttttgtctgagatgtaaccctttagggatctcaacctaaagcctataggaattaccaagggcctcctccttatttttgagtcagaagaaaaccctgctcaattcctcatactctcaagcctggcccttttagaatcagaaacactacaaaaataacgaaatgtctctaggaacaaagcagcacccaaatgctgggctcacttccctagatttctttcttatagtctaggccctgtaaaacttatttgaaggtactccaatgccttcaaatatatgttgttgaagttttttggttgttctccaaggtaaggttcatcaaaagtttctagtctgacaacaacaagtaaaatggatgaaacaaaaacttgctagattatgagctcctcaaataagatccctgcactctaaattttctatcttctatgcttagcacactgcctggcacacaactgttgttcaatttactgatgaatcaatcaaatgaagagtaattctcagcaagtaaggaaaagaaaaaagagggcagtaatacaagtaacagaaaacatacaattggccctccatatctgcaaaagtttccacatttgtagatccaaccgaccacatatcaaaaatatttagagaaaaaaatgcaaaaaatataaacttagaaacagtatagcaactatttacataccatttacagtgtattaagtataagaaactgagagatgatctaaagtatactggagaatgtgcataggttatgtgcaaatactatgccattttacataagggacttgagcatctgtggattttggtattcttcagcagggggtcctgaaaccaatcccctgtggatacccagggatggctgtactttcaaatatcagaaacctctttgggtctgtctcttagtctacattacagtctctaccactaccttgattcagttcagaatcactcacccattctacagtcatgtgccacacaaacacatttcagtcaagaaccaactgcatatacaacagggatccctaatctcacgaaaaattcatattatctactgacgtcttgatcctgaccctgtgtaggcctatgctaatatgctatggtaatatgtatgtatacatgctaacatgtatgtatgtgtctttgcttttaacaaaaaagtttttaaagttttaaaaaattttaatagaaagagggcttataattatataaagagaaaacatttttgtacagctgtacaatgtgtttgtgttttaaatggctactacaaaagtcaaaaagttaaaaaagtttataaagtaaaaacattacagtaggctcaggttaatttattacaaaaaaattaataaatttagtgtaacttaagtgtacagtgtttataaagtctaactagtgtgtgtacagtaatgtcctaggcctttatcaccactcacccaacatctcacccagagtaacctccagtcctgcaagctctaatcatgggaggtgccctatgtaactgtactattttttatcttttatattgtatttttactgtatcttttctatgtttagatacatttagatacacaaatacttaccattgtgttgcagttgcctacaatattcagtgtagcatgctgtacaggtttgtggcctaggagcaataggctatatcatatagcctaggtgtgtaggaggctataccaactaggtttgtgtaaatacaggatgatgttcatacaacagcaaaatcacctaatgatgcatttctcagaacatatcctcatcattaagtgacacatgacagtacttcaactagttcatagatttttctccttctttccagttcactgctcttcagttcaattcaagtcctctgctaaatatacttcaaatagcttctcattgtctgaaaaattctaatcttccctgcatgacatataagtccactgttttaagtacaatgtgtataatgttacctttgcctaaaatatcttttcccattgacaatctagtgagcttcagctcactatttgaaattatatgccagaatcaaccctggaaaatttttgcagcctttcaggtagttccaatcaaccccatcctttgtgtaactactttaccttatatctgattatagcatttacatcctgcatggcaattattacatctctctcccatcctatatgcctatgtactccttttggacaaaatttagaaccaaaccacagtcatcatattgaagatttttcctacaaatgtacctgtgatactgtaccttctttttaaaaattttaaccttaacttattttatactcaactgaacttaacaagtaatcactgagtacccatttcataccagttaccaatgaggtacatataaataagacacttaacaagattctgatccataattgcaccacattgcccaaaatgctgacattcagggtagcaagtaaatgagaatcacccatcttccaagtagttttgaacacattttccataaactctaaggttttttatttttatatataatacgtttatggccaaggcatttcttctggctgtctaatctagacttctagaaaagaataatttcagtttacaataaagaatgtttgtctttttcaaaatcaatttaaccaatgttctgtttaatgatccacagagcaactgatgttctgctctgtaaaatatagaacccagaaaactaaatgcattccctcacccttctaacacatgtacttatttgcaagagataaagaatattaacttagtatgatttatgtaagagttttggactgattcaatagacatggatggcaatcccagcttagcttttgattaaaagaaaatattatagagccagagtgttaaggtttgaatactggctttagacaacatctgaaaaactagaataaaaacagtactgactgataagtaacactacataactcgtaagtgttagctaatattataacaaataatatctttccaaagctctagggtagcatctagctaacagattatatgtttaaaactttaagcattcatcaagttggccaggactaatattgtcatgctattgttaaccagccattatgtcctttaagcaaaatagaggcacttttttaaaaagctaagacagcaacaagatccaatgataggagacttgatgatataaagatcttttctccctcttttctgtagacctgctagctgttgtagtctttctgttcattctctattcttaactatttcccttgagttcagtttgatgaaacctgtgtctgcctatgtcctcatacacaaattctggggtacaatgtaaacctattactgatttcaaccttagtttggagaaaaagtccacattttgtttgcccctccctttgcactaataattttcatggaaactgaaagcccactcttttttttgagatagagtctcactctgtcacccaggctggagtacagtggcgcaatctcggctcactgcaacctacgccgcccacattcaggtgattctcctgcctcagcctccttagtagctgggattacaggctcctgtcaccacacacggctaatttttgtatttttagtagagatggggtttcaccatgttggtcagcctggtctcaaactcctgacctcgtccgcccacctcggcctcccatagtgctgggattacaggtgtgagccaccactcccagccaaaagcacactctttttatactaacttaatcaatcttgagatcctcataagaaatatctagttacccatcttggtctctccatacctagtttctttgtatctacactctgtactgacttgagattctgttaagctcctctatctcatcctagaactaagagaccaaagcaatcaaacaagcatacagttggccctccatatcctcgagggattggttccaggactccctgtggataccaaatccacagatgcgcaagtctcttatataaaatggcttagtacagtcagccctctgtatatgcaggtttgtatcagtagttttgtatcagccatgggttgaatgcttggatgtaaaacccaaagataaggaggactgactgactgtacttagcattacacacagtgaccaagcccatggtagcaattaaaaatcaacaccattgtttccaaacccctgtgtgaaagaaaaagaaaaaagaaaaaaacaatcaacaccagcaataaaaacaaaacaaaacacacacacacatctttttaatcaaaggttcattcaaggccaggagtggtagttcctgactgtaatcccagcactttgggaggtcaaggtgggaggactgcttgagcctaagagtttgagaccagtctgggcaacatagtgacaccttgtctctacaaaaaataaaaacaaaaattagttgggtgtggtgacgtgcacctgtggtcccagctcttgagtggctgaggtggggggactccttaagccccagaggtcgacacagtgagccaagatcacgccactgtacttcagcttgggcgacagagcaagaagacccatctctaaaaaaacacactcccctgcaaaaacaacaaaggtgcaatcaaataagcatatataagcaatttttttttttttttgagacagtctcattctgttgcccagtctggcatgcagtggctcaaacacagctcactgcaacatacacctcccaggctcaggtgatcctcccacctgagtctcctgagtagctgggacaactggcatgcaataccacatctggttaatttttatattttttgtacagacagggtttcgccatgctgcccaggctggtctctaactcctgggctcaagagatccacccaccttggcctcccaaaatgctgggattgtcagcttgagccaccatgcccagccagcaaatctatttagggaactataaaacctctgtcatctgcttacaatgatatgtggaccacaatatttgtattgaaagacaagatttaggctgggcgcagtggctcacatctataatcccagcactttgggaggctgaggcgggtggatcacgaggtcaggagatcgagaccatcctggctaacacagtgaaaccccatctctactaaaaatacaaaaaaattagccgggcatggtggcgggcacctgtagtcccagctactcggggaggctgagccaggaggctggcatgaacccgcgaggcggagcttgcagtgagccgagattgggccactgcactccagcctgggcgacagagcgagactcagtcaaaaaaaaaaaaaaaagacaagatttaaaatgcttattatgtgctctccactcttttagtaaaatatcacaactgatattatgataaacaattgaagctaccagactactctgttttatctcacatttctaatcccatcagttgagtttacataaacaaagaggcaacggtatttgttcccaagccaatttacttcggttattcttgtttgtaaaggcacgtttcaatatttaataaaaacactatgtaaatcaataaaatgtgtgaaaaaatgaagtgaattattatgaatatgactcaaagatatgtgtgatggggggacaagtgtatacatatttaggtactcacttgttccaatttaaagatatgctgattaaagtagtgctgtaaacgttcattagcaaaattaatacagaactgttcaaagctgttattttcataatcttcaaacccaaaaatatcaagaacaccaatagacaatgtctgtaaaacaagagaaagttttgattaaaagtaatgtttaaatttatttaatgaataatatccacaacataagtaacaaaatgctcaattcctctaaagcagtgtacaggggattgtgtttggccagtattcaaaacatatcatgacttaaaagtattttagttatctttatcttacttttatcctaattaaaaaaatatatccaaactgttaatacatataatctatagattacagaaatatgtgaagcaaggttagtggccttttatcttaagaaacctcagaaatccctaacatcttaaagggaatggaaaaaaacagagggtgaggaaatcaaaaggttatttcaatgaaggatcaagagaggtaggttactcctggctataccaagaggacaatgcaatttttcctatttcgacttctacatcccaataaatagaattcttcattaagaaccaaactagtatattttatcagcctcatgaagactgagtgaaactagatgtcagaacgtatggtttcttttttatttttgagacggagtctcgatctgtcgcccaggctggagtacagtgacgtgatctcagttcactgtaacctctgccaccggggttcatgcgattctcttgcctcagcctcaccagcagctgggtttaccatggcatgcaccaccattctggctaattttttgtatttttggtagagactggtttcaccacgttggccggtctggtatcaaactcctgagtgcaggtgatccacccgcctcggcctcccaaagtgctgggattacaggcgtgagccaccgtgcccggccagaacatacggtttcgtaaagttaaaaatatttattaaaaaaaaaaagtatgaggtttaaaatgttgaatagtgctaaaaggattacaacaaaagacagcaatccctgcctcatcatcaagatctgctccctaaagtcaaccacattcaaatctttcagctgtttggtagaatacagaacataaatgcttatattcttctattgcacttctaggaataatctaacttcttactgtggatttggctctaatacctgcatatgaacacttttctcaccaccccaacccattctagaaatacagttgtatgacaattttggttaaatgaaaataatttttctccactggtgctaagagatacaacgggcaaactgatatgatgaatgaaaaatagtaagatcttttttaaaagcctgtactaagagtattttgtttaattctgctaagtctaggcccttaaaaaaattaaaataatgcccttcaaaaataaatcaatttgataaattagattacaatttaaattaatttttatgactgtgagtttacctgaagcatgaaaaattaacataagagcaatttcacatttaaggcaataggattaaatttaaaaggtgacatttttaatcagtctgacaaggtggactagtccatgaaggctgcccagaaaacacaactagatgtgaaatgattaaatacctataatctgccatattaaaaatatagttagaaaaagtctaaacataaaaaaattataattataaaaatataagaataaatattttataatcttgggctagaagaggccttcctctgtaagtaaaatacatatacaaaatgcaaaactaaaaacaagaaaaatgacagaattaactgcaaaaaaattacaacataaaatcagaaaaagatggtataaataaatctaaaaagtaaataactaagagagaaaataattgcaatatatatcaaactataggcctccacaaatatccacaataaatgccttctaaaaaggagtaggccaggcctggtggctcacgcctgtaatcccagcactttgggaggccaagaagggcaggtcacttgaggtcaggtgttcgagaccagcctggccaacatggtgaaacccatctcaactaaaaatacaaaaattagccaggcattgtggcacgcgcctataatcccaggtacttgggaggctgaggcaggagaatcacttgaacccaggagacggaggttgcaatgagccaagatcataccactgtactccagcttgggcaaaaaaaatgagacactgtctcaaaaataaaattaaatttaaaataaaataaaaataaaaaggagtatcaaaaagacaaaacagaagacaaaaataacacaaagttattttaaaaatacagagaagaaataaaatagcgaaaacatgaggtgatgcagaacttttatctatcattaaaaataatgcaataaaatgaaaccattccccttatcagattaggagatgtaaatcctgataacatccaatgtgggtaaaggtgtaggggatcaggtgctttcacacactgctgctggaaatgtacagtcttttttggaaagtgtcaaattttcaaaatgtatctatccttaaacttagcaatcggcagggcacggtggctcacgcctgtaatcgcagcactttgggagaccaaagcagatgaatcacctgaggtcaagagttcaagaccagcctggccaacacggtgagaccctgtctctactaaaaatacaaaaatgagctgggtgtggtggtgggcacccataatcccagctactcaggaggctgaggcaggagaatcgcttgaaccggaggttgtagcgagatcatgccactgcactccagcctgggtgagagcaagacaccgtctcaaaaaaaaaaaaaaaaacagcaatcccactttgataatgttatcctagagaaatgtatacacaggtaagtaaaagaatatttgttacagcattgtttataacaataaaacaaaatctatttttaatggatggatttatggtacacatcttactatatatttataactttttttaaatagccaggtccagatatataatgagacagaaaatatttcaagagattctaggtaaaaaaaatacatatatttatgtttgaaagaatacagagagcatgattctatttacattttttaaagcaactctgaatatacacgttcgggaggtaaaaacacataataaaaaaggtctggaaagacacacagaacaattcttctgaacagggtaataaataacaaataaaagcgatttcttacttattactctatataattctgtgtttttaaatttcatgtattaaccagtttattaaaatagctttcagggaaaaacatattataatccaatatatcattaccttggtattatgctctaaatctttactattcagaagtgcatgattaattcgaaaaactatccagtcaaacagggcactatacagagacttagccatggagttcctcactgtcacagcctgaaaaacaaaagcattacaagtgcatgtagaattgacaatgattaagatactatgacaaagttgtttgctcccattcaagaaagaaacttactatcctgaattagaaatgaatttttctctcaaaataaaaaatctataactaaagttttttgtttgtttgtttttgagagtttggctctcattggccacgctggaatgcaatggtgcaatctcggctcatggcagcctccgtctcctgggttcaagtgattctactgcctcagcttcccacgtagctgggattacaggcatgcaccaccacgcctggctaattttgtatttttagtagaaacggggtttctccatgttggtcaggctggtctcaaattcctgacctcaggtgattcacccgtcttggcctcccaaagtgctgggattacaggcgtgagccaccgcacccagccaattgaagttttccacatgtactcattcaattagtcccactcaaagaatctacgttaaaactgccattaaagataagagaaacaaaatgtaggtcactcagttcaaaacatgtttattaaaaattgggatatatattccccctaggaaagaaggtataattggaagtttacaaacaaatgactttgccagttacagtaggtaagagtattctaggcagaggaataaatctgttaggaaaaagccattaatttctgtggaatcctaatcaccctcttaaaacatacactaatacaaccacaattacattggtagttgtcttcggcttgtcacccatagaaacttctagaattactccatcctcaaagacagcaacaattccctcattatgtagttacaaaatttattttttcctcactctaagctttccaagtttatgaaaattctcaatactatctgctctattttcctgtaagtctgaaattgttcttaaaaaacaaagaatttcaccatttagaaagcataaatttacaaaaaaaaaaaaagggagtagagtatggcacatgtcttacagaactgagtcttagcacttagaagaatataaatcctagtaatttacatatttattatctaggggcttattctgaagcttgtatattcaggtacatatttataactccattttgaagtataaagaaaatagtaataattaagaactagagtatcttccaattccagtttttctacttattctagctgcataatcatgactaagttacttaacctcttaggctactggttatacatctataaaaagaaggtaatactacaacctaccacataggtgatgaattaatttctgaatattgaaggaaaaaaaaagcttcaagttcctagaccaaaaaataactgcctacatagcagaaagaagactggtaccaaattctctatcttcaacactagaaacctgtattattttttattgttgtggagttttagaatatttttaatgtgcaaatggttgaatccttggatgtggaatctgtgcataaggtgaaccaactatcaagaaaaccaatggcagaatgaaaatataacagaataccactgtatttttttccccagaaagaaaagaaaaatgaagataatctaataaaattcaggaaaagtacaatattttaaaactaaatcaacaaatataagacatagaataagcatataaacattatcacaataaattttatgaatgggttgaattttttagttaaaagaccttcagacaaagataaaaactaaagtctaactacagtatttatggtttacataatgtaccatttttataaaataccatagtcatagaatccagataggccaatacgatacctatttgtttactctgtaactccaaattttatactttcagcccttttctctgaaatgcatgtctgtctttcatagcttaacctcaataaacccaaatatcaagtaatattttcccacccaaacaagatctcatttagtgtttcctatgtcattgaagggtaccaatattcttacagctgtgtaaaccagaaatgcaggactcatccttgacacctcctttgtttgccttgcttcccattattcaagtcattactaggtcctgctgatttaatcaaatttttttctttttaaatccatacatttctccctatcaatatgtcaccattctgcaaagcaaatatcattctcactaccgcagcctccgaactcatctctctacatccactcctgccttctgtgcttgaccaaaacccaagatagcccacaagattccctgggggtacaagttctatataattccctcctcataagtgtaggcagaactgtaaatacgatggatttcactcccatatgaaactgatgtcacatgataaaaatgaaaggattttaaagatataaaaacccaaaccagtttattttttaatcaaagggagatcaccccagacttatgacccatggaaactgccaagatattaagtctgtattatattaagttgctaagttgcttacatagctgtaaaaaactaatacattcctccaaatggttctaaacacatctgccagagtgctccttttaaaacaaaaaaacaaattaagatttttttttcttaaaacactttaagagctttgcattacccttcagataaaatactaaaactgtttagtactgttccccatagtacccctaatgctttgcacatttctcggcacaaaaatagagtttttatatatttattaaagaaataacagccgggcgtggtggctcacgcctgtaatcccaaaactttggaaggccaaggcaggtgatcacaagggcaggagttcgagatcagcctgaccaacatggtgaaaccccatctctactaaaaataccaaaaattagctgggcatggtggcgggcgcctgtaatcccagctactcgggaggctgaagcaggagaatcacttgaacccaagaggcagaggttgcagtgagcgagatcacaccactgcactccagcccaggtaagagtgcgagactcgtctcaaaaaaaataaatgaatacaccaaacaaaaataaacaaaaaaaaagtagggaatacaaaataatctcagaaggttacattcaaagttaaaaatgaaaataaatactaaaaaaaatttgtaatgaaaaaggtggtgtggtcattagagaaacgcaaatcaaaaccacaatgagataccatctcacgtgagtcacaatggctattgttaaaaagtcagaaaaacgacagatgctggtgaggttgtggataaaaagaaacatttatacactgttggagggagtgtaaattatttcaaccattggggaagacagtgtggcaattcctcaaggacctaaaagtaaaactactattcaacccagtaatccaattactgggcatatatccaaaggaatagaaatcattctatcataaagacacatccacgtatatgctcactgcagcactattcacaatagcaaagacatggaatcaacctaaatgctcatcaatgacacactggataaataaatgtggtacttatacaccgtggaatacaatgcagcataaataagaagaaaaccacgtcctttgcaggaatttggatgaagctggagaccattatccattgcaaactaacgcaggaacagaaaaccaaacacagcatgttctcacttctaagtggaaactaaatgatgagaacacacggagacataaagggggtgacagagaatgggaggagggagaggatcaggaaaagtaactaacgggtagtaggcttaatacctgggtgacgaaataatctctacaacaaacccccatgacacaagtttacctatataacaaacctgcactataccccggaacttaaaagttaaattttttaaaagaagaaaaaggtagtgaaagaaaatgtaaaaagcaatgaatctttattttatataaaagaaatataaaactcttaaagatttggctttcttttttttttttgtctttttttttctttttattattattattacacttttaagtattagggtacatgtgcacaatgtgcaggttagttacatatgtatacatgtgccatgctggcgtgttgcacccattaactcgtcatttagcattagggatatctcctaatgctatccctccccgcttcccccaccgcacaacagtccccagagtgtgatgttccccttcctgtgtccatgtgttctcattgttcaattcccatctatgagtgagaacgtgcggtgttcggttttttgtccttgcgatagtttactgagaatgatgatttccaatttcacccatgtccctacaaaggacatgaactcatcattttttatggctgcatagtattccatggtgtgtatgtgccacattttcttaatccagtctatcaatgtccaacaaagatttggctttcttttcatttagaaagaagctctcacagtggaagactataatatgacataagaagaaatgtggacttggagatacagaaggtgagataaatggatcaatgtcaagcttaaaaaacattctctagaattcaatcacaatttcctcacctgtcttctaatcttctaatttcatattcctgtccaatttttataattataataatttgacttgacatcactttcataaaactactccacaaagtagcagcttttcaataattttcctgcccctatagatctgagtggtataatagtagcaacaagtatccctaggagcctcagtatacagatggtatttaaagtgatgggactgggtaagataacctcaatgaagaatatagagaagaagaaacaaagactgcgtcctagggtactctaccttttagagataaagaaaaaaaaatacaagcagaaagaactgcaaacaagtagccaacaatgaaaaagttaaccaaaaaagtatgatgtgctagaagaaactgtctcaagaagaataattaattgggtcaaatattgctcatttataattctacctaccatctatctaccccacattagtaatatgaaaattggaaatgatgaagaggttaagatccttggagaaaaatgcaagcctatttctcacaatcacattcaaatttaagtttctaaatcaatggaaaattcacaatcaaatgtaaaggcctagaaaatatttcaatcaaaactttttgccattgtcattttcatgctgttaagagaaaacccaaacttcaaacctaaacttctaacaatgtccagaatgctttcatttcaaagaaaatccatcatacctctgccaacttgtatggcaaaataagcttttctcccactgtcaccgtcttccttgtaactaatgcttcaaatagcatctcttctttaacctataaaacagaaaagtaaactcaatatgtaagatttatgacaataggttgaattatcttttgaaaaagccaaatagaggaggaaaagcttaatgagattagcaattacatagcagagaaaaaaggcaatacactgggcaattttaatactggccaaatggaatttaagtgtcccactcaaaagacaaatgggttttttcaagttaaagtttgctttctgatcataacagagaaacatgtttcattgtgcagaatacagaaaatatagaatagtataaaaaacattttaagatgatcaatcataatcccacatgctggaggcaaggactaaaaagtgacagcacttcttgaattccagaaatattccaaaggatatttatttatgtttcagatatttcttcttcatgaatcttgaattctaggaatattccaaaatatacttatgtttcagatatttcttcttattcatgaatgataaacttttaagataaagttgacacttcctttgttctcactctctccccagaggcaaatactatcatgaatttcacattatcatttcagttaatatttctacacttttacatgtattaaatatgttcataaacactatgctatactgtcaaatgactttaatgtttatctataaagtaccatattgcccatatgttcttcagatctaactatgtggataatttattattattattattttttgagacagagtttcactctgccattcaggctgcagtgcagtggtgcgatctcaattcattgcagcctcgaccgcccagattcaagcaatcctcccgcttcagcctcccaagcagctgggactacaggcacacaccatgtcgataatttaaatcaaccttattcattttaactgctacatagcattgcagcatataaatataccacagtgtgtaatccattctcctctttgtaggcatttacacgatttacaattttgtatgattagaaaataaaccacaatgaatattgttgcacatgagttcaaaagtttctgtgaagaacaaacctaaaagtagaaggttagagcatacatattttcagctttagagaatactaccaaactcctatatataatttttaccaatatgctctctcagcagtagcactgagagttcttatttcttccaaaccttgactatacttaatgttaccagaccttagaattttgtcatgatgatgggcatgaagtggtaaaacaaggacattttataaaagtatccatacataataaaaacataacattcataaatgtaggcaatataaaaatttatcaggtaaaaaatattagattataacagctgtgagtggtagctcacgactgtactcccagcacattaggaggccaaggtgggcggatcacttgaggtcaggagttcaagaacagcctggccaacatgggaaatcctgtcttgaccaaaaatacaaaaattagccagatgtggtggtgcacacctgtaatcacagctactcgggtggctgaggcaggagaatcacttgaaaccgggaggcagaagttgcagtgagccgagaccacaccactgcactccagcctaggagacagagtcagactccatctcaaaaaaaaaaaaaaaaaaaatagattataaggaggagattgagttataaaatgataggaagaggcattatcctgccaccaacaacatatgatagatcaataatcttttaaagaacaacttttaaccatactgaatggataaatattatctagcaaatataacacctttcagagcattcactgatcaactctcaaatttcaaaaactggaaataatttgaggcatattaacttcacaaaaacgcagtaaagccaaaaatcaacaatgaactttaaataaaaggcctcaaccttttagatttatttaaaatacattaaagaacaaaaatatcagattacacaaaaatgacaaaactaacaaagctaagaaaaaaaatgtaataaaatccaaagctatattgtgaggtatattgctgcaattattaaaagtaaatattggctgggtgaggtggctcacacctataatcccaaggcagtaggactgcttgagctcaggagttaaagaccaggttggacaacacagcaagacctcctctctactaaaaataaaatttaatgtgcctgaactcacaagtactcaggaggctgaggcgggaagattgtttgagcccaggagatcaaagctacagtgagccatgatcgtgccactgcatcccagcctggagctacaggcacatgccaccatgaccagctaatttttttttttttttttttagacagagttttacttttgttacccaggctggagtgcaatggcgcaatcctggctcaccgcaacctccgcctcccaggttcaagcaattcttctgcctcagcctcccgagtagctgggattagagacggggtttcatcatgttgcccaggcgggtcttgaactcctaaactcaaacaatccacctgccttggcctcccaaagtgctgggattacaggtgtgggccatcgtgcccagcctcataccatggactcttacacaacaacaaaaaagaagaatatagaatatagaaatcagcattgaaagatctcaaaaacatactatggaatgacaaaaagccaagtttcagaataatatatacagtgtaacatttatataaagaccgaaaacatgcaaaactatgtattctttataaaaacatctatctatactgaaaatatagaaacaagagtaggaatgatgaacaccaaattcacaacagtggttacctctggtggagacagggtacaagggtacacagtgggcttcaattatacacaatattttattacttgagtggggctgtaagggttgattatattgttttctatataatattgtgtgctggcaacatttcataacaaggaaaaaaggaagaaaatatcctaaaacaaattaatatgtaacaagtaaaatgttagaactgatcaatctaaagtccaactctttgaaaacatgaaagatggctgggcacagtggctcatgcctgtaatcccagcactttgggagaccgaggcgggaggatcaccttaagtcaggagttcgagaccagcctgaccaatatggagaaactccgtctctactaaaaatacaaaattagccgggtgtggtggtgtatgcctgtaatcccagctactcgggaggctgaggcaggagaatcgcttgaacctgggaggcagagattgtggtgagctgagatcgcaccattgcactgtagcctgggcaacaagagcaaaataccgtctcaaaaaaaaaaaaaagtaaaaaaaaaataaaagacaaatctcacacaaagcaaaagaaaaaaactaagaaacacaaatagctaataccatagagaaaaattttaaagagtgaaattaacagactatttacaaagaactcaaaagcaggccgggcgcggtggcccacgcctgtaaccccagcactttggaaggccgagacgggcagatcacaaggtcaggagatcgagaccatcctggctaacacggtgaaaccccgtctctactaaaaatacataaaaaaaaaaaattagccggacatggtggcaggcgcctgtagtcccagctattcgggaagctgaggcaggagaatggcgtgaacccaggaagcggagcttgcagtgagccgagattgcgccactgcactccagcctgggcgacagagcgagactccgtctcaaaaaaaaaaaaaaaaaataagaactcaaaagcaacaaattctaaatatccaatacatcatttttagaaaaacatagatcatccaaataactcaagccagatttgaaaatcctaaaaaattagttaaaaaggaacaaataaaagacatcaaatacagttgctcataaggctgacctctctcaaacccttgaggaacatattattctctgctaatgatccttctaattgcagaaaaaggagcaagggtacaaaaactctcaactcatttcatgagttctctttacctagcacaaaaacctgacaaagattgtacatagatctacgcatacccacacaaccccaaaacatactaatcttgcatatcatatttggtaaggatcctaaatattacccaattcacgattttttaatcagctcttctataattttctaaaaattcttaaatatattacttttagaatattcaaaaactattaatacagaacaagtagcaatgggttcaatatccattctacaaagcttctcatatttacctaattaaaaatctgatatgtaattaaaaatctattcttggccgggcacagtggctcacgcctgtaatcccaacactttgggaggccaaggcgggtggatcacctgaggtcaggagttcaagaccagcctgacaaacatggtgaaaccccatctttactaaaaatacaaaattagccgggcatggtggcgcatacctgtaatctcagctacctgggaggctgaggcaggagaatggcttggacccgggaggcagaggttgcagtgagccaagattgcaccactgcactccagcctgggcaacaacagcgaaactccatctcaaaaaaacaacaaaaaaaaaccctattctttatattgtttcaacagatgttaaaatatactcaaaatacataaacctgataaaaactgaacagtttttggtaatgatgatagttctaatatctcacaacaaaaacatcttccacaattacccacaatttatcaactggagcttgttcacctttcaataattttcacaagtatccatgccaaataggcattagtaaaggctcaaaacattcattattgcctcaggtaactacaaaaaaataactgaaaagtaaataaataaagttaaaccactactttaaaaacatttgttcctctattctatatttagcattggattaaatcaccatgggaaggagaggaattaaattaaatcacaactaaagagtctgaatgttaaataatccagtcaatgtgcttatctttgtactctatctcaaccaaagccttaagattgcaattattattatcagtcttaaccaactagaggcaatcattttctaaaataatttctaagtactaactaaagatgggataggtatcttctttagctcctgaactttgaagctattttctttctacttaatactaaacctcagccctagaaccaatccaaactatacacaagaagaaatttaagaagccagggttcaaaagtaagattttctgtcaaatcatatttgccatttgccattgtctttgatactggtttgcccaattctcagaattagatttctctcttttttttaaacctatagctgagttcctctttgagttgcctgaattgttcttatcagtctcttaccaaagaagaaatgatgcactagaaacagaagccctggtttctgctgaactgcctagacttataagtaagaccattagccacaatgccctgtcacaataccaaatgcttgactaaaatatcacctgaaatacctgactaaaatgccatctgttctctggcctttatgatcttcaaaattacaaccctcagataccacactccatctcctggtagaacttctttccagtaagtctagttccaattcaaggtactcccttcccctgcctcttcctctgccaggttatcattccactgaagttaataagcaatgcccaatcacgtacagaaaaaataaacgctgggtggttagataaataagaaagaggtatctattgctctcaaagagcactggagccttacaacagacacaaactaataattaactttatgctctaaaactaaattatgctacgtagaaacaaatgctctgtatttagggagtcagtttagaccacttaaggttaaaccacatgaagtggcctatgaaccaagatttggaagatgaataatattttttaaaaaagcaagttattcataactgtcaaaaactggaaacaaccaaaatgtccttcaacagataaatgaataaactatagcacatctatataatggaatattaccccgtaataaacagaaatgagctatcaagtcacagaaagacatgaatgaatcttttttttgtttctagagacagggtctcgctctgttacccaggctggagtgtagtggcacgatctaaggtcactgcaacctccgcctctggggttcaagcctcccacctcagcctaccaagcaactgggactacaggtacacgtcaccacgcccagctaatttttgtgttttttttttgttgttgttgttgttgtttttagtagagacagggtctccctatgttgcccaggctggtcttgaactcctagggttcaagcaactcacctgcctcagcctctcaatgtgctgggattgcaggcatgagccgccagacataaataaatcttaagtgcgtattactaagtaaaacaaatcagtctgaaaaatctacatattgcatgattcaattatattacatcctggaaagggcaaatctatatatctactaaaaagatcagtggttgccagcagtttagggggagggactgaacaggtaaagcacaggggatttttacggcagtgaaactattctgtatgatactataatagtggacatatgacttcttgcatctgtcaaaaaccaaatagcatgaagagtggaacttaatgtatgcaaatattaaaaattatttaagagattgggggattccacgaaggaatgtagaccatgacaagaaaacagcatgcatgacaaatatatgaaacctcaacaaatagggtggaaggaaaaggtgctgttctaagtaattttggaaatgagtgaagtctgcaggattaaaggcagaaggaattgctcataagcactgtattctagttgaaaaagtcatttcccagaggggtacaggttaacaattttgataccactatacatgtatactggaattaaacaaataagtaaatggatggcagaggacagaagacagctttctcactgttgaagcgggagttcacagataagcaagggaagaaggctagaatgatccacgtggggaatggattacagttggagacattatcatgaactcatgtttacctttatatagatacagatgattacatattaaaatatgtatagatacgtggatatacacaggttagtatatacacacatatatttccttgctatgccagacgatagggcctataagaaatgacaccccatctgatgggataaatctggcaagatgagaaggggtaggcaagagagaaattagctaagaaaacatgataaatcatcactccaggaagaaagaatcaggtaataaaggcccttgatgtaagaagaagcatggtaggagatgagaacctttatgtcctattcaacccataagggaaaaaaaaaaaagtagtatccttttttctccacccacccaaatacccccatcttgaaacaaaataatctaaccaaaatcttagtatgagaagaaatctcaaatatgaagagaaaaattagcatagtcccagaatattacagtccagtgtggaaatattcatcctatccagcaaatttagggactatggatgtctggagcaagtggaggcagaggagaaaacacaaattttataaagattctgccacatccaatagcaaactgaggcaggtatcaggaaaaattagatcttttggaaatgctatttaaaaatagtgcctaataaaagcattattaacagaaagcattaacccgtttacacctacaaaatacacaaaataaaaaataaaaagttacaaagatttgaaatgacaactgaaaatgtaatcactcacctctaataattctgagacaataggcagaacttcaggattacagatatcaatggagtcatcccggtatgtcttctttttgtaacagatattacccaaatgtagtatggctgagagaagagagaaaatcctgggaaaataaaacacaaattatagcttagttgtgtccattcccaaagctcatttcattctaaaattctagttaagcaaattaacctacaaatatgaagtatttagtctttggaaaataagcaatatgggaataattactaaaatttactgagggtttacttatatgtcaggtactgttcaaaatgcttttcatggccttaagtataccacttcttatatagtcatttcaaagggacttctgctattgcctgaatttgtcacagtgtttacagtgttttaaaaaggccatgcctctctaaatgctatttatcctgccaggaatgcttttttcctacactgtttcagatacactgaatcagaattgccaaaggaaaggccttgaatctgtattttttaaatcaagtatcctagctgattttttattattagttatgttgttaaaatgcttttctataccatagtatggtgtttgaggtaaatgggtgtgtgtgtgtgtgtgtgtgtgtgtgtgtgtgtgtgtgaatggggtaaatgggtgtgtgtgtgtgtgtatgtgtgtgtgtaagtatgaagccatgtggggtatattaacctctactgtgaaacaacttcatatggaccctccgttataaatttccctcctgagtcagaagagtatgtgccctccaatcaaaaactaatccctccacttatgctatatatcccatcaactcctgttaattcaggaaccttaggttaccaagtacctccatgtagctaagaacagtatattatgttattgacttatctgacatctcagaggcatttaacacagctaaacaatccactgaaaaactcttcctcagtctccttatatatatacagctttgtgtcacatgcagttattttcttagaataaatacggcttacaaaatttggcttatgaaaatttaacactatgttttcctaaaattaggaagtattccaactaaaacaaagatattgctttaggaacctgagatattaccttaggaacatttgagaggtactgaatcaccatctaacttataaatctaatttttcaaataatttaaagtttttaaatctttgaatcattcacgtgactcacaggaaatacaagtctattataaaaataattaataatgttattctggattaaagaataaactatcaactgaaacataaaaactaatggaagtcaaaagacaaaaacaaattcatgagcctcttttaaaaatgatttttaatagaaattcactaattttcattgaactgtagtttatgtcaccaattgagttggtatgccaacttacatattgtattatttgattttaattgacttctcataaaaagattctagtaaatagcctgctaattaaagagtcataccaatgatgtaagtgcaagcaaacaagaaaacaggagaggtgattttctcctactctcagtatagggtcatcaatcatgaggttaaaaattaacaacagagggcgggcgcagtggctcatgctggtaatcctagcactttcagaggtcaagaaaggcagatcacttgagcctaggaattcaagaccagcataggcaacatggcaaaaaaaaaaaatacaaaattagctgagtgtgatggtacaagcctgcagtcccaacttcttgggaagttgaggtgggaggatcatctgagcctggggaggttgaggctgcagtgagcactccagtctgggtgacagagtgagatgctgtctccaaaaaaaacaaagaaaaaaaaattaacaatataatcagatctgacatattcatcagcacgactctccccttcaaaaaagttataagtaactatttctttctggtgagagccaaggttgagtctttaattttaaataatttgtttcaaatataatttatctcatctttatctcaaatttttatatttttaaattgtttagatttacaattaaaaaacttaatagtatagtacagatataaactatacagaggaaatacactgaaaattaaatactatgcatctgataagtatgcataatttaataagattagagatcactgatatatacaaaatgaagagctataaaaatagtgttacaaagcaaaagttttaagtaaggtccatggataggcttcaggggcaccataaattcctgcatttatatgcaaattgttaaggatgtacattttacaacaacagtgtcagctttcatcagattctcaaaataatttatgataaaaaaaggaattagaaataatgctcgagatggatgaggtactagatgaagaataccacttagaaaactatttaaaaaggtcaacggcagaaatctttcaaagacatatcatgtgttctctattagagatataaaaatacaacaagtaaactcactgtcttcgtgtcttgggaagaaatcctaccatttccatggcaagttgtaggcgctcaaagtcatgtctcaaatcttctccttccaccgtgaagcaatcctgcttatttaaaataaaagtttaaaaatcaagattatatattttaaaataatgtgggccattcagaaatatggtaatttaggataggtacctgtatgtataaatgcaaattagagctggtagaatagtaagacctagtcaaattcattagacctcttatcttactacaggtatggaaactaaacacatacttactaaaataccaataagttacttttgttctccctttcacaatcaccaagattaggatttcaaaagttaacttaagataaagagttagctgtactcagtaagtgtgctgatactaagtttgattttgagtggttctaaagggtttcagaaattcaaagcatttacgggcgctcaattctaccagcaaatactatttattcaacaaatatttaacaagtgcctaccctatgtaaggcactgaactagatattagtgacacaaaaataaattttagaagaggcaataatttagttgaagagtgaaccccagatttacgtaatatagtttgttacatctatctaatctatatttatatagatctatatagatatgttattttttttttttaagacagggtctcattcctgttgctcaggctggagtacagtggcatgatcttggctcactgcagcttcgacctcccgggctcaggtgattctcccacctcagcctcccaagcaactggaactacccagctagtcctaccatgaccggttagttttttgtatttttaatagagacatggtttcaccacattgcccaggctagtcctgaactcccggactcaagcagtccacccacctaggcctcctaaagtgctagaattacaggcgtgagccactgtgcccagcctgttacatctacattagatatatacatatataattatttatatattttatatatgtaattatttcctaatgaaataacagacaacatggtaatcaaacaaggaaagaaagaagtatatgtgaaagtataaaaaccctcagaaaacacatcagatgagtcagtaaaactagttgtgaatagtcacacatgcctgtaatcccagctacttggaaggctgaggtaggaggattgcttgagctcaggagtttgagaccagcctgggcaacacgcatgacaccatctcaagaaaaaaaaaattgttgtggaataccagattaataaatactactttttaagcataatccttgcatttcagttcctaaaatagtcaaacagtggtagacatactctaaatcttcaaaacaataagtgagtcataaatctctttactgtaagttctcacagtcccttgcactttcaaaaacctcctcacatttgcatttacatttttaatgcctatcttcctagggaatattctctcaagtacttggtgaagtatatgaactgttaattgtcttattaactgcagatccccagtgcgaagtcagtgccaaaaacaagtcattatttaggtaaatacatagtcattgaattattgaataatatataaatattgaattgaatgaaacattcctttttcagaaataaagtgctcatttgttttataaaaagtatttatcaagtatttaccatgtacaagaaaatctgttttaggcactgtaagcattagttaatgaatatctaaagtttaaaataaagttttgaaatgctgttaccaatatttttattctctacatggaaagctacacatgcatagtttaaaaatttaaattcaccacaagtaaagttctttctgagaacccatgcatttaattttattactataaaattgctttcgataagcaattttaagacattctactgacatgccaatgtcctactcattaaaataatttttttttgagatggagtgtcgcacttgttgcccagctgctgtgcaatgacgcgatgtctgctcagtgcaacctctgcctcccgggttcaagcaattcccctgcctcagcttctcaagcagctgggattacaggtgcgtgccaccatgccaggctaattttcctatattttttagtagagacggggttttaccacattggccaggctggtctcaaactcctgacctcaggtgatccacccgcctcagcctcccaaagtgctgggattacaggagtaagccaccgtacccagccctaagataaatttttaaacacattcttcttttacctatagtaagtaaccttttgtaaaaagctctcttgctactcttccccctagtctcaaaacacaaacagttcattcactttatgatttaacaaatattttcctattacaagtggcaaggcagggggaatctatgcttccacatgtgtcaataatgattcttctaactaacagtgttctaatcttccccgaaagtgaatggaacaattaatgtatataaaatagtgggaaagtacactgaaagaggcactaaaatatgtttgtatttgctcttatccttaatcaaatgttcttagaaacccaaagtggtctcagtgaatatcaaaatcatagtttaaaaaaaatgtgtattaatttccttctctgtttctctgatgataactgtagaagaaaaactaaggataaattaaatctcccagaacagaaatgactttatcttaatttgggctccctgggaggcagatcttgagacagaccaagagtcaaatacaagtcacagagaaagtgagaaagtaaaagagaagacagactaaacagtctgtgctaactactatgaaagtagttaaatggagtttaatcccaaggttatctctgggaaacaatataaaacctacagaggtgagggagctactgtatttatttatataccatctcatctctcatcagtcattgtttgaagacttctggagagggagcaggcagctgttaattcccaagtcacttctagagggccctacaaatgccaaggccttccagggttctggaaaaagccttcaggccccaggatccaaatactggtcagccagagttcaaggaaatggtaaggttcgttccaaggataaggcagggaactaaccaacaactgttacaaccccttccactgaaagaacataggcaatccttctgtcagctccatataagttcttgtttgtacttgataacatgccactacattccccccacaaacatacccaccaaatgctctttcatgctatcagaccttgctctttctgtaaggtgacacactttcccatttacaaatgcctaggataaacctagcatggagtaggcaattagtgtgggtgtgagggagagaaagagaagagtcaaattagatattttcttctatcttgtctctatttcttaaaattgtacttaagaaatcatactatcttgtctctttttcttttttctttgagatggagtctcactctgttgccgaggttggagtgcagtggcacaatcccagctcactgcaacctccgcctcctgggctcaagtggtccacctcaccctcttgaggaatagctgggactacaggcctacaccacagcatccatctgatttttatatttttttggagggacagtgttttgccatgttgcccaggctggtcttaaactcttgggctcaagtgatctgcctagctcagccttgcaaagtgctgggattacaagcatgagacactgtccagttccatattatatttgatccttataaaacctctggtggtagttatgattgcctttcacacaagcagcaagcagcattggctcacaatttaagccaattgctcctatggtggtgaagcttgttaatagtgtagctgggattccaaccaagcctatgttatttatctccttttttcttaagtgatctccagcatctttactaaccttcaaagtcaattgttccagtttatgtcctgcactctacactagtagttataaaaatgtatgatttcttaagtaccattttaagaaatagagacaagtggccaggcacggtggctcatgcctataatcccagcactttgggaggctgaggcatgcagatcacctgaggtcaggagttcaagaccagcctggccaacatggtgaaaacctatctctactaaaaatacaaaaattagccaggcgtggtgccgggcacctgtaatcccagctactcaggaggctgaggcagaagaatcgcttgaacccagaaggtgggagttgcagtgagctgatatggtgccactgtgctccagcctaggtgacagagcgagataccatgaaagaaagaaaagaaagaaaaggaaaagaaaagaaaagaagagaagagagagagagagaaagaaaggaaagaaagaaagaaagaaagagaaagaaagaaaagaaagaaggaaggaaacaaagaaagaaaagaaaagagaagaaaagaggatgttaagtgctttttttaaatttttttgagacagggtttcactctgcccacccacgctggagtgcactggtgcaatcttggctcactgcaacctctgcctcctgggatcaagtgattctctcacctcagcctcctgagtagctgggactacaggcacgtatcaccacgccctgctaattttttttttttttttttggtagagacagggtttcactatgttggccaggctggtctcgaactcctgacctcaagtgatccacccacttcccaaagtgctgggattacaagcgtgacccaccgcacctggccagatgtgaagtgctttttaaacagaaaaatatatgcagagaaagttgtggagtatgcagagaccttatactagaccggcagagggtaaggaataaagccagaaagacatgtttaagggcgtgaccacaaacttacaaactgacagatgggttttggcagtaggaatctttatactgcaaaaatacttaaaacagagtagatgaaaacattatggtttcagggtatcttgcccaagttgcatcatgatctctgaaagcactataggaggtctacctcataggaaacgagcttccacagatttatagatgtttggattcctgtaaaggtagtagtgaccaaagttggagctttgtctccacagaataatacaggtcaaatccctttgcagcatggtggaaccaacagtgtcctgagactatcacttatggcaatgaccattaaaaccctacctaatagttggaccctaaaattcatggctcagataaataaaagagtttggtgaggctgaccgaccctttacattgaagttactcagatcaggttttttttttttttttttttttgagacagagtctcgctctgtcgcccaggatggagtgcagtggcgtgatctcggctcactgcaaactctgcctcccgggttcaggccattctcctgcctcagcctcctgagtagctgggactacaggcgcccgccaccacatccagctaattttttgtattttttagtagagacggggtttcaccgtgttagccaggatggtctcaatctcctgacctcgtgatccgcccacctcagcctcccaaagtgctgggattacaggtgtgagccactgcgcccagcctcagatcagctttaaggtacaatggcagacatcagccaacatattaccagtatttaattcattctccatattttataactgaggaaacaaaggctgagatgttaataataataaaaataaaaagacatttaatagattattaccacttgaagaggggaaattaacatttattaaatattcttctacatgtcagtcaccatgagttactaaaacctcagaacacaaggagatacttatatatacatttacggaagagaaaatagattcacaggttaaataacttgccaaagcttaaaaaaaaaaatcttataaataacagggctggccaatccaaaatctatgtagttccaaatcctctgctctctcccatgcaacactgctgtttgtgcttatttaataggataacccttaaatggaactaaatcaccacacaagggcaacaacaggtaccttgtaaaaagcaattttctaactataggtctccttgggaccatttatacaattccacgaaatacataagtaatgtagtacaacagaagagtcctcaaacaatcctctctacctatgatgctagtcacataagttctaataactcacagggaaacaaagtttagtttgtccccaaatatattatgaggaagagctaacaggaaagaataaaagatcctcagactgcttgcttttattaattaacataagaaaaacaatcagaaattaaatttcaaactataatagattttaagacacaataaacggataatggtgatgaaagtatgattaagggaagaggagattatggctacaaagttcttctaaagggaaagatgggtaatgatgacttcaatggtggcaacaacattcactatgcacttactaaggattatgtactctatcaagttctttacatgcacaactttaagactcacaaaacttaaagaccattattaacccctaaaataaatgaaactggaaaataagccagccaatatttatgttaggtcattctgcttcagagcccaaatcttttttttttttttttttttttttttttgaaatagagtcttgctgtgtcacccacgctggagtgtaatggtgtgatcttgtctcgctgtagcctcaacctcctgggctcaagcaatctgcctgcctcagcctcctgagtagctggaactacaggcgtgtatcactatacctggcttaaatttttgtagagatagggtattgccttgttgctcaagctagtctcaaactcccagtctcaagcaattctcccacctcagcttccagaagtgttgaattacaggcgtgagccactactctcggcccccaaattcttaagtattacttagactatctctgaaaagtagcagatcagttcacaacttcactgtaagctcagaacagatgatcaagtcttctatttgcagtatgtgtttgcagtcccctacctgctttccaaggaggcatggtcacttggtgtagtacgtgaaaaaggaaaagggggagcttcttaagaatggcaaaaacaacttaaattttttgttaaaatgtatcagaatctataaatttatatgtcaagtgtttttttccccaaaatgttaaatctaaactccaaaattacttggttatgtaatagtaatacaattaaaatttctctaaaaaaaattattattcatgtatactgatcattctcacctgtgaaataagctagtcatgcaattagtaaagtttataaacatgctgtgagaatcacagttgtggttctttaaagcaaggactaagaaatgttttcagaaagaatatttaataaattaattcattaattaatagacataggaagattagtatgtgttttcagcctttttacaagtaacttaattgaaaacttaagaaaaaaatttttgtgttctttatggttacaaacttgtcataaaatataacaaataaagctaaatttagcggggcatggtggctcatgcctataatcccagcactttgacaggccaaggcaagagaatcacttgaggtcagaggttcaagaccagcctggacaacatagtgagactctgtctttaatttaaaaatatacttattaaaatacagtaatataatttttaaaaaattaaagcaaaatgtacctattcactttatattacatcatacatccccttaaatcactcaatttacaacataaaataggctgggcatagtggctcatatctgtaatcccagcactttgggaggccaaggtgggcagatcacttgaggccatgagttcaagaccagcctggacaatatggcaaaaccccatctctactaaaaatagaaaaatcaaccgggcatggtggcgcacgcctgtaatcccagctacttgggaggctgaggcatgagaatcgctagaacccaggagatggaggttgcagggagccaagatcatgtcactgtactccagtaaaagagcgagactctgtcacaaaaaataaatatttaaaaaaaaccttatttataggaatttcaatacttatttttggataattttattaaggctacagactctggctactgggaaaaaaaatcaaagaaaaatatacatgcattcattatgtgtaaagactgttgatatataaaacataaagaatgcaattttttgaaataaacaataattactactcatagtatgtaggtaatgaaactactaaaaaataattttaaaaaataaaaggggaaaaaaaccatagttcatacaaatccacagcaatgatgaagaatcaggaatataatcaatttaatgtttgtcgaaataaatattgaatgtggactaagtcttaatgaccagaaaatagcccaaaaaaagtaaattaactggttttaaatcaacaaactatacagatataaatcaatcattcaaaagaaatgaaacattgatttatcttccttcctaggattctttgtatttcagctgatttgcattctaaatcttcagatggatgcaaatgcgcaatgtgaggaccctttgacagaaacacagaatatttaggtacttgtactgaccggctcagagtcatagcaataatcatcccagctctgtctgaggggtttctttgttatctgaaagtaaggcagattagttaggtagaagtaatggttattatactcttctaatgatctcttagatgtggtgtgcaagtagtactgctgctctccattgaaaagttattttgcatagcagcataaaacaagaaataatgaagcaaatattcacatgctgggagactgtatactgtactaccgaacgcatatataccatgggctccagtgactgttatttatataaactgagtcccatatcctatgaatattgacattatgacaggaatatattatggtcattaattacaaaaagatctgaaagaacagcaaaattccagacttctctaatactaacaactatcagctcatttatgagagaatattactttataaaaaagaaaatctttaatcacccaaatataatgcaaatagtttaaactggggaggaaaaaactcagaagctgaattagcaaatatttttgaaaagctatttaattctatgtgtaaaaattaataatattatatcagaaatggatactttaaataacttggaattctcaatatattaatacaaagtcattagtttatattaatataggtagtttcaaaattaagaaataacagttaatacaacacactgtattaacttggagaaagccaaaggtataactttctttttttcttttttttgagacggagtctcgctctgttgcccaggctggagtgcggtggcacaatcttggctcactgcaacctctgcctcccgggttgaagcgattctcgtgcctcggcctcccaagcagctgagattacaggcgtgcctcaccacacctagctaatttttttgtgtttttagcagagacaaggtttcacgatgttggccaggctggtctcgaactcctgacctcaggtgattcaactgcctcagcttaccaaagtactgggattacaggtgtgagccactgcactcagccaaagatgtaactttcataaccctaaatatatactgctatctgaaccatcatcaaagtgtcaatttgtttacaaaagcttcgtaaggatttttttaatggtcataaagggatttatttccgtagacattacatcttgcctccaacaatggaaaaataaggggagacatctattatttaaatgacctattgttttactaattccattagtgctggttgtaaaatttctgttattatgagaaataataaaattagtaaagtcaatgtaatgaaaagtaagaattactcctcaatgtggaagtttagggatgaattttgagttttgaggaaagatccaaattctctaagtcatttgcctttgatgaccttcatactgaatatttaagaagattgttcattaaattataaaaatagtcatactctaagtcagtgtcatagtatcatgcaaagacgtatgtgtatgagacttcaaaacatgcaaattaggtttcaagtaatcccttgcaaaggacaagaattaatcattagtaacatttaatatcctgggggttgtaaaaggtaaatcactttagtaaaagtaaagcatttttctaatacagtagaaatatcaataaacagcttattattattttcccaaagaatctcacagaaaacgaaaagcacatatattatctgagcttttaacatttatatgaggatggtaatcatcctcaaatttgagaactgcatcacctaaatttgtagagtacatatatgaaaatgctagctaatccattcctaggtttgagaaagtactagaaaaaagacatttttcaagcattaaatttaatactgccctatacttcaaaatgctttttatgaactctcacctgattgagataatgatattcctctggttgcttaagatggaatgctgatctctcatcttcacttgctcctgccaggaggtaatagaatacatgatagttcctgtgggaaacaaagaagtacaagtttcataatgtgtgacttatggttatcatttaacagggggaggggggaagcaaacagtaattagtaaaatgtatcagctttgcttcattttttaatataaatgtgataaattcagcgtttaagtactcctaaaaattgaatgatgttttggatgtggaatacaaaagagagggatgaaggcagcaaagttaacaaagttaggacctctgaaaattctcttctccataaaaccaatgagaaatctggcaaatctgtcataattaaccttttcagaactgtggaaactaatcgaaagcttgcaacaacccagagagtgtttactcaataaaaagagctaaatctcaataaaaatggctttgtagtgttttaaacttgccctattccatccccttgaaaaccaacagcctgcaaacttggagatgagaagcctgacagctaccagaaaggtcagaacagagtttgagcttgttcaaagcctcattccctaagaaatatcattatttgaactgtctggtggttctctgtgaacagccatattcaaggctgactctacaagattcaattcggacttcatatcatgcaaagatcttttccccagaggcatccatagaaactgaggcaatcgctgaacagcctacttcctaaagcagtggatcaaagttggggcaaacaataggctaaccaagaaacttaaaaggaaaagctggctttgaaaacctccagtaaatgtcctgggaatctagaaggtcatatgcatgcataatgctgtggacatgcccagggttgtgtgtgctctcagaaaaataacagatgaaatataaactctcacctctggttaactttgaaaccctgcacaagcagaaaataaaggctaaggtagatttgtgaaatacctagctgagtgttgaaggcatggaacaatatacatagagagccctgtggcaaagagtgagagacttacttattgtttccaagcatttaaataaatatctgtccagttattacctgacatctaagttaaataagcagacacttcaatagccacactcaaaaaagaatatcaactttataaaattagttcagaaaagtcacaattaacaatcagacagtaggaataaaagcaacaatcaaaccctgggaaggagaggactcatttctagagctgccacattatattattttaaaaatcaaattttttggccaggcgtggtggctcacacctgtaatcccagcactttgggaggctgaggtgggtggatcacgaggtcaagagatcgagatcatcctggtcaacatggtgaaaccccgtctctactaaaaatacaaaaattagctgggcatcatgacgtgcgcctgtagtcccagctactctgggaggctgaggcaggagaatcgcttgaacccaggaggcggaggttgcagtgagccgagatcacgctactgcactccagcctggtgacaaggcgagactctgtctcaaaaaaaaaaaaaaatccaattttgttgtgttttgtttcgtttttgttttgagacaggatagctgtcacccaggttggagtgcagtggcatgctcatgattcactgcagccttgacctcctaggcccaagtgattctcccacttcagcctccctagtagctgggaccacaggtgtgcaccaccaaatctggctaatttttgtattttttgtagagacagagtctccccgtgttgcccaggctggtctcgaactcgtgggggctcaggtgatctacccatcttggcctcccaaagtgctgggattacaagcgtgagtcaccacacccagccaaaaaaaatccagttttcaacaacaacaacaaaaaattataaggcatgcaaagaaagaagacagtatagccgatacaaagtagaaaaagtattaattaataactgtccctgaaaaaacccagacattagacttacaagattttaatcagctattttaaacgtgttcaatgaactacagaaagtcacatttaatgaactaaagaaaactatgagaacgctatctcaccaaatagagactaatatacaggactttaaagaaattaatccaaaaagaattctggagttgaaaaatataactgcaatgaaaaagtatccagaggagctcaacagcaaatatgagtaggcagaagaaagaaccagtgaacttgaagaaaaaatcaacaaacatgaagacaggtcaattgactctcgtctaaggaacagaagaaaaaataaaatggagaccacaaggtctcagagacctgtgggacaccattaaaaagactcctatggcaggcacggtggctcacacctataatgccagcactttgggaggtggaggtgggtggatcacctgaggtcaggagtttaaggcagctcacgcttataaccccagtactttgggaggcagaggtgggtggatcacctgaggtcaggagttcgaggccagcctggccaacatggtgaaaccccgtctctactaaaattacaaaaaaaatagctgggcatggtggcaggcacctgtaatcctagctactcaggaggctgaggcaggagaatcacttgaacccaggaggcgaaggttgtactaagctgagatcacaccattgcactccagcctgggcgacaagaatgaaactctgtctcaaaaaaaaaaaaaaaaaagaaaagaaaaaaaggctcctatactgggggttctaaaaggagaaaaaagaaagggacataaagaatacttgaaaaaacaattgccaaaatctctctccaaatttgatggaaaacattaatctgcacatccaagaaattcaatgaactctagagagtataaactcaaatccacattttgacaaaccaaaattcttgaaaggcaaagacaaagaattttgaaagcaccaagagagaaattcctcatcaaggaatcctaacataagattaacagctgatttctcatcacgaaccatggcagacagataacgtattcaaaacgttgaaaggaaaaaaaaattgtcaatcaagaagtatatatccaggaaaaataaaggagaaattagaatactgccagataaacaaagttggacttcacagctatagatggtccttacaagaaatactaaagggagttcatttttctgactgaaataaaaggatactagacaagattcaattaaacatgaagaaataaagaacactggtaaaagtaactacataggtaaatataaaagatagtataaattaattaactcattgattgattgattgacaggatctcactctgttgcccaggctggagtgcagtggcatgatctcgactcactgcaacctctatctcgtttcaagtgatcctctcacctcagcctcctaagtagctgggactacaggcgtgcatcaccacacctggctaatttttgtagagataaggttttgccatgttgtctaggctggtctcgaactcctggcctcaagtgatctgcccaccttggcttccccaaagtgctgggattacaggcaggagccactgcacctggcctattttttatgtataacacttttttcctattaaacttgagaaattacataaagcagtaattataaatgtgttgatggatgtaccaccataaagaagtaatttgcataacaattacaggacaaaggagcaagaaaggaatagaactacatacaaagtttgttgtatactatcaaaattaagttgtcattattccaaactacattgttatcagattttaactacaatgcccaaggtaaccaataagaatataaaaaataataaaaagaaatgccaatgaaattaaaatggtacactagaaaacatttatttaatgcaaaagaaggcaggaatagaagaacagaagaacaaaaaaaaatcgtaacacatatggagaacaaacagcaaaatggtattaataatcctaccttatcaataattacattaagtagatcaaatgctctaatctaaaggtagataaatggcagaatggataaaaggaaaatgtatggtccaactgcatactgtttacaagagacaagctttagactcaaagacacaaataggttaaaaataaaaagatggaaaaaaaagttaccatgcaagcaatatccaaaagcaagctagagaataccagataaaacaataattactaattattactaatatcaggtaaaataaagaccaaacttgttcctagggacaaagaaggccatcttataatgacaaaagggccaatccatcaagaagacataacaatttaaaatatacataaatgtgtgtctaagaacagagcccaaaaaaacattgagcaaaaaaactttttttttgagatggagtttcgcactgtcacccagactggagtgcagtggcgagacctcggctcattgcaacctccaccttccaggttcaggcgattctcctgactcagcctcccaagtagctggaaatacaggcgcatgcaaccacacctggatagtttctatacttttagtttcaccatgttagccaggctggtctaaaactcctcatctcaaatgatctgcctgccttggtctcccaaagtgctgggattacaggagtgagccagtgcacccggccacaaaaagaacttgacagaactaagagaagaagcacacaattcaacaataatactgagagactgcaatactccactttcaataatgaagaaagcaactagacagaagatgaacaagaaaaagaggacttcaaaattactatataccaattagacctaacatatgtttatagaacactccagtcaacataaggaggatatattcatatattttttcaagtccacatggagtatcctccagggtagaccatgtgtagtctactacaaaacaagtctcaataatttaaggagattgaaatcatacaactactccaaacactttgcagtgaaataagaaatcacatttccacggccaggcatggtggctcacgcctgtaacattttgggaggctgaggcgggcagatcacaaggtcaggagatcgagaccatcctggataacatggtgaaaccccgcccctactaaaaatacaaaaaattagccaggcgtgatggcaggcgcctgtagtcccagctacttgggaggctgaggcaggagaatggcgtgaacccaggaggcagagcttgcagtgagccgaaatctcaccactgcactccagcccgtgcctcagagcaagactccgtctcaagaaaaaaaaaaaaaaaaaaaaagaaagaaaagaaatcacatttccaaaatacaaatacatggaaatttgacaacacattcctaaataaccagtgggttaaagaagtcacaagcaaaattataaaatactccaagatgcacaaaaacaaaacactacaccaatacatggaaaacagttgaagcagtgcttagaggggctttatacctgtaaacccatataaaaaagatctcaaatctataacctaaccatccaccttaagaaactagaaaaaaaagcaaactaaacccaaagcaagcagaaggaaggaaataataagcatcagagcagaaataaatgaaataggaaataggaaaaaaaatagagaacatcaatgaaactaaagatcggttctttgaaaagatcttcaaaattaaacttttatctaaactgatgagacagacagagaaagaagcagagagaatcaaattcaggagtgaatgaaagcggaacattactaccaatcttacataaacaaaaaagattgtaagggatactataaaacaagttttggcaacaaattagataacctagatgaaatggacaaattcctagaaagataaaaactaccaaatctgaccacagatgaaacaaaaagtctgaacagatctataataactaaagtgtttcaattaataatcaaaatttcacacaaataaaagtcagaaccagatggctttgctggtgaattctaccaaatgtttaaagaattaacccaatccttcacaaactcttctagagaattggtttgtaaaaactggatttcacctctcattcattctccaaaaccaaggaaataagagttatatacccttatttcattatcattaaaatgtgttagaaaaagttactaatagttttctatctgtaaaatgggaataaataaccaagaagcagaaaagttaaatgagatgcccaaggcatacccaatatttgaatggaagtcaaaccctctcttaaccaaatctcactgtagcatgaaacaaatcatgaatttacttctttatcttatttctccatctgaaggataccacatatatcatctctaaagacctgtatacctcaagtaatacaatggaattaagagctttattgaaaattttttttctcaagttagaaaaagaacactaaggaaatgggagcaaagtcccaaggcacattgctcaccaagaggaatgaggaacaactgagaaactgcttacttgttctgacagtttgcaatagttctatataccaaataaagatctcctagcagcctctgaaaaactgcaaagttctgcccatgacagaaatagcaattatgcataaagctatgcatgacgtaaactgaattaagggtcataatacacaaagaccttaaaagtcagtctgcgtgatacaaatgttaacttcatctaattacacaaataaaaatacgtaccgttcattatgctcctgataaacgagtctggacttctccagtagatatttttcaacataggcactacaagaaaaattaaattggttgatataaataataaagtttaatataaggcagaaaaatatttggagacagtgtaaaagtataaagaatactatccagatcatttcaaaatatgcgccattggccgggcgaggtggctcacacctgtaatctcagcactttgggaggtcgagatgagaggatcacctgaggtcaggagttcaagaccagcctggctgatatggtgaaaccccatctctaataaaatacaaaaattagccaggcatggtggcaggcacctgtaatcccagttactcgggaggctgaggcagaagaattgtttgagcctgggaggcagaagttgcagtgaaccaagatcaggccactgcactccagcctgggtgacagagtgagaatctgtctcaaaaaaataaataaataaataaatatatatatatatatatataaatatatatatgtacatactattataattgtggtatgggtactgttagtgttatccatgttaaattcatatggtcacgagtcttttttctttcactaaagcaaaataaaataagaagtttaaaccaggccaggcgcagtggctcacacctgtaatcccagcactttgggaggccgaggagggtggatcacctgaggtcaggagttcgagaccagcctgaccaacatggagaaaccccatcactactaaaaatacaaaatcagccaggcatggtggtgcacgcctgtaatcccagctactcggaaggctaaggcagaagaatcacttgaacccgggaggcagaggctgcagtgagctgagatcatgccactgcactccagcctgggcaacaagagcaaaacttcgtctcaaaaaaaaaaaaagaagtttaaaacacagtacacaagatccctgaagaaagactctacattatttctaggctatataccactacacattcttccagacatactttggacagattactacataaggctcaaagatatacatagtttctttttatatatttacgctattgtcacagcctaaaatcaatttattatataatgatttactctatagttatttattgggcactatatcaagcacaaggaatatggaaataagtgatctactgcctgttctcaaatgacttacaaattagtagagaaaggagataatctagcagctatcatactgagttgatagggcttattgtagagcaatgaccaggatattatgcgtacacaaagagagacacctgagattcaatccaagaaggaaaaaggatgtaaagaagaattcccatggataagtgagtacacagcacagagtaaactttcattacatatatctggtgaaagagtgactgggtaaatgaattcaaaatctgaaggattaaccagaaggaaaggagaactgcctttatgtaaagttataaaggaaggagggtacacataccaacttcagggaaaacaattagttacgtatcacttaactacagaggtacattctgagaaatgcatcattagacaattttgttgtttgtcagcatcacagagtgcacttatacaaccctgatagtatagcctactacacacttaggccttatcttatagcctattgctcctaggttacatagctatacagcatgttactgcactgaatactataggcaactgtaacacaatggtaagtatttgtgcatttaaacatagaaaaagtacagtaaaaatagggtattaaaatctcataggactaccatagtatatgaggtccatcatctactgaaacatcactgtgtggtgtatgacccaagttacgtatgactagagaatgatataggtggacggactacgatcaagagctactatactatatgccagaagaacgaactttatcctgaaagtaatgaggaattaaacatcaattgtatatctgatatttttttctctttatccagactgtgccctccaagtctttaaaacttcttacccaaatgggtgcaatcagctaagatctcattggaaaggggttctagaatctgaaatgtaaaagctttagattactgaatccaaattattaggacaaacctcttagaggccagaatctgactcttaagctgtatttctcccagttgcctcccaccacatgctatatacttcagtcactcacaaacacacaatccctcaaagattccattcactcctaactgcactgctcactttcttcctcccacttccaattccctagtctattcccagtctctgtccagtaaattgcattccttcattaaaataaagctcaaatgtgggttctttgaaaatccattgccactaccaccaccaataattaaaatttatttctttttctgaattaccattgccatttccagtctaaattaccaaaacaggctcttacctgtctaaaatgggagaaaggaaattaacatgaatatgttaaatcctcacaaccaccttgcgtggcaaatattactgcccctattttacaagtatagaaactgatgctgaaagatattaagatcacacagctagtaaaaagcataacttttaactcaggtttgttttaactacaaaggctctctttttcaactacagtagcccccttccactttattcatgggggatacattctaagatgccaaccacaaataataccaaacccacatatatatcccattctacataatacatatctatatactatatctatatctatatatacatatatatatggtttttttccttgaactttgtttttttggaggagtcttgctctgtctcccagacgatcacagctcactgcaaactccgcctcctgggttcaagtgattcttccacctcagcctcctgaacagctgggtccacaggcacgtgccaccacacctggctaatttttgtatttttagtagagatgggcttttaccatgttggccaggtgagtctccaactcctgacctcaaatgatttgcgtacctcagcctcccaaagtggtgaaattataggggtgcctggcctgcgtcttttcttcctatacatacatacctatgacaaagtttaatttataaattaggcacagaagacagggggccccaacccccagggcatggactcgtagcggtccatgacctgttaggaaccgggctacgcagcaggaggtaagcggccagcaactgagcaaagctgagctccacctcctgtcagatcagcggcggcattagattctcataggaatgtaaaccctattgtgaatcacacatgagagtgatctaggctgcacactccttatgagaatttaatgatatatgtaacaagcttgaatcattccaaaaccattcctccatcccccagtctgtggaaaaattgtcttcgacgaaaccagtccctggcaccaaaaaggttggggaccactgcagtaagagattaacaataactaataataaaatagaacaactaggctgggcacagtggctcatgcctgaaatccaagattagcctggccaacacagtgaaacagcatctctaccaaaaaatacaaaattagccaggtatggtggtacacgcctgtagtcccagctactctagaggctgaggcaggagaatcacttgaacccgggaggaagaggctgtagtgagccgagattgcaccactgcattccagcctgggcaactgagtgagacccttctcaaaaaaaataaataataaataataaaacaattataacaatacactgtaataaaatgtatgtgcatgtggtctctgtctgaaaacatcttactgtactatactcaactatctttgggtaactgaagctgcataaactgaaatcacagataagggtggtggtagggggagtttaaaggaatataggggaatttgctgtacttttccacttatttttgctgtgaagctaccactgctctaaaaaatagtctatttaaaaaaaaaaaactatgaagaatattgctcacacaaccagaggactctgaacatagactatataataagaaacaatattgtaacaaaattaaatttctcgaatataataatatggttatataggaaaatgtagattagaaaataccaacttacttgaaaacaactttttatttttttattttttttgagagacagagtctcgctctgtcgcccagactggagtaaagtggcacaatctcagctcactgcaacctccacctcccaggttcaagagattctcctgtctcagtttcctaagtagctaggactacaggtttgcgccactgtgcccggctgatttttgttattttttagtggagatgggttttcactatatgttggtcaggctggtctccaactcctgacctcaggtgatccacccacctcagcctcccaaagtgctaggattacaggtgtgagccaccatgcttggccttgaaaacaattttttaaaagaacaaatgtatgcataatatatagaaagcaaatgcaacacattgacaacaatcaaatctaggttaagagtatgtgtgactgttacattggtgttaaaatttttctgaggttttaacttttccaaaactaaaaaaagttgacagggaagaattttaatgctgacaccaatgtctgggaatgaacaatacatagtttataaaagggtaaagacaaaaattaaaacatgctccaaagcctacgcctgctaagtagcagtacttacccaagtacagtgcctgtttcctggtaatttacttgaataaacttcccaaaacgacttgaattgttattatgagctgtctttgcatttccaaaggcctgtcaaaataaataattctcattagtttcactaaaaaaaaaaaatttttttttggaggggggattaggtcagctgcttaggtcagctcagagacaaaatgttaaagagacagtaaaaagacaatttgcttgtatgttcagactcattcacagttcaggcaaaatttttttaaaaaaaaagcaattaacaactgaaagaagatcaagtagattttattttgtgctattcagtaaaataaaccataattttattttatgttatttatttatttatttattttggagacagagtctcactgtcgcctaggctggagtgcagtggtgtgatttcggctcactgcaacctctgccttctgggttcaagcaattctcctgcctcagcctcccgagtagctgggactacaggcccacgccgccaagcctggctatttttttgtattttagtaaagatggggtttcaatgtgttgccctggctggtctggaacccctgagctcaggcaatctgcctgcctcggcctcccaaagtgctaggattacaggtgtgagccactgcacccagccaaaataaatcataattttaaaaatgtaatgttctttaaagtttggatttctctttcacattccagagcccccctacaaaaaagtcttaatatatttatacttttactttttaaaaaatttgctaaactgaagtaacaaggagttaggaaaataataattacatcaaaataattacaattttagaatagaatgaaatgaaattccagtacataatgtactatactttattatgcctatttaaaacaaagctagagtactcattacaaaagaataagaactataaacttcctaaatcgtcacccaaagtatgtaccttacaatggaatactgcccaggaataaaaataaactaatgatatcaacaaacactatgctaagcacaagaaaccaggcacaaagtacatatcatataatctatttatatgaaattctagaaaaggcaaaacaagaataacaggaagcagatcagcggttatctgggaatccgggtggaattgagaaatatctacaaaggggcacaatgggtgataaagataatctatagctcaattctgtgatggtggtcacatggatatatacatttatcaaaattcactgagctgtacgctttaaatgtgtagattttattgtaagttatagctcaatatagctcaatgaaatttaagatgtaaatgtttttaaaaatgaagccactgccctagcctgagcaatcacattatacttgaagaaacaaaactagaaaagacacagagatgattcattgcggagcttttttcttctcctacaataatctcatgggaatggcatgccctctaactccaaaatcctaaagtagccatttactgaacacctccctaaatgcaaagctgtttgtgctaaactgtaactgtgcagagcatatatacacggacgcacgcacacatacaagacaaggcgaggacgtcaaccaagctgatgccccggcaactacatctgtactcaagtagtcgtactcaactacaactgtatcatggtcctgagaccagaaacatcagcatctcctgaaaatttgttagaaattcaaattcttgggtccctcacaaaactattgaatgagaaactctgaggataaggtccagcaatctgtgcttataaaacccccttcgagtggttcagatgtaagccaaagtttgacaaccaccgctctacttattatgcatgcatttacatttctgagaaattacattttactatgtcttaagaaattattctataatgatagcagcaaatgcaaagattcataaaaatctccagaaatgtccctcatgaatgtttagattatactgtatcttagtaagtcatggaaaagagcccaggctctcaaccatcaccgaaccatctgcaaactatatacacaaaaaagcttgacattgctgagtcctgaatgcctagaacagtttgtccattctgctttttccctttccaccatagaaagttttttacaaggaatttagaaaaaccacatagcacagattaataaaatgtagaaacaaacagaaacatacatttcatcaaagaaatattcatttaagtgtcaaatgcattacattttgaaaaaacttacaaaataaaaccgtgggcttggagatacgaaatatggatgtgtgatgtactactcttattttcatatatgctacttttgattctgcccaaggctacaatgtcaacagcaaatcagaagctttacctgttacttaacctgtgattgcaatacaacttttatcactacataaagtcatttagggccattttgagaggtaggcttgcaatagttacttcaccaaataagttatatgggtggcaaataagcatgagaaagcatgttcaacatcaccaactattacagaaattccgtcaagaccacaatgagatactactacacacctattagaatggctaaaataatcaacaaaaattgacaatgccaagtgctgctgaggatgcagaggaactagaacactcatacagtgctggtggaaatgcaaaatggtagaacaactctggaagacaatctaacaaaaagtaaaacattcacagaaagttaaacacactcttaacaatatgacccagcgatacccctcctggctatttactactgagaaatacaaatttatatatacatacacatcaaggcacaaacattatcatcagctttttgacagtcaaagcttgaaaataacgaaatgtccaccaacaaatgaaggatttaacaaactgtgattcatctaaataatggaatactactcacaagcaaaataaacaactgccgtattttaacaacctggatgaatttcaaagatacaacactgaatgagagaaatcagtctcaaaactttacatgtggtggttcacatgtgtaatcccagcaatttgggaggccaaggggacagaactgcttgaagccaggagtttgagaccatcctgtgcaacatagggagacctcatctctacaaaaagtttttaaaaattagaccagcatggtggcacacacctgtaatctcagctaatctggaggctgaggtgggaagatcactgaagtctagaaggtcgaggcagcagtaagctgtgactgtaccactgcactccagccagggtgacagactgaaacccgggcctcaaaaaaataaaaaactttacatactataggactctatgtatatgacattctcaaaaacaaaaacagctgcaatggagagcagacaagtgattctgagtcatgaaaggatggcagggcagagggtatgaagataaggagtatcagagttttatacacagaggactataaaaggtaatattttaaattcatagaattttataatatgattacttatttcaaaaaaacttaactcctcaaaatatttattcaaaatataaggcacaaaaaagacaatttcagatatacatagttgaaaatattcatcacaagctaacctgcactaaaagaaacattaaagaagtcatttaagcagaaggaaaattgtatcatattaaaacatggatctatataaggaaggaagaacagcagaaatggttgccccatgaataaatacataaaatattttttagtacttaaatcttttgaaaagatcattgagagtgagattagcaaaaatggcagagtaaggacctctaaacatcctctccttcataaaaggcacaagaatgctgacaaaaactgtcaaactcaaatttttaagaactctggaaattaaccaaaggattgcaagaacccttggcagaggcatttaatcaagaaaaaacagatgagtcttggttaggaaaatcaggcattttaacttgtgctattactactcctttctctttagctccacactgaagagaaaaaccaacatcctacaatgatggggttttttttaaagacacccaagaagccacctgaagaatcagaacagggatggaactcatccaaactccacttccccgagaaaatcatcacaatttgacttatctggcatttccctggaaaaactcacacaaagggtactctttttgtgtgtatgtatgttttgttttgttttgttttgagacaagatctcgttctgtcacccatgctggagtgcagtggtgctataacagctcactacagcctccaacctccaggacttaagcaatccttccacctcagcttcctgagtagctgggactacacacagccatgcaccaccacacccagctaatttttgtatttttctgtagagatggtgggggaagggggatctccctatgttgtccaggctggtcttgaactcctgggctcaagtgatccacctacctgagcctcccaaagtgctgggattataagcatgagccacagtgcctgcccctcatcctacttttttttttgcaacagggtctcactctgtcaacccagactggagtgcagtggtgtcataaggactttcttgaccttacttggaaatcacttgcttaaaacagcctcttcacactccccactgcacccacccaccatcactatgtgtgcttgtcaaaaacaatcagaagcaattgtttaaacactataactgcttaaggtggcaataacagaatggggcaaaaaaaaaaaaaaaaaaaaacaccaaacaacttaaaaggaaaagctggtgaataatatgtacaaaggggactctgaaaacatctgaaatattcatgggcatatggaaggccacgagcatgcacagcactgcacatgcccaggatatgtcgatgctcacaaaacacaggagacctgtgttttgaacttgaggttctttgtaagcaggaagtaaaaggtaaggcagagttgacaaccgcttggctgagtactgaaggggtgagtcaacaaacacacagaacctcatagtaaagactggaggccttaacttcaggcatttaaggaaatccaagtctaatcataactaaccactataactgagtacagtttttgatgatctcatgcacaaaaatatagactttacaaaattagttcaaagaagtcatgaaacaaccaaataacggtaagaaaacaaccacaaaccttgggaaaatctcattttgaggtgccacatcattattattatttaaaaatgtctagttttcaccaaaaaattaagagacatgcaaaaaagtacaaaagtatgggcatgggaaaatgaaaaatagcactaaacagcaaccgttcctgataatgcccagatgctggacttactaggcaaagactatcagctttttttttttttttttctctgagacagggtctcactctatcactcaggctggagtgcagtggcaccatcacagctcagtggagcctcaacttcctgagctcaagccatcctcccatctcagccttccaacagtagctgggactacaggtgcataccaacacatccagctaattttcttttccatttttttgtagagacagggtctcacccatgttgcctaggctggtcctgaactcctgggctcaagtgatccactctccttggcctcccaaagtgctgggattacaggcatgagccaccacacctggccaaaatacagaactcttaaatgcacaaaatatatccaccacgaaagaccatgttctgggccataagtctcaataaatttaaaagagttgaagctatacaacacagtgttatttaacctggccaaaatacagaattcttaaatgcacaaaaaatatccaccacgaaagaccatgttctgggccacaagtctcaataactttaagagagttcaagttatacaacacagtgttatctaaccacaaaagaattaaattataaatcaagaacaggggacagaatctcagaggacaggattggggcagagcaagatgtggaacagatccacagatccactgactgctcccccacacacaaaaagacaccaatttaacaactaactacacacacacaaaaagcaccttcatgacaaccaaaaaccagtagggtaaatggaaacagccatcttagactaagatggaagccatgtactgagaatggcagagccacaaagaaggagcccgtgcccatcactgtacaatcaaccagatcagcccaagactgctaccatgtgtattatgacgtgagagaaataagagtctatcttctttaatcccttattgttttgacctttgttacagcaacctaatgtttgtacaaaagggctttcatttcttacttcattcgtttctgcattgtttgttttacagcatgtataattagtttaataacttaaaatatatacataatctatatatatttacctataagatagatataagtagatatatatctatataaagggagagtgaaatccatatttatccatatagtctatacagaggttagatagatacaatgtgcagtgggccaaagatagagacttttagattttggttttctgatacaccaaaatatttcgaattatttataccttcctgagaattaaattcacaaatctttattgagaattggtcatgtgaaagaaactaaagtgacacaagtatgtcattgttttagaaagtactgtattcactcgtgagtagcaaattaatttcaacaaaataccatccatacttttcaagtaatactgttaatctaaagttcactgatttgaagttccgtttgtacttaatttggcaaaatctgttttgctttatagttgtatacaaactttaaggaaaaaaatttaaatacagttttatatttgtacatttttcagtgtctttaaaatttttgtttatatatatttataataaaataattaggtttccaaaaaaaaccagataggatttaaatatttacaaactaaacacaaatctaagcaacccatggttcaaagaagaaatcaggccaggcacagtggctcatgcctgtaatcctagcactttaagaggctgaggtgggtggatcatctgaggtcaagttcaagaccagcctggcctacatggagaaaccccatctctactaaagacacaaaaattagctgggtgtggtggcgcacacctatagtcccagctactcaagaggctgagacaggagaatcgcttgatcccggcaagtggaggttgcagtgagctgagattgtgccactgtactccagcccaggcgacaaagcaagattctgtctcaaagaaaaaaaagggggtgggtgggatctgtctctgctgttctacgtcctccacctcaggagcccctggtgactttgtcacagcctccgttcctctgtgatctccaggtcctgggagatgcacagctaagaagccaggacatcctggaagctgggaaataaccctgaacctgcagcagcaatctggtctctccatcaccctaggcttgtggaccacaaatcacaacctcatccactgcatggacacaggaatatgtcagaacatagccctgcctgggccatcaagctccaaatagtcatccaactaggagcctcggacaacggccacttttgctgggagcccgtagataggcctctaggaagatctgactgctgtttttccaaaacagtgccccgtcagcaggaggcagttaaaattggtcttcatcctcatccttatccttattctaatggcacttagatgcacttctttagaggggagaatgagacaggcaagtaacaaaaggttccaggagaatctccaactgacctgcataccaggaagacagggtgaagacttgtgaagtctatgccatttgcaggggggaggagcctggcctctcctgtttctgtgtgaagacttgggatcaaattagtgaggtgaacagcctgttaggaggacctcatctcactttcctgaattgtttttccttttcattcattaattttactcctcacccttctatgtgtctgcgagcctaatctttcctggtcgtgtgacaagaacccagtattttccgtttttttgagacggagtctcgctctgttgaccagactggagtgcaatggcatgatattggctcactgcaacctttgcctcccgaagaacccggtattttctacaacaatattttatacatttctttctacaatgattatataattatggcttaccagcaggaaacaaaaaaataaagaataagtcacaaaaaaagaaatcaaaagggaaattatcaaatgttttaaactaaataaaaatgaaaacacaatatgtcagaatttgtgggatagcagtacaagcagtacctaggaaagaatttacagcactaaataaatatattagaaaagaatgatctaaaatcaatgacctcagagatcatactaaaaactttaaaagcttgtaattctagcactttgggaagccaaagcaggtggatcgcttgagcctgggagctcaagaccagcctgggcaacatggtaaaactccatctctacaaaaaatacaaaaattagccaggtgtggtggtacatgcctataatcccacctatttgggaggctgaggtgggagaattgcttaagccagggaggttgaggctcccatttatttgcagggttttatggctacagcatattcttcactcattgcacacatgacagacacctgtacatcttcacctgcgttgtattttccttgtatttatttgcctagttcactttctggcagtttaagatcctcaggaacttcatcagcttctgtcggcagggaaaggcaactatcttgaatgcatatcagttgataatcatgtctctgaatatttggaacatccacgttgtgaacagaaggacaaatatcttcttcttctttttttcccatgaaaacagcaattccaacaaggtgaaccttggcatgaccaagttttccagttttggaagttaacatcttcactattttgcatggttgtcctttgaacatcatgaagtcacttttccgcaaggttgagcactgcatagggtgagtgctggaagccccagcatctccagtagttaaatcaatttcgtacaccatggtgagctggggagatggtagtttttccgtgggaactttcagcaggcaaagagctcctttcacctgcgtacctgcacaggtcccctacagctgcagagccggtggcagcggtggcagccacagcagttgccaataagggaatattatataaaactttatgagaataaatatgataacttagattaagcaagtttcttgaaagacacaaactaccaaagcttactaaaaaaaaaaaaacagtaataataataatcacatgaataactctatatctacttttaaaattgaaaccttgtttaaaattctcccataaaaaacaccaggtccagatggtttcattaatgaattccaacactgacagtaaaaaaaaaaaaaaccagttctacacaactcttccaaaaatacgaggagaaaagacttcccaattcatcctatgagacttgataattctatcaatgcaaaagattgaatgcaaaaaaaaaagacattaaagaaaacaatgttaggcatgatggtgcaagatagaatgcaaaaaaaaaaaaaaaaagacattcaggaaaacaatgttaggcatgatggtgcatgcctataatctcaactatttggaaggctgaagcaggagaaccattgaagcccaggagattgagaccagcctgggcaacactgtgggatccactctcaaaaaaaatttttttaatgagaaagaaaacaatgtccctcatgatgtaattcacattaacaaagtttaaaatataatcatctcaataagacacagaaataacacttgacagaatgaattttgacatccattcctgaaaaaaagctctaaacaagctaggaacagaagggatcaagctcaatgtgacagagaatttacaaaaaaccaacagctatcattataacttaatggctaaagactaaatgttttcccctaagatcagaaacgagacaaggatgttgctttcaaccacctctactcaacattatactggagtagccagtgaaatcaagcaagaaaaaaaaaaaaagacatccaaactggaaagtaagaaaaactttttattcacagacatgactgactatatgaaaaatccaatggaatctataaaaaagctgttgcaggggtgggcaggtgtggtgactcatgcctgttatcccagcactttaggaggccaagacaggagaatcacttgagctcaggagttcaggaccagcccgcctaggcaacatagtgagacctcgtctctactaaaaattaaaaaaaaacacagccgagcacagcaacacaggctgatagtgccagctactcaggaggctaacgtgagaggatcactcgagcctggagatcgaggctgcagtgagctatgatgacaccactacactccagcctgggcaatagagggagaccttgtctcaaaaaacaaacaaaaaaaaaaggttaatggcactaatatttaagtctagccaggttgcagaagataaggtcaacgtgtaactatcaactgtatatctatatactagcaacaaacaattgaaaattgtagaacaccatttataataacatcctcaaaaatattgagagataaatcttaccaaagatgtaaaagacctgtacactaataactataaaatactgccaagagaaattaaagaacttaataaaaagttaaacacatacttatcatctgatctagtcattacattgctagatatttactgaagagaaaaaaatgcatatgtctacataaacttgaatgtaatagccaaaaattaaaaacaacccatatatccatcaatgagtgaacagatctaaaaaattgtgatatcccatggaatactattaccttagcaacaaaaaggaatgtattatcgacatatgcaacaacatggataaatctcaaaataattataccaagtgggagaagccaaatataaaagggtacatactatgtggttccatttatataaaatggtagaaaatgcatactaatctacagtgacagaaagcacttaactggtttcccatatatgggtgggctgagaggagcgtgaaagagggattacaaagaggtatgaggaaactctggggataatggatatgttcttgactgtggtggtggtttcatgggtatatacatgtcaaagtttatcatgttatacactttaaatatacgcagtttactgtatttcaattatacctacaaaatatcttttaaaaagacaacaaagtaatattaccttttcctttcaggtctaaaacaaacactatattccctttccttttttttttttttttttaaattggcaagcaaaaaccgcatatatttatggtgtataacatgatgttttcatatatgtctgcagtgtagaatggcaaaatcaacctacttaatgtatgcattacctcacaatacttatcattttttgtaatgagactaattaaaatcttctcttggaaatgttcacgtataggctgggggcgatggctcatgcctgtaatcccagcactttgggaagccaaggcaggtggatcacctgaggttgggagttcaagaccagcctgaccaacatggagaaacccctactctactaaaaatacaaaattagctgggtgtggtggcacatgcctgtaatcccagctactcaggaggccgaggcaggagaatcccttgaacctgggaggcagaggctgcggtgagccgagaccgcaccattgcactccagcctggcaagaagagcaaaattgtctcaaaaaaaaaaaaaaagaaattttcaagtatataatgtattgttacttaccacagtcatcatgaagtacaatagatcccttgaccttattcctcctatataactaaaaaatttgtgtcctacaaccaacatctctccaatcctcacagcctttagtaactaccactttgctctgtttctatgcattcaactttttcaaattccacatataagtgagactgtggagtacttgtccttctgtattatctttccttttgacattggatggtattacttgtaaaacatcccacaactaaacatttttcccatattctctacattattacaagtttcgatgctaggcacagctgttaagcttgcagaaatacaaatatatcagcaaaaatattttcaccaaccatcacaatgcagttagacacgacctgactctgctttctccccttatagggggatatacaatgactacagtcatctctttctttgcatcattaatgacccaaagacattctctttaaaaaaaaaaaattaccactgtcacactcttcaatcttccacaccaccttttttgcgttcccatcttccaggtcctcttggttactaaaaataatgtctacacttctatttagttttacttcatcttctcacatctatcaaatattttttaaagatatgtttaagaataggaacagtatttttctttctttttttttaaattgctgctccttgtagagcagggctacgctgcaggcagtgtgcccagaatagcaagaacagtatttctatagcttctcagccttttggctaagatcaagtacagttatgtttttatagtttaatatctgaaatgtcttctatccaaagacaattttttttttttttgagatggattttcgctcttgttgcccaggctagagtgcaatggcatgatctcagctcaccacaacctctgcctcccaggttcaaacaattctcctgcctcagcctcccgagtagctaggattacaggcatgcaccaccacgcctggctaattttttttgtatttttagtagagacaggtttctccatgttggtcaggctggtctggaactcctgacctcaggtgatccacccacctaggcctcccaaagtgctgggattacaggcatgagccattgcgcccagccctaaatgagtttttggagctgggagatggaacagtatcttgcttgatctactccacacatcgacctggtattgcagtacctccaggaatggtacacccccccacctcaaaggataaaaatcaaaattaaaatcaaaaataagatttctatatatttacctcaagtactggtccagctccaagaataatctgttctactccactggcaaatcctttctgactgagagcagtaaggtggtgaataagaaagtttgtgctttgagtcttcccagaaccactctctcctgaaatcacgatgcactgattctttttgcgctgaagcatggcatgataagctacatcagccacagcataaatgtggggctcaagttttcccagttggtggttatcatacattttgacatatttggggttataaataggaagaaacttgaatgggttaataactattagaatactgccaacataggtataaattttttcatgcttaaagcgatttcgtaggttttctaagagagttttctcattcaaatcaggtaaactacataaatcatcaaagtctttctgttgaggctgtggaagaaaaccccgttccatcatcctgcgacgttcttctgttacccgtagccatgactgcaggctaccataatggattgatccatcaaggtttttctctctcagaaggaagcggtagtcctctccacttaagcgattttccagagccattcggggccacagcatcattcgctgaactggacaatctgttggattgagaatccattcttctccaccaaattcctttacctctgctagaacataacattttgttttgtcaagatgaagtttgtttataagagactcaatcacctcagcagctgtggagttttttctggcaggaatcggacagtagattgtcccttctgaaatagccccaggatatatccgtaatgtatgttcattatcttcaaagcgtcgtcttcctccatcatttatattcatattggatcctgtcccatcagcatggatagtatatgttcaaagtcgtgcaaaccattttcttggtaaaataactgtaacataaaagatgcaaaatatttagaagtaaatacacattgctttctgatgctcaagaaagaaaagcttaacaagcatgttgattacatcttctaaaacacaaaatactaactcttgtcttagcacagcaacagtttcattgagaccacataatattaagtttcactgtccaaatctaggcactttctaaaatagtaacttgccaaaaaaaacatatatttcaatgttttattatacaaaaatccaaagagtacaaagaaaaattatttttcccctgctgtctcaaatgtttgtaaggaacttgggattagaaccaagttctttccttatacttaacaaagactggattaagacagaataaccatgcaaatctaattgccctgtacccaaaatttcttaaggataaagcaaaaacaagaaagcatcccaacaatggagcaaaaattttgtaaaatttgttaaaaacagcaagaagatagataaacatagaaattacataaaaccaagaaaatgatgagagaaaccaactaaggagatagacatatattttcaaggaattctaggctctgactcactccctcccacaaggtgggaaggagaagggagtttggcaagagtgacaaaagaatcctgcccctgacttgctaggcaaatttaacacaattatacaactaggcaccactacaaattttattcagcttccctttttccttcaatgctaccattatatctttttacctaaccttatttattgcattccttacaagtattctgcattttcttcccatcttctcgaacctcgtatacagtatattacacttctagaagaatgatttcaacttttatacctcactgagaaaatagtgatttccttcaaatggcttctccaactcaaaatttattcctatctttacctcatctatcttattccattcctgtcttctactgagaaaatatgccccacacactttccagggctgataaaacctgtttcttatcttcattagttagttatatgcccccaaaaaactactctcatgtgtcatcaatatttaccttatttatttcatcctttaacatataaggatgatgtgctattaaaaaaataataagaagaaatactttcagttacttcctttttttttttttttttttttgagacagggtcttgttctgtcacccaggctagagtacagcggcatgatcttggctcactgcaccctccatcacccgggctcaggtgatcctctcacctcaacctggctgggactacaggtgtgcgccaccttgcctggctaatttttgtatttttagtagagatggggtttcaccatgttgcccagggtactatctatcctctcatactactacatatttgtcaaagtcttctaatcaagaaactattttttcctgtttgcctagatggtctttcaaacacagagattaatacaaaacatataaaaaaaacccagccatataggccaggagtggtggctcatatctgtaatctcaacactttgggaagccaaggcgggcggatcacctgaggtcaggagttcgagatcagcctggccaacatggtgaaaccctgtctgtactaaaaatacaaaattagccaggcatggtggcacgtccctgtaatcccagctactcaggggcctgaggcaggagaatcacttgaacccgggaggcagaggttacagtgagctgaggtcgcacccctacactccagcctgggtgacagaatgagactgtctcaaaaaaaaaaaaaattaaaaaagaaataaactagtgaggaaaggacaaactattcactgtggtactggttcaattgctaatctgagttggagtgaagaaaattaacagtcctatctcatagcatactgaaaatagattccatctatggatctgtacctatcaatctgttctgggctctatagtctgttccataggtctatttttccacccctgaacctctgttaattactacagtcctataataaattttggtatctgaagggcacattaccttaatgtgttgttctttacaaattttaccttggctatttacactaccataaaaatgtttaagtttgcatgtttactatcgtgaaaaaaaaccttttcagattttaatactgcattgactttacagattaatattggacagaactgacatctaattgactcttctcattcatgaacaccatgctgttggcttttaaaaattacaactatatttttcacttctaaagtttttgtcattttcaaatccacctcatcttttttccgccgatttacatttcaaaattatttatacttaagggctattactccttttctttttgaaaaccctcagtatgtaatttaatatttttcagactaacactgaaatgtcatccagacggaactgctcttatggttatttcatatcttccttagcatgagatgagttcatatatttgagaatttagctttacaagtgcacttttgatggaacttcttttgtttttcatacaaacacttactgagaacatgtttactacttttttaagagaactacagtatcataaatatatttttaaaaattaaaaattttggtattaaatgatcaattgatattcaaatttccaaatttcctcagttatctcataaatatttttcttacagatagtctagctggagattctgctctgcaataacagtgaggatatactctgagttaccaggttcctagttgtatagctatgtttgctttcctgaatccctaagtgtttgcttcatatacgctatggcatctggcagcagtcagcagcaaatcttcttacagccagggaggctgtgacctgtaccactccaggagatgtactaagttaaggggtccccaacctctgggccatggaccagtgccagtccatggcctgtcagaaactgggccgcacagcagaagatgagcagcaggcaagtaagcattactgcctgggctctgcctcctgtcagatcgtcagcagcatgagattgtcatagaagcattaagcactattgtgaactgcatatgcaagggatctaaactgcatgctccttatgagaatctaactaatgccagagaatctaactaatcatctaatacctgatgatctgaggcagaatagtttcatcccaaaaccatcccctactaccccatctgtggaaaaattttcatctatgaaaccagtccctggtgccaaaaaggttaaagaccactgtactaagtaactacaatctaatccctaaagttgtataatatggcagccctggaagtaaacttagaaacatcttttttaacaggagtcctatcttggaccactgtttccaacaataagcccaactctaattacacttccccattacttcaaagcagccaaaatcacacctgctccttcctgaaacagaagtgtttaccttttttgagtcctagttttgtcagtttggttttatctttgttattttatcaattactgctttgtgggtttttttgttttgtttttttttttacaaaaaggagggtttgtctcaaaataccactcagaaatccatcttgatcacaagccagtccttactaaacagcttggaaaatctgtacttgcaaatccgagacatgagctttcatcaaaatcatctggggagctttttcaaaacgtacattaccagccgggtgcggtggctcacacctgtaatcccagcactttgggaggccgaggcggatagatcacgaggtcaggagatcaggaccatcctggctaacatggtgaaaccccatctctactgaaaatacaaaaattagccaggcatggtggtgggcacctgcagccccagctactccggaggctgaggcaggagaatggcgtggaccctggaggcagagcttgcagtgagccaagatcatgccactgcactccagcctgggtgacagagcaagactccgtctctaaataaataaataaataaataaacaaacaaacaaacaaaatttttttttaaatgtacattaccaggctcaacaatagttatgagttgaggaaatgcaggtaattctgttattgctggtccagaaaatagtatttgaaaatcaccatattcccaaatatttgggaactcactttctactcccttaccactcttcccacatagcaagctacttgacaatgctccggagaagtcacaaaattccacagagttggtaatccaaaggtctttcctcattcttcattttaacacaccacactatggcatgactaaagcagccaatttctagttcttgaaagtgtactcacatagttatttttcttgtagtcttcctgatagtcttgctctttttctgactcactcctacagctccttttccattaactcactttattttgttgttgttttgttttgtttttgtatttgtttttgttttatagagccagggtctgtctctgtcatgcaggctggagtacaatggcacaatcatggctcactgcagcctcaaccttctggactcaagtgatcctcctgcctcagtctcccgagtagctgggactgtaagtgcatgccaccgatggcagcagcggcccatctatagcggccactgccatgataccagctgcagtgggggaggtgcagccaggactgcgtgctccatggaggcagcagaagccaggaacaggtgggaaccctgccaccttctgagttgacagggcaggagtttcgtgctccctaggtgcagctgcggccacctgcccaggtgggctgcagacccaggcatcactgtgctcttgggggatgggagcaggcaggagccccaccctcccaggcacagctgcagccgcccaagctgcagctgcagacccaggcatgtctgcactctcagaggcccaggaaggccccccgcccagtccctgcaggctcagaggtgtttgctcccactgcctggcctctcctcactcccagcacccactccaatctcagagaaaggttgggtccgagactgggcactgtcacagcctggccaagtgtgcacacgctccagatagcactgatacaccagccccctgccaccttggccccctctaaactttgggtgcctacaaacactagagggaggctgagggggtactgagggcagctcagtacctgtaggcaccccctgtcacaaacagcctgggcaccatgaacagcaggaggaggcaggcaggctcctgggcaaaaggaggcaggtccctggtgaaaccccaccttcaagccagggaaggcctgaagcctggggaccaggctttccattggcacccgatgaccagagtgggaacttgtggtgctttctccaggctcacccatggttgtcaatgaaccaatcagtacacacaccctccctgctgagacctataaaagcctgaactcagccagacttggggagacaaccacctgccagttgcagagaaaaggtgcccaccccagggtctcctctctgccgggagttgagaagatgatgggacaaccagctgcagggagaagctacccaccccagggtctcctctgctgaaagctgaagagatatccaactaccagctgcagtgaggagctacccactccacggtctccactctgctgacagctgaacactcatcaggacacccgaacactcatcaggacaccctggctgcagagaggagctacccactgcgagtctcctctgagctattctatcactcgataaagctccccttcaccttgctcaccttccacttgtccgtgtacctcgttcttcctgggtacagaacaagaactcaggacctgccgaatggcaggactaaaagagctataacacaaacagggctgaaatacgccccttgttcgtcccattgtaggcaacagaaggagagaagagagaaggagaaaagagctaaggcccttcatggagtccagacctgggggctccccaagccagggctctgacaccctctttggggctctacggttcctggcatcttcaagcttccgagcaccactgcattccccagtgccagccatggaagctgcttgaggtatgcctgatccacagccttgcaaggaagccagcgcctatgccagcacccggagctgcctgccccgctgcagccagcatgctcggttgtgtagagtggccaaactcctcactcactcacacaccctcctttggtaggtgtgggatccaggctggtagtgcaagccaaacacagcctgccattcagagtgatcagaataagcccagcaggcccaagaaaaactcaggcagaggcgccagtggccacagacgtttccagcctgaaaagtatcaccccaagaagtatcaccccatagcaagatggaatgctgcccaggccggtccacaaagccaaaaacttttactatatgctcctttacaggaaaattctgctgacggttgttctagggtagccactaaaaaagacttttttttaggctgggcctggtggctcacgcctataatcccagcactttgggaggccaaggcaggcggatcacttaaggtcaggagatcgagaccagcctggccaacatggtgaaaccctgtccctattaaaagtacaaaaaaaaaaattagccaagcagggtgctgcgtgcctgtaatcccagctactcaggacactgaggcaggagaatcgcttgaactcaggaggcgcaggttgcagtaagccaagatcacaccactgcactccagcctgggcaactgagtgagactccgtctcaaagaaaaaaaaaaaggttttttaagtgtaactttccatgtggcacatatacaccacggaatactatgcagccataaaaaagaatgagataatgtcctttatagcaatatggatggagctggaggccattatcctaagcaaactaacgcaagaacagaaaaccaaacaccacacttataaatggaagctaaaaactgagtagacatgaacacaaagaagggagcaatagacacaagagcctacttgagggtgaagggtggaaggaaggcgaggatcgaaaaactacctatcgggtactgctgtgcttattacctgggtaacaaaataatctgtacaccaaacccctgaaacacacaatttatctaaagaaccaacctgtacatgtactcctgaaactaaaagttaaaaataattatgtataacttttcaactagtagagtgaaaaaacagaataatgagttcaaaagaaagcaagaaaggagaagagaaaaaagtcagaataggtagatcaaatagaaaacaaatagtaaagttttaaagctaaatacaacagtaattatattatattacatgtaaatgctccagttaaaagacaaagatggtcaaagttttaaaattcaactatctgctgttttcagtagacacacatctataacataaggatacagaatcagaaagtatttttttaaaaggagaagaaataccatgcaaacactagccaaaagaaagctggtataatcaaaataacatcaagcaaaacaggaaaataaaattgaattaaacatctcttaagggttttttttagcccttccatactattattttaggcttaggcctgagagaaaggtctctggatatcactggtattcttgaaaagaagtacaaaacagaaaaagattacaagaagttaaggaggaagccacagagtggcaagtaagtagctagcagatgttgatcgaatctgctacaaagaaagcaggagtagggccaggcgcagtggttcacatctgtaatcccagcactctggggggccgaggcgggcgaatcacaaggtcaggagttcgaggccagcctggccaagatggtgaaaccccacctctactaaaaatacaaaaattagccaggcatggtggtgtccgcctgtagtaccagctgcttgggaggctgaagcaggagaatcacttgaacccaggaggcagacgttgaagtgagtaaagtgagtagagatcgtgccactgcactccagcctggagacacagcgagactctgtctcaaaaaaaaaaaaaaaaaaaaaaaaagcaggagtattgtgagtgaaatgtttattagttagggggcttgggaacacaactgtatgattataaataagatcaagcaaggaagcagaaactaaaaactgaagaaaaagaaggtctaactggtaagccaaagttccttggtaagcaagactaaatgagattaaggtcaaaggtggacagatgtctctcagaaaggaaaaaaaaaggacacttttactgaaagaattaaaaaaaaaaaagatgggcagagaaacagaatttgagataagatgtgacgagactgtatatcagctaatcattactagaaagaatataaaagcccaagttttacctatagcagatcaacgtcaagtaaaagcaaaagtgggtgctgaaagaaaacatattttgtaccatttcagttgaagaaaatgtaatggaagaaataaattatcaggctgggcacagtggtgcgtgcccatagtcatagctatttgaaaggctgaggtgggaggactgcttgagcacaggagttcaagaccagcccgggcaatataccaagaccccatctctaaataaataaaatgttaatagttggcaggccacatgtagaatgaaaacctctcaccttatacaaaaatcaactcaaaatggatcaaggacttaaatctaagacctgaataaaaattctacaagataatgtcagaaaaaccctcccaggccttggcttaggcaaagactttatgaccaagaacccaaaagcaaatgcaacaaaaacaaagatgaataaatgggacttaattaaagagcctttgcacagaaaaagaaaaaatcagcaaaaagacaacccacagagtgtaagaaaatcttcacaatgtgtatatccaataaaggactaatatccagaatctacaaggaactcaaacaaattagcaagaaaaaaacaaacaatcccatcaaaaagtaggctaaggacatgaatagacatctcaaaagaagatacacaaaaggtcaacaaacatgaaaaaatgctcaacagcattaatgatgagggaaatgcaaaacaaaataacaatgtgataccaccttactcctgcaagaatggccataaaaaaaatcaaaaaaataatagatgctggcagggatgtggtgaaaagagaacacactttgacactgatggtaggaatgtaaaatacattcactatatgtaaaatacaaccactataaaaaacagcatggagattccttaaagaactaaaagtagggcaggtgcggtggctcacgcctataatcccagcactttaggaggccaaggcaggtggatcacctgaggtcaggagttcgagaccaccctgaccaacatggcgaaaccccatccctaataaaaatgtaaaaattagctgggcatggtggcacgggcctgtagccccaactactcaggaggctgaggcacaagaatcacttgaacccgggaggcaaaggttgtagtgagcccaaattatgccactgtgctccaacctgcacaacagggtatcacccagttgccactactgagtacctacccagagaaaaagaagtcatttatacaaaaaaagatactcccacaggcatgtttatagcagcacaattcacaactgcaaaaatatagaaccagcccaaatgcccatcaatcaatgagtggataaagaaattgtggtcaatatacaccatggaatactactcagccataaaaaggaacaaaataatggcattcacagtgacctggatggaactggagaccattaatctaagtgaagtaactcaggaatgcaaaaccaaacatcgtatgttctcgctcataagcaggagctaagctatgaggattcaaaggtgtaagaatgacacagtgaactttggggacttgggggaaaaggtgggaggtgggtgagggataacaaattgggtatagtgtatactgctcaggcgatgggtgcaccaaaatctcagaaatcaccactaaagaacttactcagctgggcgcagtggctcacgcctgttaatcccagtactttgggaggtcgaggcaggcagatcacctgaggtcaggagttcaagaccagcctggccaacatggcaaaactccgtctctactaaaaatacaaaaatggctgggcacagtggctcacacctgtaatccctgcactttgggaggctgaggcgggcggatcacctgaggtcagaagttcaagaccagcctagccaacatggtgaaacgctgtctttactaaaagtacaaaaattagccaggcatggtgggtgcctataatcccagctactcaggaggccgaggcaggagaattgcttgaacctgggaggcggaggttgcagtgagccgagattgcaccaccgtactccagcctgggtgacaagagcaagactctgtctcaggaaaaaaaaaaaattagccaggtgtggtggcacatgcctgtaatctcagctatttgggaggctgaggcagaatcgcttgaacccgggaggcggaggttgcagtgagcagagatcacaccactgaactccagccttgacgagagagcaagactccatctcaaaaataaaaattaaaaataaaaaaaacttactcatgcaaccaagcatcacttgttccccaaaaaactatgaaaataaaaaataaaacataacgtgaattattgtatgacacactagtatatgtgtatcagcttagcctgaccagtaagtactctgtaccttcttcaaaattactgttttcctttgaaaaactatttctcctccttgtcattccatctttgtcatcgaacatagtttgaatgaactgacctcattccccagataagggagaagagagacatttgctgtgacccaggcccagtcaatcaatttatttcattactcttagccacagtggctgactactgagattctgtactggaatttttgctgcaactgtcggaaaagaagctttcttcccacaccagggccgctaagctagaaagatctaaacctacagctgctggcagccatattccctgaatgcataaaagaaggctctgcaataaaagaaaatgaaactaacacacacagcaaaatcttatcaacatatttgagccactgaatccagttgtgcctcaaataagctagaccactgaaattccttgttaagtgtgccaatcaattcccttttattccctgagccactctgaggtaggtttctgttctctacaatcaaaagaacccattataatgggtagtatttcagtgcaataccctttgaggatacaggtcgcccttgttatccaaattcctgatttcaaaaaatctcacaacctaaactcaagaaccaaatacgtttgagtaaacttctggaatttccttcattatcttgttatttgctatgcaaactttaggaaacaaacagattcaaataaggcagtaccccctgacattcaaattcactatccaaactgaagaattaagcaaacatgaatagtgggagatagctgtaaagtcaaccatgcagaaatatggaaaagaatttataacgtaaaatttttaaatctagaaaattgcacataaaggtatacatatattttaaaatgggttaaaacactgggcttttgggaaatcttcacattttccatctatagttataatcaaaaataagtttgatatacattacctaatttgagttgaacagcaattcttagacaaaaataaactattacctttcaaatcagaaaatcaagacctaaagagcaaaaaaaactatgaaaatatacgataaagatgacatttcaagtcagcagagaaaaaacgattactaaataaatgatgtggggatagctgaccataagaataaaacaatacacgtaaagaactaagcacattactggcatttatatagcaatcagacaatgctgtatcttttatatagaaaattatttaatattctttttattctctatctcaatgtagacacttcaaaagtatatgctaacagtatatgctaacgaggtaagaaagttgctgtggtttagcagggtgtggttcagaataggccagcttatgatgttattcactggactgagttagaagggactaattacagaggaaaactgtggtgaagaaagaaaacagggaataaagagtttcctttaaactagaagttcagttaaagaaattaaaaagtacctaaggatttttaatgcagtgttctgtgcagtgttctgcagtgtgttattaaaatttacttttcaaaatatatacattaattttgtttttgcttttttatcaaaaactttgattctgctttagaagttttacataaattaaaatctttatcaaatgttaatatgaagggaggcacaggatgcaacatatatagtcaagttacctctctgtatatttagaaattactttctcctccaaggtatttgcaacagaaagctctgtctgtcctgcttaataatcagtagtacaggttggaatcaaagttcctcttggggaaatggcaagtctttaggacaggcgagaccctgtatgaatagtaccaaagcattactgcatggtagagaacacactcaattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcactgaaaatctgcacaattcagtttcagctctggattacttcagttgacctttgtgaaggtttttatctgtgtagaatgggtgtttgacttgttttagcctattacgtttttattttctttcactctgtattaaaagtaaaacttactaaaagaaaagaggtttgtgttcacattaaatggttttggattggctttttttagtgaggctttctgaacattgagatatcctgaacttagagctcttcaatcctaagattttcatgaaaagcctctcacttgaacccaaaccagagtactcttactgcctcttttctaaatgttcaggaaaagcatcgtcagttcagtcttttcagaatgagggagaaacatttgcctgccttgtaataacaagactcagcgcttatttttttaaactgcattttaaaaattggatagtataataacaataaggagtaagccaccttttataggcaccctgtagttttatagttcttaatccaaacattttatatttccttcttttggaaaaaacctacatgctacaagccaccatatgcacagactatacagtgagttgagttgcctctcccacagtctttgaggcgaattacaaaagtccagccattatcatcttcctgagttattattttgaactgatttttttgtacattttggctgcagtattggtggtagaatatactataatatggatcatctctacttctgtatttatttatttattactagacctcaaccacagtcttctttttccccttccactgtcttctttttccccttccacctctctttgcctgtaagatgtactgtatgtagtcatgcactttgtattaatatattagaaatctacagatctgttttgtactttttatactgttggatacttataatcaaaacttttactagggtattgaataaatctagtcttattagaaaataaaaaataaaaataaaaaataaataaaaaataaaagagccactggtgagggtaggaaagacagtcttgaactgccaacaccaccctatcctctagcagcagccatgttgtccagagacagaatctgtgtacctgtgggagagatagcacagagattgtgggactttgcattgaaactcagtgctgccccgtcacaggagaaagcagcacagggcagaattcagccggcatctatggagggagcatttagacgagccctaatcagagaggaattgtccatcccagtggttggaacctgagttctggctagccctaccatggcaagctaaagtactctgggatcatacataaacttagaaggcagtctaggccactaggacttcaattcctgggcaagtcttggtgttgtgtgcacttggaatcagtggacttgaggtgcacatgacccagtgagacaccagctagggcagcccaaacagtgcttgcattacccctcccccagcaccaggcagcacagcttgtagctccaggagaacctccttctgcttaaggagaggaaagagtcacgttgtcttacaacttggatatcagctcagccacaatacagtaaagcaccaagcacagtcctgatgcccccattccaggctctacatcccagataacattcctagacacaccctgaaccagaaaggaaccagctgctatgaaaggaaagacccagtcctggcaggatttatcaactgctgcctaaagggtccttggaccttgaaaaaacttcagtagccagcagtggccaggcagtactcgccatgggccttgggagagacccagtaccatgctaacttcagatgtaacccagtgcactcccagctgtggtggccaccgtgagagactccttctgcctgagaaaggagagagaagagcaaaaatgactttgccttgcaacttgggtatcaactcagctacagtaaaataaagtactaagcaaactcttaaagtccctgattttaggccttagctcatggacagcatttccagacccaccctgggccagaagggaacccattgctctgaagagagacccaagcctggcaggattcaccacaagctggctcaacagccttcaggccttgaaaaaacatcagtggtaagtaggcagtactcaccacaggcctggggaggtggtagccacagggagagactccttctgcctacggaaagaagaggaaagagtaaaaaggactctgtcctacaacttaggcaccagctcagccacagaaaaataaagcaccaaggagattcctaaagttcccaactccaggccctagctcccagccagcatttccagactcaccctgggccagaagggaacctatctccctgaagagaagcacaggagcctgtctgaattcactacccactgactaaagcaccctaggacactcaacaaacatcaatagtagccaggcaatagtcaccacaggccttgggcaggaccccgttttgtgcagacttcaggtctgacccagcacagtccaagaggtggtggtcacggcggtgcttgggtcacacctccccaattccaggcagctcagcaaggagatacagactccactagtttgaggaaaagtaagggaagagaacaagagattctgcctggtaatacagagaattctgccagaactaacccagaccaccaaggcagtacctctacgagtctgcaaaagccacagtgttactggggcttggggtgtaccctaatgaagagacagctacaataaccaaagacagatcataatactcaatccactttgaatacttgaaaaccttctaaaggaggacaggtacaaaaaagcccagacagcaaaggttacaacaaatacctaactcttcaatgcccagacaccaacgaacacccacaggcatcaagaccatccaggaaaacatgacctcaccaaacaaactaaataaggcagcagtgagcaaacctagacagagatatgtgacctttcagagaattcaagatacttgttttcaggaaactcaacaaaactcaagataacacagaaggaattcagaatcctatcagataaacttaacaaagactaaaataatttttagaaatcaaacagaaatttgggagctgaaaaattcaactgacaatctgaagaatgcatcagagtctctcaacagcagaattggtcaagcaggagaaacaattaatgagcttgaagacaggctacttgaaaatacacagaggaagacaaaagaaaaaagaataacataagaataaagcctacaagatctagaaaatagcctcaaaagggcaaatctaagagttattgaggctgggtgctttatcacacctgtaatcccagcaatttgggaggccaaggtggaaggattacttgggcccaggagttcaagacagccaggacaacatagagagatcccatctctacaagataaatattttttaattaactggatgtggtggcacaagcttgtggtcccagctactaaggaggctgagatgggaggatcacttgaacccaacaggtcaaggctgcaatgagccgtgatcgtgccactgcactccagcctggatgacagagcgagatcccatctatggagctatagtaaccaaaacagcataacaacagacgaatgaaacagaatggagaacccagaaatgaatccatacatctatagtgaattcatttttgacaaaggtgctaagaacacacactggggaaaagacattctcttcaataaatggtgcttggaaaactggacatccatatgcagaagggagaaactagacccctatctctcaccatatacaaaaatcaaaattagaatggattaaagatctaaatctaggacctgaaactctcaaaccactgaaagaaaacattggagatctctctaggacattagtctgggcaaagatttgttgagtaataccccaaaagcacaggaaaccaaagcaaaaatggacaaataggattacatcaagtcaaaaagcttctgcatagcaaaggcaacaatcagcaaagtgaacagacaactcacagaatgggagaaaatatgtgcaaactgtctatctgacaagggattaataagaatatataaggagttcaaacaactcaataggaaaaaaatctaaaaatctgattttaaaatgggcaaaagactggaatagacaatgagatattatcttatcacagttaaaaagcttttatccaagacagacaacaacaaatgctggcaaggatgtaaagaaaaggtaacacttgtacaccgttggtgagaatgtaaattaatacagccactataaaaacagtttggaggttcctcaaaaaactaaaaacagaactactatatgatcaagcaaattaactgctaggtatatacccaaaagaacggaaatcagtatatcaaagtggtatctgcactcccgtgtttactgcagcactattcgcaatcaccaagatttggaatcaacctaactgtccatcaacagacaaatggataaagaaaatgtgatgcatataatacaatgaagtagtattcagccagccataaaaaaagaatgagatcccatcatttgcaacaacatggatggaactggaggatactatgttaagcaaaataagccaggcacaaaaagacaaactttgcattatctcattcatttgtgggagctaaaaattaaaataatttggactcatgaaaataaagagtagagtgatggttatcagaggctgggaagagtagtaaaggggcggaggaaagtggggatggttaatgggtataaaaatatagttagaatgaataagatgtagtatttgacggcacaaaagggtgactacggtcaacaataatttattttacatttaaaaataactaaaagaagtataattggaatgtttgtaacacaaagaaatgataaatgcttggggtgatggataccccatttgccctaatgtgattattatacaccgtatgcttgtcaaaatatctcaagtaccccataaatatatacaactactatgtatccataaaaattaaagttttaaaaagcatagatggggcagagaagaagggattgactgaaacaagagggaactctctggagttaacggaaacgttacacttatttttggtggtaattacaccagtgtataccatttcaaaactcatactgaacatttatgatctgtgcattttattgtatgttgtttctcagttaaaatgaattttaaaaagataccgccacacatctaagaataaaacaaaatatacgtaaggtcgcaagaagacctaaatacatggaaaaatatactatatccaataatttgacttctgtatcattaagaagccaactctccctcaaaatgatctacagattcagcacaattccaaacaaaatactagtaggttctgaacaaattaacaagctgattctcaatgtgtatttgaaatctaatggacctagaatagccaagacaatcttaaagaataacaaagttggaggacttatactaccaaatatcaagacttagtacaaagccacaaaaagtatagtacttggtacaaggagagacacaagagaatccagaaacaggctcctatacaatgatgttctaacttaaaacaaagatgccactgcaattcagtatgggggaaggaaaggcttctatgtcaatggtgctgcaccaactggattgtctagaaaaattaattcatggacaaaaattactttatgatggatcatagaccatgaaaggtaataaaattaacatttctagaatagatcaaatgagaatatttacatgagccaggcacggtggctcatgcctgtaatcccagcactttgggaggccgaggcaggcagaacacctgaggtcgggagttcaagaacagcctgaccaacatggagaaactctgtctctactaaaactacaaaataagccaggagtggtggcgcatacctgtaatcccagctacttgggaggctgaggcaggagaatggcttgaacccgggaggcggaggttgcagtgagctgagatcacgccactgcactccaccctgggcaacaagagcaaaactccgtctcaaaaaaaaaaaaaaaaagaatatttacatgaacctagagtgggatctcgaacaacaacaacaacaaaaaaaacacactaggtactaaccataaaaaataataaatttgactttattaaaattaagaacttctattcaattaaaaaaatcattgagagtaaaaaggcacagaagatacctgcaatacacatatcaaaaaaaagacttatatccagatttttgtaaaaacagctaaaaaataagaaaactgcccaatctttttaatgagcaaaagacttaaacagattattatgaggatatataaaaggccaatatggatataaaaaataaaattcaacatctgtagtagctcattgttcaaaaatattcacttcttatccttacatgcattgaagacttatacttccgcaaccatgaattttggctacaccacaacttagtttaaggagtggaaggtcagcagacatgacataaacacgtcttgaaatatgcttgaacaactggatatgacttcttgcatttatgttaccactatgaaaagaacatgtcccatctggcctactggtgcacataagaagatgagatacacacagcagagctgtcccagctgacccacaaatccttaaccaagaaacaaatacttgagtaccactggagattttcaggttaagcagtaatagctgactaatacaggccaagtgtggtggctcacgcctgtaatcccagcactttgtgaggccaaagcgggtggatcacgaggtcaagagatcaagaccatcctagccaacatggtgaaacccgcctctactaaaactacaataattagccgggcgtggtggtgcgtgcctctagtctcagctactcaggaggctgaggcaggggaatcgcttgaacccgggtggtggaggttgcagtgagcagagatcacaccactgcactccagcctggcaacagagtgagacttggtctcaaaaaaaaaaaaaaagaaagaaagaaagaaaaaagccagataaaagagtacaaactaaattatcccatttatatgaagttcacaaacagacaacataaatctatggatacagacaccagaagcatggtttccttagcggagaggaagttatataggcagggcacaaaaggaaggccttacaaagttttataaacattctatatcttaatatgggtggtggataaccggtatatacatatgtaagaaatttttaactgtaaatactgaagatttatgcactttattgtatgttacatgggaactgcttgaacccgggaggcagaggttgcagtgagctgaggttgcaccattgctctccagcctgggcaacaaacagcaaaactccgtctcaaaaaaaagaaaacaacaaattagttatttgtggtaaaaaggaatctgagggaaaaaaagaaataaaagagattggttatttgaagttaaactggtattccatataataaatgtattattatactgcaatcattacattatatattacaatatataatcatatattaatacattatataatatataggtaatcattagcaatattgataattatatattacataatataatcttatatgatataatctattaactatattaattacataaatttatattataatctaatatacttattaaatatattaatattattactatataaattaagactgtctcaacattatattttaccataatcactaaatacctgagaaaagtacaaatattagcatctggtttaaatattattcccaatactaattaattaatttatttcattttattttatttttgagacagtctcactctgctgcccaggctggagtccagtggcgcagtatcgactcactgtaacctccgcctcagcctcccgagcagctgggattacaggtgcctgcccacacctggctaattttctgtatttttagtagagacggggtttcaccatgctgaccaggctggtctcaaactcctgacctcgtgatccacccgcctcagcctcccaaaacgctaggattacaggcgtgagccaccatgcccagcctccaatatttatttttaaaatattacactatttaaacagtttcaaaataaactaaccttttgcccttctactgggacgccacatggagactagactataaccaaaacatgaatcttaaataacttaaaatctctccctccacaagacatatttctattgtttgcaaaatgagattttattttcttgataaaacagtgtaatataaagtacttagaaagcttctgtgcttttatccatttaagtaatacaattccagaagcttcaaatgtttactcattctattaaaaatcttttaaggctataaaaaaaaattcatattgttttactctgcaaatcttctactctgtagaaaccccctcaagtttactcataagaacaacacaaagcagagtttaacagaataactaaaaaccttagaattcttagtgaaaatacataaaaactattagtaattataaatgattttcttttctaagtcatttattctgagatttccttttactagtttaacatacttgcctataggactatcaaatcgcccttcgacagtccttatagaaaataagaatatttccaacagctttctcactaggcttccattctctacataaagatattaagtaaacatgcatctagtgagtcctatgagataaagaatgtcctacacctaagcagtacttctctgaaattctgtaatatttattttactaatttttttaaaaaaagctttattgagaatatatagttggacactgtgctgtgtgctttatatgtattacttcatttaataagaaatatgtgatattatacccatttctagatttaaaaaactaatgccatagatgtgatgttcccaagatactacaactactatgttgatgattacaaactagatcccaatttctcttttttttttttttcctttttgggacagggtctcattctgttgcccatggctcactgcagccttgatcttcctggctcaagccatcctcccacctcagccccccaggtagctgggactacaagtgacagccatcatgcctggttaattttttttatttttatttttatttttgcagagacagggtctccctatgttgcccaggctagtcttgaagcctgggatcaagtgatcctcccaccttggccccacaaagtgctgggattacaggtaagagccaccatacccagccatatcccaatttctttaccaatatgctactcttagcacaaataagaaccatggcaataattaatgataatgaataactgcatcaaacactcatacagcatttactgtatgttttaatcattccatcctcataacaaccctaaggaaaggcacactattatgtcttattttacagatcaagaaactgaagtacatagactttgccacttgtctaaggttacaggccagtacatggcagagctaggatgtgcacatcagcagtccagccctagaatctgggagctaaaccactatgccactttgcctttcacaaactgccttatactgcctcatagctgataaggtatatatcatatctcctttatgaactcacaagctcttaggtagcaaagaccaagacttctaacctaatcagcattagacttttgccagcatagggactggtaaataataaaaagaaactagaaggtgcactgaggtcctaaggaaagcttctttgtagtagtgactcttgaggttaaccttgccactgaactctacaattgtatatgtaattgtttagtgcatatttgatagtctcccctactagtatataggcttgttaagggtagaatatttttttgtctttccatctgctatacaacattcaaaaataaataaaataaataataaaataataaaaattcaaaatgtttgttgaataaatatgtgaaaaactttattacagagggttatacttcacaatccctactatcaacagaatcaatacaagatctctagataagagattcacagcaattaaataatttgtgacaaaccacttatcaggttatggaagcagacaggagaatagaaaaagatagtgatagaaggtagaaacatgtattacttaaacccaacagtaaatataggagcaaagtaaacagtgactcttttttctcctttaatttgcatactcatgaatttttatccctccttcattttctttcagaatacccttcagttgagtacctcttctgactttcaattagaatgggggggtggggcgcagggccgggggaggctggtgtggtggctcacgcctgtaatcccagcactttgggaggctgaggtgggtggactgcctgaactcaggagttcgcaaccagcctaggcaacacggtgaaaccctgtctccactaaaaatacaaaaaaaaaaaaattagctgggcatggtggcggcatgcacctgtagtccctgctactcaggaggctgaggcaggggaatcacttgaacccgggaggcagaggttgcagtgagccgagatatctccactgcactccaacctgggtgacacagtgagactatgtctcaaaaaaaaaaaaaaaaaaaagaatgaacgtaggcccagcgaggtggctcatgcctgtaatcccagcactttgggaggccgaggcagatggatcacctgaggccacgagttcgagaccagcctggccaacatggtgaaaccccatccctactaaaactacaaaaaaaaaacaaaaaactacccagatgtggtggcacacgcctgcagtcccagctactcgggaggctgaggcaggagaatcacttgaaccggaaggcagaggttgcagtgagcagagattgtgccactgtactctggcctgggcaacagattgagactctgcctcaaaaaaaaaaaaaaaagaatgaggggcaggcctcaatctacgggttaatccacttatgagctctacaaatatctgcacattttggaggccttgttgacaatatagatatactcaatgacacaataaaatactgagacttaggcaggagaattgcttgaacccaggaggtggaggctgcggtgaaccaaaaccgcgccactgcactccagctgggcaacaaagtaagattccatctcaaaaaagaaaaaaagacacagtaatcaatggaacagaatagagaacccagaaacaaagccacatacctacaaccaactgatcttcaataaagttgacaataataaacaatggggagatgacaccctattcaataaatgctgctggaaatactggctacccatatgcagaagaataaaactggacccctacctctcaccatatacaaaaattaactcaagatggattaagcacttaaatgtaagacctcaaactatagaaatcctaggaggaaactagaaaaaaaattcatctgaacatttgcctaggcaaagaatttatgactaagacctcaaaagaaactgcaataaaaccaaaaactgacaatcaggcttaaactaaagaacttctgcatagcaaaataaaaatatccacagagtaaacagacaacctacaaaatggtagaaaatatatgcaaactatgcatctgacaagagactagcacctggaatctataaggaacttaaatcaacaagaaaaaacaaaccatctcattaaaaggtgggcaaaggacaggaacggcacttctcaaaagatgacatacaagcagccaacaaatatgaaaaaaatgctcagcatcactaatcatcagggaaatgcaaattaaaaccacagagatatcatctcacaccagtcagaatggctattattaaaaagtcaaaaaaataagagatgttggcaagtatgtggaacaaaagggaacactcacacatttggtagaaatataaattagggtcaggcgcagtggctcacgcctgtaatcccagcactttggcaggccaaggcaggtggatcacttgagatcaggagttcaagactagcctggccaacatggtgaaaccccgtctctaccaaatatacaaaaattagccaggcatggtagcacacggctgtaatccccggttacagaggcaggttacagaggaggctgaggcaggaaaattgcttaagccgaggagacagaggctgcagtgagccatgatcccaccactgcactccagcctgggcgacacagcgagactccatctcaaaaaaaataaaaataaaaaagaaatgtcagttagtttaacccctatggtaaacagtatggagatttctcaaagaactaaaaattaaactaccatttgacccagcaatcccactactgagtatctacccaaaggaaaataaatttttctatcaaaaagatacctgcttagccaggtgtggcggtatatgcctgtagtcccagctattcggaaggctggggtgggaggatcacttgagctcaggaggcagagaggttgcagtgagccaaaatcataccactgcactccagcctggggtgacagagtgagagcccatgtcaaaaaaaaaaaaaaaaagtatatataatatacataaaagagaaaaaagatacctacattctttttcttttttttttggagacggagtcttgctctgtcacccaggctggggtgcagtgccgtgatctcagctcactgcaagctccgcctcccaggttcatgccattctcctgcctcagcctccagagcagctgggactacaggcgcccgccaccacgcctggctaattttttgtatttttagtagagacggggtttcaccgtgttagccgggatggtctcgatctcctgacctcgtgatccacccgcctcggcctcccaaagtgctgggattacaggcgtgaaccacagcgtccagccaaaagatacctacactcttatgtttatcacagcactattcacaatagcaaagttatggaatcaatcatcaatgtaagtgcccatcaatggcagattgagtaaagaaaatgtgatacatacacaaaatagaatatcacactaccataaaaaataatgaaatcatgtcctttgcagcaatatgaatgcagctggaggccattatcctaagtgaattaatgcagaaacaaaatgaaataccaaatattctcacttttaagtgggagctaagtagcgggtatagatggacataaggatgaaacactggggactccaaggagtgtgaggaggggaggagggaaagtctgaaaaactacctattgggtattatgttcactatttgggtgatgggttcagtagaaacccaaactccagcgctacacaatatacccttataaggaacccgcacgtatacaccctgaatctaaaatttaaaataaaaaaaaagacaccttcactcatatgtttattatagcactagtcacaaatagcactgttcacaagtcatggtctcaacttaagtgtccatcaatggacattattattctctgacctccctataagtagacatatttccctttaagaccagtcatggttagtaatcaattcttactgaatcatcctctaataatatggatacttaggacagtatggagatattaacaaaccatttgttcccacaagctgaaactaagccattacttaccacctttcaagtgtgaccatccattactacattaatacattcacctctaaatatcattaagactcagatcagcaacttgtaacatttgccccaaatacttaaaaatcattcacttggttcctgtaacaaaaatggatcagaagaggtaattatttcaaccaactaccgccacaattgtcagggtccatggaacatcaaaaaattataacaaaataataccatcttgcaacagccattgtatctaggcatacccctgctctttgttccatagagtcaacatataactcttattcacatctcaaggaatctaacttaaaatatattccatggatgacctcctaaaaactgaaagaaatttagattaaaaagagccacactttgattgaacaaatacatacctatagctgagattagctgtttaacaatggttcaacatggcaatgattttatagcaaaagtccctggggagttataaaaacagaaacctagcactgatatacagtaatcttctgatataatttgatatacagtaatttggataactcttacagaccaaattgaggtatctactaaccgaaaggaaacaaaaggaaaggccaccaatgataagtattatgtaaatatggcaggtatcacagcctaataaaattaaaagactccacaaatttttgaaaaaacagaagtagctgtgtgacctgggacaagttatttaacttcaaatattattcattgggatttaatcatggtctacttctggggtccacaaaactttttctctataaagggccagactgtaagtattttaggtcttacaggtcatatggtctctgtcccaactactcaactcttcctttgcagaatgaaagaagctataaacaaaaatttatcctcacatcacctgcctttacacataaaaaatgaagtctagaaaaaaattaactgatggaaatttagatttgactaggtattaatgtgtgataataataataaattaaccatgctctcagtggaaatgagaaaagcaagtcatctcagaatccatcaaatttgttcatgctattaaaaacttagaataccaccttttcaacctgtactaaacaagaaactaataaaatactgaaagttcttccagttagaatttaaaggtcacaagggagaatcactccactatattaaaaagacaaagctaaactataaaatccaaattttaaaactcatcggagagctgagaatacaaagaagtctgaaaaaaacaacaacaacaacaaaaaacaattccagaaaggaaaaagccctttctaggctaacagacaagtgactactttcaactctgagatcatggtgaacacaggaatgaataatcctatagactgatacgatggaccaaattccaaagaagtcccacaagtaaagttaatcaaaacaacctaaaaattcttccccatggagctttaatagagtatacatcaatgtgcactaatctaggggtagactcggagggcaaagtgagatgatctgcagagtagaaagtcaagtgcagtgctaaagcagagagatccccggaacttagctaaacttaaatctcaagatctattgtagagtgaagactgaatcctcccttaaaacacttgaaaccaaaaataactacagttgcagctcagcccagacataactcaattccatgtcagaattaatagtttagtcccttttttgatctgtctgaggaattagcatgtcttttctcaggaagaagcagttagaaatttcattttcactgcctttttttttttttttttttttttttttcttgagacagagttttgctcttgttgcccaggctggagtgcaatggcacgatctcagctcactgtaacctccacctcccaggttcaagcaattctcctgcctcagcctaccaagcagctgggattataggtatgcgccaccacgcccagctaattttgtatttttttagtagagacagggtttcaccatgttggtcaggttggtctcaaactcctgacctcaagtgatccacccgcctcggcttcccaaagtgctgggattacaggcatgagctaccacgctcagccttcactgctctttttacatttaatattcacatataataaaaattacaggatagtcagtcatgaaaatgtgacttataggcaagagaaaaaagtcaacactaacccacggatgatgcagattggaatgagcaaagactttaaaataaattttataaaaatatatgatattattatgtataatcttatagagagaaaaaacattgattaaatatattttgtcacagaagaagaaatttgggggaaaaagagccaaatggaaattctcaagtaaaaaatatttgaaaagttcactaaatagacttaataacagatgagacacagaaaagatccatgaattcagagaggtcaacacaaactatccaaattaaaacgaagaaagccaggcacagtgattcacgcctgtaattccagcacttcaggaggccaagacaagaggactgcttgagtccaggagttcaagaccagcctgggcaacatagcaagaccccatctctacaaaaaaaatttataataaaaataataataaagtaagaaatactaaagtaatttcttcagactgaaggaaaataatctcagacagaagtctagatctgcaagaaggaatgaagagtactagaaaatattgtgaacaagacagctatgtctactgttaccacttctgttcaacactgtaccagtggtaacagcaagtgccataaagcaataaaaagaactgaaggcatgaagactggaggaagaattaaaactatctttatgggccaggcgtggtggctcatgtctgtaatcccagcactttgcgaggctaaggtgggcagatcacttgaggtcaggagtttgagaccagcctggccaacatggcaaaaccccatctctactaaaaataccaaaaattatccaggcatggtgccatgtgcctgtaataccagctactagggaggttgaggcaggagaatcgcttaaacctgggaggaagaggttgcagtgagctgagatcatgccactgcactccagcctgggcgacagagtgagactctgtctcaaaaaaaaaaaaaaaaaccttattagtctcagataatgagactttatatatggaggatccaaagaaatagacaaactagtaaaactaataattgaatttggcaagttcaaaagatacaaggtcaatctacacaaatcaaatatatttctaaatactccatgaaagaatggaaaatgacatttttaaataccatttataatatactcaaaaaacaaacacttagcaataaaattaaccagaatatgtgaaagatctctaacgtgaaaactatgaaactttgctaaaagaaattaaaatctcaatgaatgtagatataccatgttcaagaagaggaagactcagtattactaagatgtgaatttcccaaaactcatctatagattcaacacaatctcaatcaaaatcccagcaaagttactttgtgaatattgacaaacttatatcgtttatatggaaaagtaaaagaccaagaatagccaatacaatattgaaggagaaaaacaaggtcagacactacaagatttcaaatttactataaaactacagtaaatcaagactggcaaaacaatacacaaacagatcaatgaaacagaaaagagagtccagaaacagacccacacaaatatagtcacctgatctttgacaatgaaacaaaggcaagtcaatggaaaaaggatagtcttttcaacaaatggtgctggaaaaactagacaactacatccaaaaaaaaaaaaatctcaacacagaccttacacgtttcaccaaaaattaactcaaaatggatcgcatatctgagtgtaccacacaaaactattaaactcctataagacagcatgggggaaaatcttggtaaacttaggcttggtgatgacagtataagagaaaatcttgctaatctcagccttggcaatgacgttttagatacaacaccaaaagcacaaaccatagaagaaataattgataagctggacttcattaaaaataaaaacttctgctctgcaaaaggcaccgttaagagaatgaaaagacaagccacagactgacagaaaatctttgcaaaacacatatatgataaaggactagtattcaaaatataccttaaagatgccgggcgccatggctcacatctgtaatcctagcacttggggaggcagatgtgggtggatcatttgaggtcaggagtttaagacaagcctggccaacaggctgaaactccatctctactaaaaatacaaaaattagccaggtgtggtggtgcatgcctataattctagctactcaggaggctgaggcaagagaatcacttgaaccggggtgacggcagggtggtggcagggtggcggggggcggcgcgggcagaggttgcagtgagccaagatcatgccattgcactccagcctgggcaacagagtgagactctgtctcaaagaaaaaaaaaaaaaaaaaaaatatatatatatatatatatatatatataaacacataaacacacacacctccaataactcttaaaacacaataataaggaaatgaataacccaattaatatgggccaagtgggaaatctaaacagacatcccaccaaagaagatatacagacaacaaataactaaatgaagatactcaaaatcatatttgttagggaactgaaaatcaaaaccatggtgagatagtactatatgcctattagaatggcaaaattctgaaacaatgacaaaaccaaatgctagtaagaatgtggaattacaggaactctcattcattgctggtggggatgcaaaatagtacaaccacttttcaagacagtttggcagttcttacaaaactaaacatacttttgccatataatctaccaaccatgctcactggtatttacccaaatgagctaaaaattcacttcactacagggcttgccagggtggctcatgcctgtaatcctagcactttggaaggctgaggtgggaggaacgcttgagcctaggagttcaagaccagcctgggcaatgtggtgtgacctccttctctacaaaaaataaaattagccaggcatggtggtacatgcctgtggtcctagctactcaggaggctgaagtgagaggatcccttgaaccagaaagatagaggctagagtgagcccagatcataccactgcactccagcctgtgggaccctgtctcaaaaggcaaaacaaacaaaaattacctccacccaaaaacctgcagacagaaatcagacacagtggcacatggcaacagtcctcactattcaagaggctgaggtgggagaattgcttgagcccaggagtttggggccagcctgggcaatatggtgagaaactgttgctaaaaataaaaaaataactttaaaaacctgcacatggatgtttacggtagctttatttatgattgtcagaaattgaaagccaccaagatgtccttcaaaaggtgaataaacaaaccctagtatccatacaatagaatatatttcagcaataaagacaaacgagctatcgaaccatgaaaaaatacagaggaatcttaaatatacattgctaagtaaatccaaaaagcctatgtactgtatgattccaactacatgacattctggaaaaggcaaaactatggcgacagcaagaagacagtggttgaaaagcgttgtgggaggtgaaaggatgaaaaggtaaaagcatgagatttttaaggcagtgaaactattctctatgatactgtaacggtacagacatgtcattatacatctgtcaaaacccacaggatgtaggacacagagagtgaaccctaaactacagaccacaaatagtaacgatggattaatatggctcatcaactgtaacaaatggacctcacttaaccaagatgctaaacaataggggaaactgtgggggcaggaggaggagcaaggtgatatccggaaactccgtattttctgctgcatttcactgtaaacctaaaactgctttaaaaaatagaccctattaaaaataaaagaaaatttaaaattttaaaaataaagtatattaattaaaataatttttagttgcttacaaagtcatcaacctgcatactataaaattttggcattttattgtaaattaaaacttaattttttaaaatgtaatactcaacagtctcttaggccttctatctgaagatgaatatcgaaaaaaggatacagtataatatgcatgtgttttaaaaatgcaaggtgacatatggtctacaagtgcatatgcatatatataagtaaatgcacaaataaatatatgaaaacacatataccaaactggaaagagcaccactaggaaacgaacactatggaaaaccaacactactgtgaagggaatgaaaggaaaagatgggggatgtggagtgtgtcctaatccatatgtcttgatctctcttaagaggatctacattaatgtttccaattcgctattattaggttttatactacatttaaaatgtaggcttcagaatctgaagaggaatttcaaaatgttttataaatctttaagactaaacagcctcagcataaactaacattggagacagatttttacctgtaagtatttctgcacctgtatttaaaagtataaaaaagtatttaaaagtttaaaaaagcatttttacctgtaagtatttaaaaggaattttaaatcactcaatagtgattgatcaggcaaggaacaagtattatctgctgattcttagtttgtctgtaatgccatccctacaaagactgtatttccattgcaccctccttttattactcggctgattataccctaaaacacatacacactcctccctggtgtagatgctgacagcttaattcacattatataattcatataatagtgaagttgtaatacagaatgcaacagtatccattatatcagaataaggaagaaaactggtctgagatgtgctattatgatataaaatcaactaacaacgtaccaatcaataaactaaccatgcttctcttttttttttttttttttggtaaatgtgggtattttaattttccttgataaggacaaatatggccatgagaagtttctctgggagtttcatcatctgccatttacagagagtgggaagttatgcagcaattagcctaggagagaagtgtccaccaacctatgaagacagtctccacagctcaaggagacagtaagagccagaaagcgttaataccagtcaccccaaaaatgcaaagatcctcccagtaagctacttaaaaaatgtaaaaagtgaggtctaaattgtgaaattatactttttgggttttttttttacttttaagttcaagggtacatgtgcaggtttcttataaaggttaactcacatcacaggggtctgccgtacagattatttcatcacccaggtattaagcctagtacccattggttatttttcctgattctctctctgctcccaccctccacctcatcaattagcttccacttatgagtaagaacatgtggtatttggttttctgttcccatattagtttactatgaataatggcctccagcttcatccatgttcctgcaaagaaaatgatcttgttctttttgatggctacacagtattccatggtgtatatatacaccacattttctttaccggtctaccactgatgggcatttaggttgattccacgtccttgttatcataaatagtgctgcagtgaacaaacacacatgtgtacatgtctttaggatagaatgatttatattactttgggtatacacccagtaatgagattgctgggttgaatggtagttctttttaggtcactgaggaatcaccacactgctctctacaatggttgaactaatttacactcccaccaactctgtatatgtgttcctttttctctgcaaccccgctagcatctgttatttttgactttttaataatagtcattctgactggtgcgaggtggcatctcattgtggtctgattcacatttctctaattatcagtgatgttgagtgtttttccacatgcttgttggccacaggtatgtcttcatttgaaaagtgtgtgttcatgtcctttacccactttttagcgggttttcttcttgtaaatttaaattctttataggtgctagatattagatctttgtcagatgcagtttccaaaacttttcttccattctgtagactgtttactctgttaatagtttcttttgctgtgcagaagctctttagtcactctaagctctttgtcaatttttgcttttgcaattgcttttggtgtcttcgtcataaaatctttgcccattcctgagtccagaatggtagtgcctaggttgtcttccatggtttttacagttttaggttttaaattagagactttaatccatcttgagttaatttttgtacacggtgaaaggaaggcatcgtttcaatcttcttcatacagctagccagttatcccagcaccatttattgaggagggagtcctttgcccattgcttgtttttgtcagctttgttgaaggtcagatggttgtaggtgtgccttatttctgagctctccattccattggtctatatgtctatttttgtcccagtaccatgctgttttgtttccggtagccctttgtagtacagtttgaagtctggtagatgcctccaactttgttgtttttgcttaggattgccttgactatttgggctcttttttggttccatatcaatttttaaatatttttttctagatctatgaagaatgtcattggtagtttgataggaatagcactgaatcgataaactgctttgtgtagtatggccattttaacaaactgattcttcctatgaatgtggaatgtttttctattagtttgtgtcatctctgatttctttcagcagtgttttctagttctccttgtagatatctttcccctccctggttagctgtattcctaggtattttattccttttgtgatgattgtgaatgggatttgtgttcctaatttggttcttggcttcttgactgttggtgtattggaatgctagtgatttctgtatgttggttttatatcccgagactttgctgatgtcatcagcttaagcagcttttgggctgagattatgaggttttctaaatatagtcatgtcatctgccaaggacatggacagggacatggacagggatagtttgacttcctctcttcctatttaaatgccctttatttctttcccttgcctgattcctctggccaggacttccaatactatgttgaattaggcagtgatggagggcattcttgtcttgtgccagattaagacaaatgtttccagttttggcccatgcagtatgatgttggctgtgggtctgtcttattattttgaggtatattccttcaatacctcgtttattgagagtttttaacacgaaaggctgttgaattttatcaaaattcttttctgcatctattgatataatcatgtggtttttttagttgtttatgtgacgaatcacatttactgatttgcatatgttgaaccaaccttgtatcccagtgataaaagcctactagatcatggtgggtaagttttttgacatgctgctgaatttggtttgccagtatcctgttgaggatttttgcattgatattcatcaagcatgctggcctgcaattttttttgttgtgtctctgctaggttttgatatcaggatgatactggcctcacagaatgagttaaggaggggtccctcctcctcaatttttgggaatagtttcagtaggaatagtaccagctcttctttgtatatctggtagaatttggctttgaatccatctggtcctgggcttttttgctcgatgggctatttattactgattcaacttcaaaactcattactgacctgttcagagatccaatttcttcctggttgagtcttaggaaggtgtacgtatctaggaatttatacatttcttctagattttctagtttctgtacacagaggtgttcataacagtctgatgattattcctatttctgtgaggtcagtggtaatagcccttttgttgtttctaattgtgtttatttggaccttctccattttcttattagtttagcaagcaatctattaattttttcaaaaaaccaaatcctaaattcactgatgttttgaatggtttttcgtgtctcaatctcctgccattcagctttgattttggttatttcttgtatgctgcaagtttgggggttggtttgctcttggttttctagttcttttagttgtgatattaggttgttaaattgagatctttttaactttttcatgtgcacacttagtgctgtaagttttcctctttacactgcattagctgtgttccagagattctggtatattttatctttggtctcattagtttcaaagaacttggtttttgccttaatttcatggtttacccaaaagtcagaagaaggttgtttaatttccatgtaattgtatggttttgagcaattttcttagatgtgacttctaattttattgcactgtggcccaagagagtggttgttacgacttcagttcttttgcatttgcagagaaacatgtcgaattgtgtggtcaatttcagagtatgtgccatgtggtgatgagaagaatgtatattctgttgttttggggtagagagttctgtagatgtctattaggtccatctgatccagtgctgagttcaggtcctgaatatctgttaattttctgccttgatgatctttctaatactgtcagtggggtgttaagctctcccactattatggtgtagaagtctacatctctttgaaggtctctgagaacttgctttatgaatctgggcgctcctgtgttgggtgcatatatatttaggatagttaattctcttgttgaaatgaaccctttaccatcatgtaatgcccttctttgtccttcttcatctttgttggtttaaattgttttgtttgaaatttggattgcaacccttgcttttttgttttccatttatttgcttggtaatttttctccatccctctattttgagcccatgggtgtcactgcataggagatgcactacacaccttagtttttttatccaatttctcactctgtgccttttaattggagcatttagcctgtttacgttcaaggttagtattgataagtgtggatttgatactgacatcatgatgttacctggttgttatgcagacttgtgtggctgctttatagtgtcactggtctgagtacttcagtgtgtttgtgtagtggctgctaacagtctttccatacttagtgcttccttcaggagctcttgtaagacacgtctgacggtatcaaattccctcagcaattacatgtttgaaaaggatcttatttcccctttgctatgaagcttagtttggctggataagaaattcttggttggaatttttctttaagaatcttgaatattcactcccagcctcttctggcttgtagagtttctgctgagaggtccaccattagtctgatgggcttccctttgtagttctcatgaatgagatcctgaaatatattttccaagttgcttccattctccccaactctttcagggacaccaatgagtcgggtgtcatagatttggtctctacataatcccgtatttcttggaggttttgtttgttcatcttcattcttttatccatattcctgcctgattgactgtcttatttcagaaagccagtcttcaagctctgagattctgtcctcagcttgacctattctgctattaatacctgcagctggccgggcgtggtggctcacgcctgtagtcccagcactttgggaggccaaggtgggtgaatcatgaagtcaagagatcgagaccagcctggccaacatggtaaagccccgtctctactaaaaatacaaaaattagctgggtgtggtggcacaggcctgtagcccccgcttttcgggaagctgaggcaggagaatcgtttcaacccaggaggcaaatgttgcagtgagccaagattgagccactgcactccagcctggcgacagagtgagagagtctgtctcaaaaaaaaaaaaaagaaaaaatgaaaaaatctgcagctgcattatggaattcttggagcatgtttttcagctcattcgggttggttacattcttttctataatggctatttcatctgtcagctcctgtattattttattgtgattcttagcttccttggattgggtttcagtgcactcctgcatctctatgatcttcgttcctatccattgtctgaattctatttctgtcacttcacccatctcagcctagttcagaaaccttgctggaaagccagtgtggttgtctggagaaaagaaggcactctggctttttaagttatcaggattcttacgctggttctttctcaactttgcgggctgatgttccttcaatctttgaagatgctgtccttcgaaatggttttttgtttttttcctttcaccctatttgatgaccttgagggtttgattgtggtatataaggtgggttcagtcaactggcttcatttctggaagattttaggtggccaaggttcagctcctaactcccagattacatgctctaaatctgggggactggtattgggaccctattttgttctctggctcctcaatgttaggaacccactgcactgggggtaggagggtgtcaaggtgcccctggactacttgtcactacactccagcgggtggtgccaaagagttttgtaaggcagtggcagtgggatctaccctcattcccatgtgccagtggcagcacagaggggtgcacacttgtcagctgtggcagtgtgctagcagatgccagagtgtcagcctcagtgtgggcgtttgtagcagtggtacaggcagcatggcttaagcgggccccactggcaactatgcatgtggtcacactggtggtggtgttagccgggtagtgctggtaagggcaaatctgtgtgcaccctctgtgcacatttacacaggtggggatggccactcagggagggggagggttcattgttctctgtgcctagtttcactccagcagcaatgttggcaagggggtggggcactggcggggtggggcactggcagggcagggctgaaaggctctgtgcctgccaagactctgactgcaattacagtacaaccaggggaagggaggcagagtgcactcacactggcagcagtggcacagggtaatgtgcacgtgcacacgtgctggcgaggcgagggaaagcaagatctgcctgtgcacacacaccggcaaagtgatgtgtgttgggggggccggggcagtggtctgtgggcagggaggggttggggtgtaagctgcaataggggaagggagcaggcaggcaggctggtgcatatccaccggggctgttttgttttttttgttgtttttgttgttgttgttttttttgagacagagtttcactcttgttgcccaggctggagtgcaatggtgcaatctcagctcaccacaacctccgcctcccaggttcaagcgattctcctgcctcagcctcccaagtagctggggttacaggcatgcaccacacacccagctaattttgtatttttagtacagacgggatttcttcatgttggtcaggttggtgtcaaactcccgacctcaggtgatccacctgcctcggcctcccaaagtgttgggattacaggcatgagccaccgccccggcccacaggagctattctactgcagctctctgccattcaagtgtggtcaggtcagccagcccaggagctatgatgcaggtccccagggtacccaaggcttcactgcaagcaggcgcaaccaggctgggtccccagaagaggccagcagaccaaagcatgctcaggttgatgggcaagactgccctgcagagttcaggtctgactttctctagggctaaagtctcctatgggagcaagtcaagcctagggagatgggcatccctggccatgctccactatagacactcctgcaccaaaccctctgggctctgcactgactggagtgctgcctctaccacttttcaagtgtgcttgagaatcaagcagctctccctgccaactcgagtgtccatgaagtttgagggatctcctcctgccaggattccagaggcctgtggtgagagcataccgttccttgccagttcaactcacccgtttccctggagtcactgggcaccaggaacaagtcctggtgcatagtagccttgtgcagggttcccaggttcctcccacttcatcccaacatctgtgtcttccctctgtctactctcagtgccttccctctgaagatctgttaggagtgtgccagttgtcccagtccctcagtggcagccattccacctggctgtgtctagtcagccatcttgcccaccttcctcctttctttctcatattttttttccactatgcctttctccagagaaaatttaccttctattcttttctgctgtttgggtttatactactgtcgttatgtactgaactgtgctgttctcccaaaatttgtatgttaaagccccaatctgcaatgtgagtgtatttggagacaggacctttaaagaagtaatgaaggttaaatgaggtcataaggaaaggtcctacttcaataggatgggtgtccttgtaagaagagatgtcagggatgtgtgcactacaaaaaaaggtcatggaaggatacggcaaacagcagctaccagcaagccaaaaaaagaggctccaggagaaactaaacctgacaacaccttgatcttggacttctagtcaccaggagtgtaggaaaataaatttttgttttttaagccactcaatctgtggtattttgttatggcagccccagcaaattaatacaactgtacagcagtctttggcacacaattattaatatgttcaacttgatactgttttataataaactctatagaatactaactagttttctgtcattgcccaaaaagtgcaatgccctctgggcctactgtcataggtcaatgccttctgtgcctactttgcctttctttttccaatagtgcttcaaatattctatagagttcctttctcttccatctcctctactgtgatcatctctgatctctgctcttagtatttaccattgtcagaggtctactttccaacacattatcaaatttataatctaacacatttgccacttactactgtgacatatacaccctcacctcccttgactcactcctttagcagctgcttcatgtatacttctcagccttgctaatactgacattaggcatttagaaccaacaaccaaaaagagctctaccagtcagtaaaaaatatatatatgtatatgctagtttctgctgattatcttattgctcttaccagtagtattttgttctgactgacagagacgttccctgagtttggaaaactcaaatgttactccagaacttaaaaaaactgctcttcaaatactatctaaatacagtccagctaacccaccatcaacaaaatatatgccagggttgatttttctacttacatgtatgtctatgctcatttatccacagtcatccagtctcccttctctggtcaatgatgtacacttttgcagaataaaacattccaaaggcaagagtatgatcagaaaacagagtatcccttatgaactcaatcaagaataaattctgaaatcttgttctccctggaatgggacactgcacaactaagttaacacttcaaaatactcatcaaatgttgtcttattacctcaagagtcaaaacaatgtagaaaaataatggtttttgtttttgtttttgttttgagacagggtctcactctgttacccagactacagtgcaatgtcttgatcacagctcaccacagcctcaacctcctgggctcaagcaatccttccacctcagccaccccaatagctaggactataggcacacagcaccacacctggctaattttttaatttttttgtagagacagtttcactatgttgcccaggctggtcttgaactcctgagctcaagtgatcctcccacctcagcctcccaaagtgctaggactgcaggcatcagccactgtgcccggcaggatgggtcatttttattccttcaagaaccgtatgagctgggccacagaggctcacacctataatcccagcactctgggaaaggaagggaggaggatcacttgaggccaggagttcgagaccagtctgggcaacatagtgagacttcgtctctacaaaaaattttaaaaattagctgggtgtggtgacatactgctgtggtcccagttactcaggaggctgaggtgagaggaaagctcgagccccaaaagtaaaggctacagtgagccatgatctcactactgcactctagcttggacaacagtgtgagaccctcctcaaaaacaaaagcaaaaaaaacaccaacttatcaacagcaatgttgtcataccacttactaaaaagttcaaacttaaaagtttctctgggttttggtcctttttaagaggtgtcatattcattctgtatcaaaaactgtattgtgccaatggcttcgagtgggatattaaacaatctcacctctattttgttaagctgtgagataacaatgctatattaataacttattaagactaagtatacaggaattgaaattacttttatgtaaaataaaagtgcaagttaatcactatgtactgcatggtcattagaattagataggtagcaagtcataaattactacttattagcccactggtaaaattacagctgttctgaagttttagagaaatcctaaatattcaagttttccaatgaactggaatttcagctctttaagcttctctaagctttagaagttcttcttttaatactctggattaattatttctataatatactaactttatatctttttaaacaaagtatattaaatataccatgcatttcttaaaaatttagaattgcataacaaatgttaattttgatatgatacagttaatatttattagaaactactgatataaacaaggttggctgtccctgtcaatattcccagattgctttatagacaagtgcttcatcctatcagcctaacaacctataaatgtccctgttctcatttactgtttctatactacgtaaccttagaaaccaaattcttacttaaattacctgaaataaaactagcccctaaataaaagcctaggggactctcatataagtatagaaatgttaaacatattttcataatctccattaaccatttaaagactctggggttttttgcaatataatctgaaaataaacatgggctttgtagtcagtcacacagtgaggggttcagatcctaccattacacttactagctgtgaaatcttggaaagataataaaccaccttccctaaatgtttatattcttttttaaaaaaactccatcacctagttcatcattgctgtgagattaagtgtgatactgtatataaataaacaatgattgggtgctgggcgcagtggctcacacctgtaatcccagcactttgggaggctgaggtgggaaaaccacttgagcccacgagttcaagaacagcttcagcaaaaaaaaaataaataaataaaaaataaaaaaataaaaaagcaacacctcatctccacaaaaaaaatttaaaaatctacccaggcatggtggctcatacctgtagtcctagctacttggcaggctgaggcaggaggatcactggaccccaggagttcaaggctgcagtaagctatgacttcaccactgcaccacagcctgcataacagagtaagatctgtctcaaaaaaaaaaaaaagtcaactttcatacctattttaatcattgatacaaatagttaatataacaaatttactgaattttacaaacaaaattcaccatttctttttcgtttttatttcttgatatccatatggggtgttagctttctataccaaatagcttttaaccactttattcttttcttgtttttcttttctttcttttcttgtcctctgtgactgagacatttccacatggctaaaacagtagaaatccttaagactacagtcatatatgggaaagaatacgcaagcctaactgctcacactcctagatcataaataagcttctgaaagtcaaactctgctatttactagtaatacaactttacctgaactactctctctctctgagccttaatttcttcatattcaaaaaagaatggagatatccatctccaataacatggccaattacacagaacacaactacaactaagatttttaaaactaaatacatcagaaaatatatattctttttttcttttttttttttttgagacagagtttcactctcttgcccaggatggagtgcagtggcgcgatctcggctcactgcaagctccgcctcccaggttcacaccattctccctgcctcagcctcccgagtagctgggactacaggtgcccgccaccacgcccagctaattttttgtatttttttagtagagacggggtttcactgtgttagccacgatgatctcgatctcctgaccttgtgatccacccaccttggcctcccaaagtgctgggattacaggtgttagccatcgcgcccggcgaaaaatatatattcttaaaagcctcaaagagctaatgttaaagaattataagcccaaaacataagatagggcaggaattcagagagataagcagagcactgaagccaggttagctactgacagaagccaaactcaggctttggttttcatagtctcataatgatagaagccaagcccatgacccagccttagtggtgagtctgataagacacccctataccatatggctggaaccagtaaaatgaacaaaagtaaacctgtcctattctaacctaatcccctaagaacttcaaagaaagctgctttggcactgagcagaaaagaatgatgggagaaaggagagttcctgacaagttattaacaggaaacagcaaactttttctgtaaagggccagaggtataaatattttaggccttagctgagtgtggtgcctgcctgtagtcccagctactccggaggctgaggcagcaggatcccttgagcccaggggtttaagactgcagtaagctatgacttcaccactgcacgaccactgcccaccatcctgggcaacagagggagactgtctctaaaaaataaataaataaataaatattttaggctttgaaggcaatatgatctctgttgtaaccaatcagctctgctgttgtagcatgaaaacagccacagacaatacataaaccagtgagcatggatgtattcaataaagatttataggcacttaagtttgaatttcatatgattttcatgtcacaaattatttttttccaaccatttaaaaatgtaaaaaaaactctactagcttgcagcccaaacaaaacaggtggcacaagccagtttccatttacttgtaacaacaagacacacaccaccacttcagccaccaccttacttacacacacacacacacacacacacacacacacagagatttgaggctctaattcccatcacctagatgaagtaaaaaacatcaggccataaacatttagaaaatacatgtgcaaaacccaccaagtactgtcccaggaaaaattaacaagaaaaaaagcaccacaaatgaaaagcaagcaagcaaagaataccaacacacatgcaaaaatttcagatattagaaaagatcacatagagaatataaaataactgctttctaaagtttaaagcaacaaacaagcttgaaagggtcgtatatatgagaggggaaagaatcattaaaaaatgacttagcaagctaggtgtggtggctcatgcctgtaatttcagcactttgggaggttatggtgggctgatcacttgagcccaggagttcaacaccagcctgggcaacatagtgagaccctgtctctacaaaaaataaaataaaataaaaaatagctgggtgtggtggcctgcacctatcgtccctgctactcaagaggctgaggcaagaggatcacctgagcccaagggaaagaggctgcagtgagccgagatcacaccactgcactccgccctgggcaacagagaaaaaatgacttagcaaatataaagaattaaaataatttctaaaattgtaaaacacaaggaactgaaattaaaaatcaaatcaggccaggcacagtggctcaagcctgtaatcccaacattttgggaggctgagatgggtggatcacttgaggttaggagttcaagaccagcctggccaacttggtgaaaccccgtctctactaaaaatagaaaaattagctgggcatgacagcaggcacctctaatcccagctacttgggaggctaaggcacaagaaccacttgaagccaggaggcggaggttgcagtgagccgagactgtgccactgcactccagcctgggcaacagagtgagactccatctcaaaaaaattaaataaaaaaaaccacacaaataaaaaataaaataaaatcattgaaaagtagtgaacttaaaacatacatctgaagaaatcacccacagtaaaagaagaaaaatacacacccaaaaaaagaagaaaaacacaaaaatacaaaaaaaggttaaaaaaacatataagaaagccagacacggtggctcgtagctataatcccaggaacttgagaggctgaggtgggaggatcacttcagcccaggagttcaaggctgcagtgagctatgatcacaccactgcactccagctgggaaacagagcaagaacttgtcaaaagaagaaagaagaaagaggaaggaggaagaagaaagaaggaagaggaggaggaggaggaggaataaaagaaaaaatacataagagtaagaaaatctaacatatatagacatacctcattttatcgcactttgctttattgcacttcacagatagtgattttttaacaaattaaaggtttgtggcaaccctgtgtcaagtaagtcaacaggtgccatcttctaacagcatgtgctcacttcgtgtctctgtgtcaaattttggtaattcttgcagtatttcaagcttttttaaacttttttatgtatttatttatttttagagacaggatctcgctctgtcacccaggttgcagtgcagcagcatgaccatcatagctcactgcagcctcatattcctgtgctccagcaatcctcctgcctcagcctcccaagtagctagcactacaagtgcatgccaccctgcccagcttattttttaagtttttgtacagatgaggtcttgttatgttgctgagtctagtctcaaactcctggccttaaagcaaacctctcacctcagccttctaaagcacctgtattacaggtgtaagccgccacacctagcttcaaacttttttattattatatctgttatggtgatctgtgatcagtgatctttgatgttactgtaattgttctgaggcaccaaaaatcatgaccatataagacagtgaacttaatcaatcaatgttatgtgtgttctgactgctccatcgaccagctgttccctgactctttcttctcgttgggcctcactattgcctgaaacacacaatattgaaattaggccaattaataaccctacaatggcctctcagtattcaaatgaaaggaagagtcaaatgtctctcactttaaatcaaaacctagaatgattaggcttagtgagaaaggcatgctgaaaacctagacaggccaaaagctagacctcttgtgcaaaacagtttgccaagttgtgaatgcaaaggaaaacttgaaggaaattaaaagtgctactccagcgaacacacaaataagatagcaaaaccaccttactactgatatggagaaagttttagtggtctggaaagaagatcaaattagccacaacattcccttatgccaaagcctaatctggagcaagtctctacctctcttcacttctatgaaggctgagagaggtgagaaagttatagaagaaaagttggacactagcagtgttgatgcatgagatttaaggaaagaagccgcctccacaacataaaagtgcaaggtaaagcagcaagtggtggcatagtagctggagcaagttatccagaagatccagctaagataattgatgaaggtggctacactaaacaacagatttttaatgtgacaaaacggccttgtgttggaaaaatatgtcatctaggactttcataattagaagtgaatgcctggcttcaaagcctcaaagaacaggctgcctctcctgctaggggctaaggcagctaatgactaagctgaaaccaatgctcattgaccattctgaaaatcctagggctcttgagaattaacgctaaatcaaggccagatgtggtggctcacgcctgtaatcccagcactttgggaggctgaggcaagcggatcatctgaggtcaggagttcaagaccagcctggccaacatggtgaaacctcgtctttataaaaaatacaaaaattaaggtgggtagatcacctgaggtcaagagtttgagaccaacctggccaacttggaaaaaccccatctctactaaaaatattagctgggcatggtggtgggagcctgtaatcccagctacttgagaggctaaggcaggagaatcatttgaacccaggaggcagaggttgcagtgagccaagatcacgccactatactctccagcctgagtgacagagcgagactgtctcaaaaaaaaaaaaaaaagaaaaaaaaaaattagctgggcatggtggtgcaggcctgtagtcccagatactcaggaggttgaggtgggagaatcacctgaacccaggaggcagaggctgtagttagttgagatcacaccaccgcactccggcctgggcaacagtgagatcctgtctcagggaacaacaacaacaaaattacactaaatctactttgcctttgctctctaaatggaaaaacaaagcctgaatgacaacacatctgttgacagtaaggtttactgaatgttttaagcccaccgttgagacctactgctcagaaaaataagattccttcaaaatactactgcttattgacaatgcacctagttacccaagggctctgttaaagatgtacaaggagattaatgttttcccacctgctaacacaacatccactctgcagcccatggatcaaggagtaattttaactttcaagtcttattatttaaaatatttcatgaggctttagctgccatagacagtgattccccttatggatctgggcaaggtaaacgtaaaaccttctgtaaagaattcacctttctgggtgccattaagaacattcatgactcgtgggaagaggtcaacataacattaacaggagtttggaagaggttgttcccaagcctcatggatgactttgatggcttcaagacttcagtggaagaaggaattgcagatgtggtggaaacaaagataattagaatttaaaatggagcctaaagatatgactgaactgcagcaatctcacaataaaacatgaacagatgataagctgcttcttactgatgaccaaagaaagtggtttcttgagatagaatctactccttgagaagatgctgagaacactgttgaaatgacaacgaagtatgtataatattacatcaacatagttgataaagcagctgcagggtttgagaagactgactccaattttgaaaaaagttatattgtgcataaaatgctatcaaatggcactgcatgctacagacaaatctttcattaaaggaacagtccactgatgcagcatacgtcattgtcttatttcaagaaattgccacatccactccaactttcagcatccactatcctgattagtctgcagccaccaccatgaagtaaagaacctccaccagcaaaaagattacaattcaatgaaggctcagatgaccgatgaccgttagcatttttttaatattttctaatcaatgtgtggatatttttgtagacatggtgctattatacactttaaatagactatagtacagtataaacataagtcttatacgcaatgggaaaacaaaagtttcatgtgacttgctctactgcaatattcactttattacaatatttgctttattgcagtggtctgaaactgaacttaaatatatcagaagtatgcctgtatataaactggagatccagaaaaagaaagactgagatggtgaaacaaaaatatttaaaaactgggaggccaaggtgggcggatcatgaggtcaagagatcaagaccatcctggccaacatggtgtaaccccatgtctctactaaaaatacaaaaatgagctgggcatggtggcgtgcgcctgtagtctcagctactcaggaggctgaggcaggagaatcgcttgaacccaggagacagaggttgcggtgagccgagatcacaccacttcactccagcctggtgacagagcgagactccatctcaaaaataaataaataaaataaaaatttttttaaaaaaaagaagaaacagaaaaagaaagaccactgaaactataagatcatttcctctgaaaacaattaactagaaatcagtataaaaaagatgagtgggcataacaaatgtatttttcaaagatgtccacaccagcatataccccatcccacacatacttttacaatgtgacttgacacttttccctatgcttcctcctcctcaaacatgaatggagctctgtaactctggatcaccagaatgcagaaacaaggctaggtcataaatggcaacatggcttctatctggtatgctctctctctcaggaattccactgaccatgccctgacaacagttaaagtttcatggaaaaacccacatggaagggaactaacacagaaatgccaagtttaaccactcctgaattcctaacccaccaaaactgtaaaggataataagccactaagttttgggcttaactggttatgcaacaatagataactaacatactaaaaattgtcacttatttggaaatttttaaatatactcctaaataatatatgtgaccaataaatgaaaaatattttgaaataaataacaaaactacatttcaaaacttgtgagatgcaattaaagcaatacttcatgggaaaatgtataaccctaaataagtataataggaaaaaaaattagagagctatctattcagaagataaaaaagaattgcaaaataaacctgaagaaagtaggaaggaaataacagaagtgatcaggtgtgtgtggtgccacacacctatagccccagctagccagggggctgaggcaggagggttacttgagcccaggagttcgagaccagcctgggcaatataatgagaccacacccccatctcaaaaacaaaacaaaacaaaacaaaacaaactgctgtgatcatattttggttagaaaagaaatgataaaaacgaagaagtgataagtagagagaaaacaaaatagtaaaggccatcaaagccagaagttgtatttaaaaaaaaaaacaactataaattggcaaacctctggcaaaaataattaagaaattaaaaagaaaaagaggccagacacagtagctcacacctgtaattccaatactgggaagcggaggcagaaagatcatttgagcccagaagttcgagatcaaccctggcaacacagccaagacctcatctctacaaaaactcaaaaagtagccaggtccaggccaggggcagggcctcacacctgtaatccagcactttgggaggctgaggcagacagatcaactgaggccagaagttccagaccagtctggcctacatggtgaaacctcatctccactaaaaaatacaaaagtcagctaggtgtagtggtgcacacctgtggtctcagctactcaggaggctgagtcacaacaatcgcttgaacctgggaggcagaggttggcaatgagccgagatgctgggcaatagagcaagaccctgccccaaaaaaaaaaaaaaaaaaaagaaaaaaaaattagccaggtctagtgacacacacctgtagtcccagctactcaggatcctgaggtggtagaatcactcgagcctgggaggtcaagactgcagccagccgtggtcacatcactgcactccagcctaggcaacagcgagaccttgtctcaaaaaaagaaaaaaaaaccaaggctgggcgcggtggctcatgcctgtaatcccagaattttgggaggctgagcgggtggatcacctgaagccaggagtttgagaccaacctgaccaatatggtgaaaccctgactctactaaaaacataaaaattggtcgggcatggtggcatgcgcctgtagtcccagctactcaggaggctgagacaggagaactgcttgaacccaggaggctgaggctgcagtgagccgagatcgagccactgcactccagccctccagcctgggtgacagagcaagacttggtctcaaaaaaaaaaaaaaaaaaaaaaaagcaaaggatcaggaatggaaaaagggataaaaactaacatcagaaataacagattagggtaatcccagcactctgggaggtgaggcaggcggatcacctgaggtcaggagtttgagaccagcctgggcagtatagcaagaccccatctctaaaaaaatagaaaaattagacaggtgtggtggcttgcacctggaatcccaacactttggggtgccgaggcgggcggatcacctgacgtccggagttcaagaccagcctggccaacatggtgaaacctgtctctacaaaaaatagaaaaattagacaggtgtggtggctcacacctggaatcccagcactttgagaggccgaggcgtgcagatcactctgagctataacagatgtgaagactcagtgctcggtggtgcccaggctggagtgcagtggcgtggtctcggctcgctacaaccccgtctgggaagtgaggagcgtctctgcctggccacccatcgtctgggatgtggggagcccctctgcctggctgcccagtctgggaggtgaggagcgtctccgaccggccgccatcccatctaggaggtgaggagcgcctctttccggccgccatcacatctaggaagtgaggagcgtctctgcccggccgcccatcatctgagatgtggggagcacctctgccccgccgccccgtctgggatgtgaggagcacctctgccccgccacgaccccgtctgggaggtgaggagcatctctgccccgccgccccgtctgagaagtgaggagaccctctgcccggcaaccaccccgtctgagaagtgaggagaccctccacccggcagctgccccgtctgagaaatgaggagcctctccgcccggcagccaccccgtctgggaagtgaggagcgtctccgcccggccagccgccccgtccgggagggaggtggggggggtcagccccccgccggccagccgcccggtccgggagggaggtggggggggtcagccccccgcccggccagccgccgcgtcccggagggaggtgggggggtcagccccccgcctggccagccgccccgtccgggagggaggtaggcgggtcagccccccgcccggccagccgccccgtcagggagggaggtggggggttcagccccccgccaggccagccgccccgtccgggagggaggtcggggcatcagcctcccgcccggccagccgccccgtctgggaggtgaggggtgcctctgcctggccgcccctactgggaagtgaggagcccctctgcccggccagccgccccgtccgggagggaggtgggggggtcagccccccgcccggccagccgccccgtcagggagggaggtgggttcagccccccgccaggccagccgccccgtccgggagggaggtcggggcgtcagcctcccgcccggccagccgccccatctgggaggtgaggggcgcctctgcctggccgcccctactgggaagtgaggagcccctctgccaggccagccgccccgtccgggagggaggtggcggggtcagccccccgcccggccagccgccccgtccgggagggaggtgggggggtcagccccccgcccggccagccgccccgtccgggaggtgaggggcgcctctgcccggccgcccctactgggaagtgaggagcccctctgcccggccagccgccccatccaggagggaggtgggggggtcaggccccgcccggccagccgccccgtctgggagggaggtggggggggtcagccccccgcccggccagccgccccgtctgggaggtgaggggcgcctctgcccggccgcccctactgggaagtgaggagcccctctgccaggccagccgccccgtccgggagggaggtggcggggtcagccccccgcccggccagccgccccgtccgggagggaggtgggggggtcagcccccgaccggccagcggccccgcccgggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgtactaagaaaacttctgccttgggatcctgttgatctgtgaccttacccccaaccctgtgctctctgaaacatgtgctgtgtccactcagggttaaacggattaagggcggtgcaagatgtgctttgttaaacagatgcttgaaggcagcatgctcgttaagagtcatcaccactccctaatctcaagtacccagggacacaaatactgcggaaggccgcagggtcctctgcctaggaaaaccagagacctttgttcacttgtttatctgctgaccttccctccactattgtcctatgaccctgccaaatccccctctgtgagaaacacccaagaattatcaataaaaaataaataaatttaaaaaaaaaaaaaaaaagaaataacagattaggtggttccatggtgtaatggtgagcactctggactctgaatccagaaataacagatatatcagaaagccaatcaatacaatcaaccacatctcaaaaaaatccaagaaaattcagtagttatacacgtctctaatggagtcttggcaaaagaaaaacagaagcttccttgattcgataaaaggtatctacaaagcctacaccatgcttaatgaggaaaggttgaacatttttcccttgagatgagaaacaagacaaagatggccctataaagtcctatcaacattatgctggagatctcaggcagcaaaggaaagcaggaaaaaaataaaaggtataaggattagaaacaagagacaaaattgtcattatttgcatatgacataattatatatataggaaatccagaagaatctacagataaattcaaattatatatggttttttttgttgttgtttctttgttttttgagatggaatctcactctgtcacccaggctggagtgcagtggtgcgatctctgttcactgaacctccactcccgggttcaagtgattctcctcggctgaggaaggagaatcacttgagcctggcaggcggaggttgcagtgagccaagattgcgccactgcactccagcctgggtggcagagtaagactaagtctcaagaaaaaaaaaaagcagcagcagaagcagaagcagcagcagaagcagcagcagcagaaggagaagcagaggcagcagcagaagcagcagcaagcagcagcagcagaagcagaagcagcagcaagcagcagcagcagaagcagaagcagcagcaagcagagacagaagcagcagcagaagcagaagcagcagcagcagaagcagcagcaagcagcaagcagcagcagaagcagcagcagcagaagcagaagcagcagcagaagaagaagcagcagcagaagcagaagcagcgcagaagcagaagcagtggcagcagaagcagcagaagcagtggaagcagaagcagcagaagcagtggaagcagaagcagcagaagcagtggaagcagaagcagcagaagcagtggaagcagaagaagcaacagaagaagcagaagaagaaacagaagaagcagaagtaacagaagaagcagcagcagaagcagaagaatttcacaaatactgaactaattttttagattacataatatacacatagtattattatatgcacatgaagttcaaaaacaaggaaaactatattgtttaaggatgtatagctaggacttaaaattatgaagcaaagcaaaaaacagtcacaaaggtcaggataataactacctccactgaggggggatatgttgacaaggatggtgaggttggagggaagcacttctggcttgttgacctgggcaatgacaacactaatattcactttattatttcccttaaactgaacattttatgccttctcttgtatacagatggtccacaacttatgacggttcaacttacagtttttcaactttagcacagtgcaaaatcgatatgcattcagtagaaaccatacttcaaattttgaatttttatcttttcccaggctagcaatatgcagtatgatactttctcataatgctgggcagcagcagaaagcagcagctctcacaagggtaaacaactgatcctcaatagtatatactgtgttgccagatgattctgtccaactgtaggctaatgtgttctgagcgcatttaaggaaggctaagctaagctattatatttggtaggttaggtgtaataaatgcattttcgacttatggtattttcaacttacaatgggtttatcaggatgtaaccccactgtaagtaaggaagcatcagtatatgaatgaaaaggaaaaataacaactgcatgtaactagtatggtaatttaatatacggtaatataagtctggtacctagtgtgcattttttaaaagctaccataattacaaaatgttctgtatcctccccagtgcctacacatcaggaagttggtcatggtagatgctcaaatattttgatcaataaatgaaacaacttccattctgattaaacgaagtaaaagacaatttagatctgaatgattccctaaaccaactgtcattctacaagcccagagactgaattctttatatcccaacagactattccctctgcctttagcattttcctgatctctttctcttcattcataggatacatctgttctgccctactatactgtaagaagctgtacattaaatgcttagaatcctatacataatctgagatttaagacaaaaaaagagaaagaagaaaggttaaagttaaggggaaatggtacataagatgtacataagagcagaattttcaggaaaacccagtgaagatacaatgtatccttacatgaaaacattcaagacatgggcttttttttagttctaatgattcaaggagtcaggaaacagtgaaataaagcaggaaacagtgaaataaagcaggcaaatcatctactgtcccttcagacctaggtaccataccaaaatatatctactgtttttttcctaaaattatctcaacaacaacaaaacagaacaaagatacctctgaaagctacaagactcttctggaaaaaatcagctccttctcagtcacttgggaaaaacacttttttctttttccttttttctcttttaagagacagggtcttgctctattgcccaggctgttggactactaccgtggcatgatcattatggctcagtgtaacctcgaactcctgggctcaagtgatcctcccatgtcagccttcccagtagctaggaccacaggcacacaccacaatgcttggctagttcttttgtttgttttggtagagacagggtctcattatgttgcccaagctggtttcaaactgctggcctcaagcaaccttactgcctcagcctcccgaaatgctgggaaagcttttttttttttttttttttttttgagacagtttccctcttgttgcccaggctggagcacaatggcatgatcttggctcaccgcaacttccgcctcccaggttgaagcgattctcctgcctcagcctccctagtagctgggattacaggcatgtgccaccacgcccagctaattttgtatttttagtagagatggggtttctacatgttggtcaggctggtcttgaactctcaacctcaggtgatccaccggcctcggcctcccaaagtgctgggattacaggcataagccaccatgccctgcggggaaagctttattttttaatcaatttattcaatatgtattacttacacatagttcaaaagattaaacataaatatccttcagaaccaaactcactgaataaaactatggtacatccgtataatagaatattgtgtctccgtaaaaaagaatgagaaacatcttatataccaatacgaagtcctctccagcatacagtaagtggaaaaaaaagaaaaggtacagaacagaatacatggtatgctacctttagcatatgaaaagagaatacatatattttatttttgaaagaaaaatattaggatgattaatcaaagacttacaaaaatggttacgtatagaggagtgagaaaacaggatgaaaaagatggggatgaaaatgagattcctggccaggcacaatgactcatgcctgtaatctcagcactctgggaggctgagacaggaggactgcttgaggccaggagttcaaaaccagcctgggcaacatagcaagaccccatccctactaaaataaaatgtaatttaaaaaaataattaggaaggcacagtggcacgcacctatagtattagctactcagaaggctaaggcagaaggatggcttgaacccaagagttcaaggctgcagtgatgtatgattgtgccactgcacttgctctatcactccagcctgggtgacagagcaagacctcatctctaaaaacatttaagaaaataaaaatcctttttttatatggtttctctttctgaactatgtaagtgctttacatattcaaagaataaaatcaagggtttttttttattttttttttgaaatagggtttcactctgtcacccaggttggagtgcagcagcgcaatcacaggtcactgcagcctcaacctcctgggctcaagcaaacctcccaccttaggctcccaaagtgctgggattacaggcgtgagccatagcacccagccaaattaagtctaaaaacaggaaaagcaaatcctaaaataaaataagtagacctaactgcatattaaactggtaacaatcaaactgagaaaatcattatttcaagtgacttttgaacatagtactacttacaataggtacattcttagtaggatacagtctaaggacaaaaagaaatgcaaagaaattttgagtctcactgagcagtttcatttatttttgaaactattttataaatacttagaaaaaacatacatcaatgttaataaaaactatgattttcaacgtaaaggagattaaaacaaaaataatttaacaaactaaaaggaggaggaggaagaagagtagggagaagagaaggaagaaacccataatgttaaacttgagtaagaattatcaagatgatatcatgctttttactccctcctgtcaagagcctcaatgacagcccaataacaaggagcatacttagcacctaaatagtggtttctaaatacaatctcggcagagtgtagtgactcatgcctgtaatcctagcactttgggaggctgaggcaggcagatcacctgaggtcaggagtcccagaccagcctggtcaacatggtgaaaccctgtctctactaaaaatacaaaaattagcgaagtatagtggcgcgcgcctgtaatcccagctactccagaggctgaggcaggagaatcacttgaaccccggaggcagaagttgcagtgagccaaaatcgtgccactgcactccagcctgggcgacagagcaagactttgcccctcccctccaaaaaatattttttttaattaaataaatatataaataaatacaatcctccactgtaagaagacaaagcttcttggagaaattgctgattccaagtctaaagcaggaaaagtccatggtgagccaagatatcgtgtacccaaaagtaaggaatcattcaaagactaatgggttcaggaaaaaataattcaggaacctgtttgaagaagctcccactgtccttatttgagacaatttgagcatcaaaaaaaaaaaaacgtctgcaaatgactataatacaacaaaagtcatgagaccattaaaaacctcatttgctactattgtagatgactattacacaaatcctcactctaaaaattaaggaaaaaattaagcatttactgttctcttttaataggaactgttgttcactcccagttgataaaggttacaaagctcttattaactgaagaataactaataaatgaaaaagaattacagaattagaaaaatcgccattttgcaatccttaattaaatacctaaggatcaaaaaagatgctaaaattattagagaaagaatactgagaaatggaatatttgtatggtaccaaagtatcagtcccacagattattgtacataacaggagaaaaaatttacttttaaaatggagacataagcaaacaccaccttaaacctatcgaacttacatcactgataggaggacagctgacattatgtgcctcccattaacacacaacatgatatacaacatcacctacagagtgttcttgccaaaactttttaatatgaatctattcaatcctttacaatataacttccagtttacaggacatacaagcaccagaagaacaagttaaacaatctaagaaacaatcagaaaactctagaaaacaggccattctacaagatgattggtctcttcaaagacatttcaatgtcacagggaagagaaatgtgggaaggaacttcctacattgagagactaaaaagagataatcaaatgaaatgcaaaaactaaaagtgagttctcttttgaaaaaaacatttttcaggacagttgggaaaattcaaatataaattcaatattaaattagggtattatttttcctaggtgttggtaatagcacactggtgatacgaaaaatatgtatttcttagaaaatatatacgaagtattttgcagtaaacttgtcatgacacatacatttttttttttttttttgagacagagtttcactcttgtcacccaggctggagggcaatggtgcaatctcagctcaccacaacctccacctcccaggttgaagtgattctcctgcctcagtctcccgagtagctgggattataagcacccaccaccacgcccagctaatttttgtatttttagtaaagacagggtttcaccatgttggccaggctggtctcaaactcctgacctcaggtgatccacctgcctcggctttccaaagtgctggggttacagatgtgagtcacggcacccagccgcaacttactttcaaaaggttctgcaaaaatatatacaatcacagccgggcgtggtggctcaggcctgtaatcccagcattctgggaggccgaggcagcaggcagatcatgaggtcaggaggtcgagaccatcctgactaacaccgtgaaacgccacctctactaaaaatataaaaaattagccaggcgtggtggcgggtgcctgtagtcccagctactcgggaggctgaggcaggagaatggtgtgaacccaggaggtggagcatgcagtgagccaagatcatgccactgcactccagcctgggtgacagagcaaggctctgtctaaaaaaaaaaaaaaaatacacacacacaatcacacagggaacaataatgcaaatatggatggcataacgctatcttttgaatctagttgatagacataattagtgttctcttccaacttttctatttctttaagatcttaattataaaacaataggggagggaagaaagagaactaaaagaaaacagagttgcaaaagcaaaataagacaaaaatattagtcgggtgcagtggttcacgcctgtaatcacagcattttgggaggccaaggcaggcggatcgcttgaggtcagcagtttgagaccagtctggccaatatggtgaaaccctgtctctattaaaaatacaaaaattagctgagtgtggtggcacacacctgtaatcccagctacttgggacgctgaggcacaagaatcaagaatcacttgaacctcgaaagtggaggctgcagtgagccaagatcgcaccactgcactgtagcctgggcgacagagcaagactctgtctcacaaaaaaataaataaataaataaggcaaaaaaaatctaaaaatcgtttataaacatgtccacacagtcacctaagaactttctcccttacattaaaaaaaaaaaaaaaatctagccaggcagcgtagtggcacacatctgtagtaccagctactcaggaggttgaagtgggaggactgcttgagcccaggagcttgagtccagcctgggcaatacagtgagatgctgtctcaagaaaaaaacaaaaaggaaattccaggccgggtgtggtggctcacacctgtaatcccagcactttgggaggccgaggcaggtagattacctgaggtcagcagttgaagaccttcctggccaacatggcaaaaccccatctctactaaaaatacaaaaattagctgggcacggtggcaggcacctgtaatcccagctacttgggaggctgaggcaggagaatcacttgaacccggaagccggaggttgcagtgagccgaaattgcaccactgcactccagcctgggagacagagcaagactccatctcaaaaaaaaaaaaaaaaaaaaaaagaaaattccagagattactcagcccactatcatctgatcaataaaaataaacagatttcaaacaaatacttacacactacaaacagcaatagtactaaaatctgtcaattatttaaggaatgtttgtcattgacaaacagaacacattttgttatgataactcacactgaatcaaatacattctaaaatccattaatcttatatgctaagacatcaagagaagcatttctttgcagtattttttcaaaaatattttttaaatgccccaatgccacaagaaatattttaactgaaaaaaatcacacttgaaagacaactagtagacagactgccctaatatctgcttcttttagcaacaaactttgattagccatttattctaaaagccacacagtgaaattcttaaaattcttgatttcggccgggcatggtggctcacgcctgtaatcccagcactttgggaggccgaagcgggcggatcacaaggtcaggagatcgagaccatcctgactaacatggtgaagccctgtctctactaaaaatacaaaaaattagccgggagtggtggcaggtgcctgtattcccagctactcgggaggctgaggcaggagaatggcgtgaacctgggaggcagagcttgcagtgagccgagattgcacccctgcactccagcctgggcaacagagcgagactccatctcaaaaaaaaaaaaaaattattgatttcacatttaaacataacaagaaataggctgcgcacagtggctcacacctataatcccagcattttgggaggccaaggcaggcagatcgcttgaggtcaggagttcaagaccagcttggtcaatatggtgaaatcctgtctctactaaaaatacaaaattagccgggcatggtggcgtgcacctgtagtcccagctactcgggaggctgaggcacgagaatcacttgaacccaggaggcagaggttgcagtgagccgagattgcgccactgcactccagcctgggtgacagagtgagattgtcttaaaaaaaaaaaaaaattaataaataaaacaggaaatagacgtattcaagagggaaaaggaagacttactgagtacctactatatgcttggtgctttacataaaaatttttttaactccaatgatagtcttatgaggcaaatattacccccaattttttttttttttttgaggcagggtctcactctgttgcccagcctggagtacaatggcatgattacagatcactgcagcctcgacctcccaggttcaagtgatcctcccacctcagcctcccaagtagctaggaccataggtgaatgccaccacactcagctatttaataataattttgtcatttttgtagagacaaggtctcctatgttgcccaggctggtctcaaactcctaggctcaactgatcctcctacctccacctctgcctcccaattatccccaattgagagatgaaaattctgacaagctctcaaacgttaactgacttgcccataaatgacagttccaaagttataaggctagaacttgaatccaggtctgttagaaatctaggtttgagaatccatattctctccacttaatggatttaagattcacagatataaaagcctatctaaggaaaaagaatatttaaaagaatacagttatatattcaaagagctacacaatcttacagtttaagaaaaatcaaaactgagaaaaagtatgctccaaaattattgctaattgtaaaaaaaaataaataaataaaaaaaacacacacaatttttagcaagccagctgtctatgacaggacagctagtccattcctcactgtacatgtaaaattacacttcagttgcccgctggatgaccccactgccaaaatacgccagcaacataattcacattaaaacccagaggcctaacactatttggaaagtgctttacatgtttactatacctatcccaagcatatttaccactcataattcataggccattttcagcaaatatactttgttctatcatattattttctgccactctaaaatcatattaaatgtataaaacaaaaacacctacctaaatataacatctcacaaataaaccttagtagtattatgttattttgaacttgtctattgtatgaaactatgccataattgtttctataacataaattaggtatgttctttctacaggatcaaaattccaatacctacactccttgcatgtctaaagatacacacaaaataggtacagaaacctatatgttaaagggtttcccatgtaaattaaatcctctatgagctggattagtgactagaagaaggcatgaggcagcttgtagagttctagtgatattctatatcttgatgtagatgttagttacactggtatgttcttagtgaaaattcactgagctatatatttaccagctgtgtactttttgtatattttataatttataaagtcttatatttttaggctgggcacagtggctcagcctgtaatcctagcactttcaaaggctgaggcaggaggatggctctagtccaggagtttaagaccagcctgggcaacacagtgagaccctattttttctgaacttatattttttaaaatgctcaatctaaaaacttgttttactaaaaagcactgatatcatccctcttaccaaagtagtcaaaccctagtgaagaaaacagacaagtaattaagctatttcattagaggactatgatagaagtaattactatgtgctacaggagcacataagaatggtacctaacttaatctgaaaagaggtaaaggaaatcttcctgaagaatatacacctgaactgaatcctaaaggtcagacagaaattagccaagcaaagaaaggggaaagtggaaatcagggaaatagaacatcaaatgtaaaagacgagagagaaagcacattacctgagaggaagcctaaagtcagtaagagtggattaaagtatgtaaggaagacagcaagtgaagaaaagctagagaattaagagttagatcatgaatgatctcatacacatgccatgctacagtttaaactctatcctgaaagcaatgagacagcttttttgaagattattcaataggaaaggacatgatttgatttttatctgtactatacatgtcaaaattatggtgtgggccatgctcacaaccccattttgcggtaaattagcctgcacactgtcccatactttccaccattaagatctttcctgatacccatatatacatacaaacacacagccaacaataaatggccaagagtggtgacataacctaagtacacagacttgttagcaatcaatgagaaaaagagctgagccaaatctggaattcaaaccagaaaatcctagggaaaaggaagaggttagcaacaggagctaacctcttttaaaacgttttaaaacaattgcagccaggaggcaagatgttggcatgggggtcacatagtagttataaggagcagaaattagtaataaatggaagctatgacatagggggaaaaaaactgaagaaagaaacggtatctaggacaagctaacaatggagcactggagtggggtctccagctttattaggttcttgttcttcttgagagcaagttttattaggttctttttcttcttgagagcaagttaacttttcctgggttcccttgtgtatggttcctttcaataagcacttcattacttaaggtaacttgagtctcttccctccaagtgaaagagcctgactaaaagagcattttagaatacttactccaacagcagtcaagagaatgaacaggagggcatgacaagaggcagaagacagaaggcaagaagaccactcagcattacagaagcccaacaaacagatattttcagttaaaataagatagaggcaacaaaaagtaataaggaatgacctgaaatatcatgagggaaaatgtacaaggcagtgacagactggatgttggcagtgaagtacagagtgaagcggagggcaattcccaggttcctgaaggtttcatgaggaaagagtggtgccattaatcaaggtaggaaatcggggggaagaaaaaattttgttgcagtttctgtctccggctctctctccactgtttttgtggggggaaaagaggcaggaagagttttgtttcctaaatgtttggattgaagtgtttgtgaaatgtgaatcaaagtggtgatatccattaggcagtgcttttacaggggtctagagcaaaggcaagcactctagacagcagttctagacttaggaatcaatacattaagtcaatattgtggtttttaaaatgtctgaaaagtctttgactaatatttatttcaaactgagttaacataaccaaaaatcactccaactaaaaaccttaatattcttggcaaatcatattttcaaacctcctacatttctctgctattaaagactgaacaaacttccacatagtataatccaaatgattaggaaagatggagtttatatcgctaacttctattgaggtacttgttaaaaaaaatctaagtttacccaatttccctcaggaactatatactactaaaataactaagggaaaacaactgttaaaaattcatatattagatagtgaatctcactgttaatgcttaaactagaataagttttttaaaggcacttaatcatgtaatttactaatttaaatattcaactctacctgtaatttaaatgttgggtttccatcctaaaaccttttctcctcccttctgtatgattttgcctccaaaatctactgctatcaacccagaacctgatactgagcttcagccacaaatccaaatgcctaatggtcatctacatctgacagaactacagtcacctaaactgaacatgtcacaaattaacccctctatccttcctccttgacaaaataaaaacaaaatcccactccttcatgggaatccccacctcagtgaaaggcacaagccagaaacctagattttatcctgtatgcaacttctccccaaccccaaatacaataaaatcaccaactcaactccgaatatccaagttcagatccagtctcaccatttgcctggataaccctaatattcctggcctttagtcttattctactcttcaattcactgcagccagaatgacttttttaaaatgcaaatctgatcattccagtcccctgctttaaaatccttcaataatttaataaatattataatcatcatcacagctagtcacactgtggaagctcagaggttcaatgagaaatttagttacatcctttctgtaggttcaacataaaagaatcatcaggaatttttttcaactcacaaaattatttaaacatacatataacatcagacacatttaaaagaaaagcatgtaacattgttggtaaaagcaaaacaccaaaaataacctccagtccacaaaaatggaatactatccagccagtaaatgaggcacttccatatgtattgttaagaaatgacctctaggatgtagtattaagtaaaaaaaacaggctatgtatagaatgtaaagtatgcaaccatttgtgtacagtgtcttaaaaatataaatgtgtaggtttatatattggaaatatcacagaaaggatacacatgaagctggaaatagtggttgcctctaaagaggaaaaatgggtggctggagagtgaaggcggaacagaaatttttactacattactcttccgaaacttttggcttttacgtctagttattatctataattttaatgtgattttctcctgttactttaacattttttactgtgtgtgtgtgtatgactacaaagacctctttatatttcatctttataccaatattaaaattacgtactgatcatttgatgcaacattacatttctttcttgacaactcaggagctcaacttctacaaacattttattcaacattttactgctattgagaaggctgttgttggtaatgacctcagtgaacactgcatgatttctgtacttgcttcttggagaagcaagacagcagcaccaggcaacagaagtttattattaaaccgacatcgaagcattcagggattaaggaatgctacaaatcttatttttctagcaaatccaaaaaacagtgaatccaaaaaaagtcccctagtatcctttaaaaataaaaataagaaacagttctagtatctgcagcaatcgacaaggaggtgaagtaatactacaagacgacatagttatatccactagtgcaacgtgatttaatccttacagaggtccctaaaacatcagtgctggacaacctcacacgttctacacagaacagacaagacgaggtgcaggctctgtgaccttataatggcacacacacaactggcctcatgcttccataacttcactctgcctcccacttttttcagcccaacccctccaaacatgggtctcggtcggtccccttaagccacaatggagggaatacattaggctaagcaaatattccctcaggatttcatggcaaagccctttcaaccaaagaaaggatcgcgactaaggagaaagataacaaggtttgcttgaggagaggtctgttgagagaggctacagtcggtggtgggagagaagccaaagtctgtgacggtgtctagagggactgacaccacatctaccgggagtaagaacaccatgacagcggctatctgaaagccgtgatggctagggttagtgctagtcggcttggtgatgagcgagctgggaggggttctactaagaagagtagggcgaggggcacatgggggacgcaatgggttagggggcggtcgagactttgcctgagaactgtaatcacgtcagcccaagggaggatgtaacgtagtctagaagctccattaagagtcctaagggactctgaggggtactaatggggtctgctgggttggggggaccgtgacagaatctccggggaggctggagggccggaatggtgcccggccaatggaagatacagggggtggggtctactggggatccggggccgtgatctggtgtttgggaggctcggcgcagacccgctcgcggggcgtctccgctgggacggggcggggcggcccgaccggagccaaatagcgaggctgagacgtgggccaggacgggctgcagggccgctgggcgcttgggcgggtcttacctcgggctccgccgcggtggccaccgcagccccctcctcttcgacggaagctgccttccaccctccgccccagggtaggaccggagatggcagaagaggccgaggccaccgagggtcggacggttccgggagggtgggcccagcagcctcagggtccgggcgagcggccgcggcgcatcccccgccctgtcagagagactccgcccggcctgagcaggcacatcccccgccgcaccccgcccagagagcacgcgttggaccgccgcctcaaccgctgccagcggccgcctctgccggtgcaactactgcctccgccgccgcctctcgcagtccgggctgtcctgtactctctcaacagacacagccaaccgccgccgcgtcccttatccgcttcggtcgcgcgcccccgaccccgcgcacgcggccccgccccgcgcgactccccggctgcaggcgagcaggcgcgcgcgcacttacctcccacgccccctactgccagcacgggtcggccccgccctgtcccgcccccgcacgtgacgccactggagagtacagcgtgcgcttgcgcagacacgccccctttcctacgccccaggcggccccgcccaaattttttcttcttcaccttacggcagagcagggaactcagctttagattctccctgtactggaaagggatgtcgcaaggttggggacgaaacctctgagtttgcgaccgtagctgtcgctttccggccaacacagaggtgcctgaaggctggttggggtggtgaggcccgaggcaggtaagaagcctcctccccacttcggtttgtctcggcagtggatcgctctcccacccactcagattctggcgtatccgtgctccctcccgattctggacctggattctcagcgccgccggtcatagcccccgccccttttcaaacacgcacgctctctccacccactgccccctccattgtccccgccccgacctccgtttccattcatttctcagacttttcactgagtggtttccatgccttgggttccagaatgtcagaggcgaattaagtggtgtcagctttttgaagtgcttttgtataggagaccgtgagagaatccgcagtggtagtacaataaagtgacaatagagaaaaatgcacgggatgctgtctgcgcacagaagaggggtcccaggttgtgtaggaggataacgtgaggaagccctttccagggtgacttttgggtcacttttagaggactgtgttaaaagactagtaatccagtacctggtcaaagaaatacgaaaggaggtaaaagcagaataacgggcgcaagagcatgtgacagtggtggtctgaaagagaaaaaagaagtaaaataaacctgatggaaaccgtactagtgtagacttccctttaaagaagcatcgttataaagttagagaaatgaggaacgagaatatggccctcaggaatgttttctgtttaggtagaagactcaaaagcgtaccatgaaaccgagaagtggcctcttcgagggtgagggaggctaatttataagatcaagatcactagtggaacgcaaccttgtatgtgcatttgaatcacctgggaaactttttgttaaataaaaccaatactgttgccccactctagaccaattaaattctgggttgtgccaggtgtcattactgttttaaagctccacaggtgactctaatgctaaagattgagactcactaaactagagagaaggaagttgagacagttggctctgtaacattaagatggaggtcatttagccgggcgcggtggctcacgcctgtaatcccagcactttgggaggccgaggcgggtggatcacgaggtcaagagatcgagaccatccaggccaacatggtgaaacctcgtctctactaaatatacaaaaaattagccgggcgtggtagcaggcgcctgtagtcccagctactcgggaggccaaggcaggagaatggcatgaacccggaaggcggagcttgcagtgagccaagatcgcgccactgcactccagcctgggtgacagagcgagactccgtccccgcccccagaaaaaaaagatggaggtcatttaactacagagaggcttggagatggaatgagaaacttgagcggcgttatgtttggaataactggtctgggaaatgggagaaggagccactcttgcctttctcttcagcactgttcattcctcagtgtttatcaggtccaaattagttacttgtctctttgctctcccgttcccttccgtccaggattggtcagctgttgtctccagccttaaagctcaaaggccatccccacttctgtccccaaaatgatcagagctaagccaatttatgagatgcagagaccaacatccagagctaagccaatttatgagatgcaaagaccaacatccactctcatagagattactacatacagtgccttgccaatttagaatctttttctattatttatcatttaagttagtaatgagatataaagatatttaaaatacagctcaattaggatggaaaattaccgtattagggaaagcaggcctttaaacaaagaattcacttggcaggcagagaagctgtatgaggtaaagaccaagacagtgtatggctgctatctattaactagggttaatccaaaaacctgtctatcagacccagataagaacgagttattgttgtctagtatggctagagcatagtatggagagtagaggtgggacagagatgaagatgataaagtgggtgtgaacagattatgaggagccttgaattccatggtgaagagtttagattatattactagaagtaattaataagtacaaaaaaggttcttaacctcttttacccagtggaccttgttggcagtccaccttatagattcagtctcagaaaaatgttcttaaatatataaaatagaatacgtagtaatataaaggaaactaattttgttaagtttttaaaatattaaaacaaatgtgtgatatatatgcactttatgcattaaataaaatctggcagcaggtctaattatataatttctaagtagtgatgactataaattatattttgaaatgcctgcagcaactttaatgtgatgtgaaaatatcagatttctattggtaaaaaagagagtgctaatattgtagtttgtggtccacacttattgaagaaatgctaaatttcagctactgattattgaaaacaaagatgcaattgttttcccagtctaagttcacagaaccctgatattctagccacatcctggtctatggatcctaagttttaaaatatctcagtataatggttttaagcaagagcatgacatcaaatctgtgtttcagaaaaatgatgaagcagtgttcacttcccaacctctctgctgggatgagaggctggctctggggcagcaaccagtactatcccactgtttcctaataaccagggcctgcagagggactgagcttgtgggtgtatatgtctgtgagagtaataccagaaaataaatcaggaaaggtagattggggctatttttgtggaaatcattgaatgccaggctgtaatttgtagttactttggtagacaatggagggttgttaaaattttttggagtagaataatgtgattagagttctgtttgaaaatctagaataatgtgcaggttagattatcaaaagagaagataggaatgaagagactagaacaataagttaattaatttttgaaaaatggaatcttgggccaggtgcagtggctcaggcctgtaatcccagcacttggggaggctgaggcaggaggatcacttgagcccaggagttcaagaccagcctgggcaacaaagtgagaccgtgtctctccaaaaaaaaaaaaagaaaattagccagacatagtggtgcctgcctgtggtcccatctacacgggagactgaagcaggaggattacatgagcccaggaggtcgaggctgcagtgttcatgccactgcactccagcctgagtgacagagagcctgtctccaaaaaaaatcttgaggtgatctctagagtctgctaaattcctttatttccacaatgtgctgaccagtctagagtaacatacattggaataaatggcatacctgtcaacaggaatatataccccagtgtgggagtcagttaactttatgtggtcaagaggctagcccagtcttttgtattataaatgatattgttagtacttctaataaagcaatggccttaccataagttcacagatcttgccaaggccttcctcagtcaaactccatctatacctgtgagtcctacatttctgacttttaaaagtcagaacctgtctatacctgtgagtcctacatttctgtcttttaaaagtcagaactcctctctttttgccaattccttaaacttcttggatgggaaagaagtttagtttaaacacattagcaaaagaatgggaggtcctcaaggcccaggcaacccatctcctttgaaactgatcaataccggactataaaaacttactgctcaaatccagctagtacccaaagtatgtactgtctatatacctgtctatacctgtgagtcctacatttctgacttttaaaagtcagaactcctctctttttgccaattccttaaacttcttggatgggaaagaagtttagtttaaacacattagcaaaagaatgtgaagtcctcaaggcccaggcaacccatctcctttgaaactgatcaataccggactatagaaacttactgctcaaatccagctagtacccaaagtatgtactttttaaatgtattctaaaaaattgaatttggggtttaggtattactgatccaaatgagtcctataaaattaacttccagaactaggttctcagagaggccaccattaccaccttcttcaacataactagcctatattgactttctgtccatcaaataattggaggccatttgggtggtgataggaagaattaagtttatgcagaacttgaggttcagctatctgacaccttttgcgggaggaggaggagtgggtctatctgaaatcagaaataatacttttatgaggctttttaataatttttattacttacagaaaatttctgaaagttcctttctctggctcccaattaaatggcttactccacaatcaacttataaaagcactggatcattgtcttgatcccaaaaaatttgtcccaactatagttactattttgagcatctgtattattgtttgaaaaccttaggcttgctttccctgatggccaatgaataaaactctcaaagtcgtgtgattcattactcattaattcattagatatttattgaacctctactatgtgccaggcacatttttgaaacccactaatgagcaatttgtaatgacaatttacctcttaactatctatgaaaaaaataacttgccaggatttgaaatccttagaacaaatgagattaaaagatcatagcttttttgtgttctttcaaatagtgtgtttgcatagagctgccatgtgctgaccacagtgattatctgtgaaatgaggtaaatcatggctttaaccactccttatcagactttgttaccacatgtactaaaataaagttctgtctacacctttataaaatattatcttacacagacgtcttattaattctaatggcctctccacacctgaccctcactcctagtcatttcaaagtttgcaattgtgtaaagtcatttctcagaaaatttgaagcaaaacaaagtcaccacaagaaaaacttggtatacaccaggtttatattgaggacaaaaactgtgacacaattacaaatggaacttttttttttttttttgtgatggagttttgctcttgttccccaggctggagtgcagtggcgtgctcttggctcaccacaaccgccacctcctgggttcaagcaattctcctgcctcagcctcccgagtagctaggattacagttgtacactaccacgcctggctaattttgtatttttagtagagacagggtttctccatgttggtcaggctgatctagaacgcccgacctcaggtgatccacccgccttggcctcccaaagtgctgggattacaggcatgagccaccgcacccagcctacaaatggaactcttgaggtagaaatggtagaccaggaataaaattattttcatggtcaatgacaccttagccattgatagctgtgcctagttacagagcaataaatggagagccttggtgttagatgaaatcctaaaaagtcacctgttttatctccttggccccagacagaataaagtggaatttatagcagtagagttaccaagcatcatcatcacaccaagtaggttttgtactttgagagctgaattcctctctgaaatattgatgttacaggaatgttgtttaaattcatagctcatttataaaattgagaatatttcttacatttataactgtgttgtgttttcctgagtttttcaagatatgtttcacttctgtactttgctcactcaggaaaaatatttatttattaaaactctagcttgtcaggcactgaagttagaaggatgagtaaaatctaatctgtgtactcaagagggttatataataaatcttgatggtcattcttacatgccacattatacagatctccagatggcttaggcttagttttaaaaggaaacgttttaattggggggaaattgaaaccccaaaaaaaagccatgaacttccttcctggaaatatttttgccataaaaagcatatttggtcttggatgtgattctttttgtgaaagtgcaagttgaatcagacattagaagttggacataatcttctaattttagtaaacatcaaattatttttaaatatttgtgtttgaacatttatggaaaagagattagatttacctgttttatccagaggacagaagtaagactcagaagttgaaaaaatggaaatattttatgtcattataagagtgggaactggtacatcttttattcctcttcaatatggaaatcactgtatttactaattatgtgttcattattaaaaaagggggaaaaattaaagcacaatatcaaaaggtagaaggaaaaaggcaaaaaagtattaatcctatttcttaaaatgatatttacacttgatggatatcgttcttgattatttttctgtatatttttatcatatacagatgtttatatcaaagcatattatgaacatttttcttttaataaatttgtattgacaatattatatttaatggctgaaaactattccatcgtgtggaaaccctgttgtttaatttaccagtccttttttgaactccagattgtttccagtttttctgttacaaatactgccatggtgaatatcttgttgaatttttgcacacattgttaatgtctcccttaagttaaatttcttaaagtataatacctacatatataaatttcttaagaattccaatataatggcaaattacccttgaaaaagcttgcatgtatgacagtcctatcaaaatggggcatcatttactcatttcccataatctctcagcaatgctaattattattagttttcttcacctttgctaacttgacaggtaaaaaaatgaaattttattttaacttacatttatttgattactactctgatgtccagtgtcttttcatgtgtttattgactagtcatgtaagtgtattaactaatattttctaacaattttttttttactttttaacatttaaatttgtattctatctaaaatataatttgatgtaaggtatgaggtaaaactctttacttttttaatcaaataattaacaagttgtgccaatgctacttattaaaaaatccagcaagcatatcccatacttcaatatacagataataaagtactgatagatattcctccaaaaaaaagaaagactatttcgtggttaaataagtttgggaaaagatcatacgaaaaaaagttaaaattttttatcgccaaactctcgttagcctctagtgtgtgtgtgtgcattaggagttagcatttcctaatttaattaaccatgtaatcttttttcttttttatttatttatttattttatttatttatttttttgagatggagtctcactctgtcgcccaggctgtagtgcagtggggtgatctcggctcactgcaacctctgcctcccaggttcaagcaattctcctgcctctacctcccaagtaactgagattacaagtatgcactaccatatccaacttgttttgtattttcagtagagatggggttttgccatattggccaggcgggtctcaagctcctgacctcaggtgatctgcctgccttagcctcccaaagtgctgggattacaggtgtgagctattttttttaaccatgtaatctcacttcataggtatttcaggaaatacctatgaaagcctgtggaactgagctgtccagtatactagcactagccacatgtggctatttaaattttagttaattaaaattactcagttcttcagtcacactgaccatatttcaagaactcaatagccacaaggggctagtggctactgtattgaacattttgcagataaaagaaaatttccgggccaggcacagtggctgatgcctgtaatcccagcacgctgagaggccgaggtgggtggatcacaaggtcaggaattcaagaccagcctggccaagctggtgaaaccctgtctctactaaaaaactacaaaaaattagccaggcacagtggcagttgcctgtaatcccagctactcgggaggctgaagcaggagaatcgcttgaacccaggcagcagaggttgcagtgagccgagattgcgccactacactccagccggggcgacggagtgagactccatctcaaaaaataggaaaatttccgtcacaagaagtgctattggacagcactgctatgggaacataatgttcagtggaacacgtgaacacgctgaaaacactggaataatccataatttctcctgatttgtcaggcaaacatgattactactacactatgagaacagactctctcattgatttgtaaagactccatcatcatatttaaaatttctaatctacatatgatttttttatgctattgatttatctacttctgctccaataccacacccctagttttaagtcaaggttctgcacctttctctttcagagcagaaatgaagaattcttgcatggagtaggaaattagattagaagtgatagtaaaggcgctttcacttcccagactctaaatgtaaacatttctctgccgaacttgatttatattatgttgagctgtatactcaattacttattcatttattctacaattatttattgagtacctgcctggtaagcactgttttaggtcctggggttaaaatggcaaacaaggcagacaaggcccctcgtcgtcttattttcatagagcttacattcttgttttggagagggaaagagaagaggcagggggaggaaaaaagaatatgaaccaataaacaaataaattaaaaaactatcacatagtaatcagtgctattcaaggaattgaaattagagtgatagtaactggtggcctctttgttttggctgccctgagacctctgtgacttagtggcatttaaactaagatctgtccaaagaagaagctaattactagaaggtccaggcagagctagtaccaccctcaggagggaaaaagcttggtgtatttgaggagtaaaaagaaagtctttgtggctgggtcttagtgggcaagcagggaaataataggagataaggttggagaaatagctgaagccacattttcatgtagggttttgtaaactagggtagggaattttcatttttttctgagtatgatagctactagagactcctaagcagggaacagacctggcctaatttaaatttttaaacaattattttgatggagaatttattggcacagtcagtagtggaaataggagacctgttaggctaggtcaagaaagaaatggtgatagatttgactaaggtgatagtagtgaagatggaaagcattggacagatttagaacatttaggctatagaatcaacaggacttgtcaattggatgtgaagtgtgaagacaatagaaaactctgggatgagcctgggcaacatagtgagaccctgcctctataaaaaaaaatattaattagccagacatggtggtatgcacgtatagtgcatatagctacttggaaggccaaggtgggaggatcacttgagcccatcagttaaaggctgcagtgagctatgattgcaccactgcactccatcctgggcaacagagtgagacgttttcaaagaaagagagagggaaaggggagaggggagagagggaggggaggggaagaagaaaaaacagagagagagagaaagaaaaaaactaactcttggatgatgtctgtaatccattatatagtaaccaggttcaattttcagtctgattatggcaggcaaaattgggacacataagacaccaataaatatattttaaccaaatgaataaatttactttaataaatgtttctctcctgtacacatttaagctgctaaagcataagcttgtgctcattcctttattattagggaatctgactcctaagaatttgaggtttatgtcataaacacatcagctataggtaattattagactgttcccctgaagtatccaagccaacagaggagactgaatgaaacagaaaaaattgcctgccacagttgcaaaagttctgtgagattctcatattttatttttaaatttcatgctgattttgcattttatgcccaagtttatgttaataattaaaatatttttagttgctgatttaaatgttttaagtcaatgattaagtggtttagctctttcccctaaagttggtcaaattaaagctctaggaagatgccctgtgattaacttgtgtttgttttttggactttctttgttgctatctgctggcacatgggcatgtatccatttagagaagtacagatgcatctctgagcatttgtagtttggtacaacttaaaatcgtagccaaagcgagtgaggaaggcaatagcatttagaaacaactgacttttataatctgcacttactttgtaatgtttttaaaaaacatacctgaatgaggctgtttctctctttttatttttttaaggaatgcttactgaataattagaaaaaaatgagtaaaggtcacaattctggaatagtatgttttcagtaaaacagatttatctggagtactacttaagtcaatagccaacaggcttattttccctgaagttttgagaattgctgtatgccatataaaatccttgttaatttaaaactctaatacatattttaatcccataaaataaatacttatacatctataaaatagacaattatcgttaatatccattgtaaattagtatttttaagcatttccattcattaaaaatccagattgagtccaggtgaggtagctcacgcctatcaacccagcactttgggagggctagacaggaggatcactggagccaaggagttcaagacggcctgggcagcataatgagacctcatctctacaaatttttttttttttgagacagtttcgctgttgttgcccaggctggagtgcaatggtgccatttcggctcactgcagcctccgcctcctgggttcaagcgattctcctgcctcagcctcccgagtagctgggattacaggcatgcaccaccacacccggctaattttgtattttttttttttttttttttagtagagactgggtttctccatgttggtcaggctggtgtcaaactcctgacctcaggtgatccacccacctcggcctcccaaagtgctgggattacaggcatgagccactgcgtctggccacattttttttttttaattagccaggtgtggtgggaggcacctgtggtcccagctacttaggaggctaaggcaggaggatcacttgagcccaggaggtcaaggctgcagtggccgtgattgcaccactgcattccagcctgggggacagagtgagacccagtctaaaaaaaaagaaaaaaaaaatccagactgaaacagcaataacacctccagttaaaagttaatctggccaggcaccatagctcacacctataatcccagcattttgggaggccaaggtggtggatcacctgaggtcaggagtttgagaccagcctggccaacatggtgaaaccccgtctctactaaaaacaatacaaaaaattagccaagcattgtggtaggcacctctaatcccagctacctgggaggctgaggcaggagaatcacttgaacctgggaggcagaggttacagtgagctgagatcgcgccattgcactccagcctgagcaagaagagcgaaatgccatctcaaaagaaaaaagaaaagtcaatttatctggaaactgcctttaagatagtttaataaatgtccccagtgctttattagaattgtaaaagttcttaaaattaattcaacctggaaatttacagattacataacagtgatctagaatagggattggcaaactttttctctaaaaggccaaatagtaaatattttagactttgcagactactctgtccttagaggtcaaaagtagccataaacagtatgtgaacaaatgaacatgacttagtccaataaaactttatttatagaagcaggcagtgggccagatttggcctgcaaactgtaatttgctgacctttggactagaaaactagaatgttttaggatttttttttttttttttttttttgagacagagtttcgcccttgttccccaggctggagtgcaatggcgtgatctcggctcaccgcaacctccacctcccaggttcaagcaattctcctgcctcagcctcccaagtagctgcaattacaggcatgcgccaccatgcccagctaattttgtatttttaatagagacagggtttctccatgttggtcaggccagtctcgaactcccgacctcaggtgatccgcctgcctcagcctcccaaagtgctgggattacaggtgtgagccactgcgcccggcaggatttttataaacaggatgacagaatttaaaaattggcagagatgacagcttagaatcatagaatatagagctagtggaaacttagaaaagagctagtggaaacttagacatcagaataacttggaaatatcttaaaaatgcagaggcccagattctatcccaggtgtatgctctttaaaatccccacagataggtgggcatggtggtgcatgcctatagtcccagctactcaagaggctgaggcagaaggatggccttgagcccaagagttcaaggatgcagtgagctataatcacaccactgcactccagcatgggcgacacagcaagacctcatctcttaaaataatttttttaaatctcatagatgattctaatatgcttccctggctagaaccactgtttacctggtccagaccactcagtttacagatgatgaagctgaaattcataggttaagtgactcttccagagtcaaacaactggttaattgtagatctgaactgaatcccaggtctgactccctaactaatattttttctactgaaccagcagcttcttcccttgtatcagcaggccatcagaatgactcctattgaattgtgaattttcccttcaagttggtttttattactttttatttaattactttgttttttataacaaatattcaagtagtgtgcatcttaaggattttaggattaataagaagtaatctccttctattaaaattaatcctttgttaaggaagtgttctacacttatgaattcaatattagcttcatttaattacagaatttggaagatacaataaactaacccctgtaatgacagggtttgtgtatactgacaacacattaacatcattgcttcactcagattgagagaacaattttccctggacttagcattctctctctttatgccaaagataaagcacaagagcagagtcatgccatggctagttccatctttgataactttgtggctttatataaagagacaagtgctttattttcaagaaatctttggggtccattattgccacctcaaacatagggaacagggaaggaaactaagtttttttgagagcctactgtagatcagacaaggtgctgagtgttttcactcatgtttttaattcgtgtaacaacctgtgattatgttattactacctcatcttacagatgaggaaaatgaggcccagaaagaggaagaataacttgcccacgatcacttaaatagtaagtggcaaggtcagagcctagacccaagacttcctagccctaaaacatagaactatgtgtttggtaagattttacaaatagaactataaggaggtcattggctccccagttgactcacctttcttgcccttcccctagtcttgcttaccatccaccaagaccaagtacacagatccttttaactctaaacgaatttactattaacagcagaacaataaaggataacaggcaaagcataaaaccaaagaataaggatgttacaaagaatacagaaatcttaagtggccttatttctttttttcccgtaatctaaattttctgacttccctttaaaaatatttcattcatctggcaaacatttattgcacttcagatatgccaggcacagtgctcactacatagaaaatattcctaaatgattatagatggctcttggttttttgctaggtccccttccatctccttttctcccaccccattgataatgttattatcatcctctcactcacccccaactgaaaccttcagaccatttcataattctttttttttttttttttttttaaacagagtctcactctatcccccaggctggagggcagtggcgaggtctcggctcattgcaacctctgcctcccgttttatctaccctcctctgatcacttactgagtcttattgattctctgtctacaatatctattcctccacattcctactatcatttctcctgctttaggtcattacctcctacctttacttgcaataaaaatctaattgggctgggcacagtggctcatgcctgtaatcccagcactttgggagggcaaggcgggcggaacacctgaggtcaggaattcgagaccagcctggccaacatggtgaaaccccgtctctactaaaaatacaaaaattagccaggcatggtgccaggcacctgtaatcccagctacgcgggaggctgagacgggagaatcgcttgaacccgggaggcagaggttgcagtgagccaagattgcaccactgcaccccagcctgggcgacagagtgagactcacctcaaaacaaaagaaaaaaatatctaattgatctctgctttcaatttttcccttaccaattagttctatatattatagctgaattattatcttcccaaagcattgacctggccattaatggctcccacttcctccagtataaatttcaaactccttcactggaattcagtctgtcaccacttagcttctaagaatcctctaatatttgcctgcacctctactactcccacttcattctagcacgctagactattcaagattctctccacatttgaaagcactttctttacctctctgtcttccacatgcatccagctccacctgtccttcaagagcccacttttatgccactttcctcaaagccatttctgatctgagcactcattccttttcatcctgttagccaggaatgattattctctcttgtgaattcccatacattctgtttgtgcctcttatggatttcttatctcattgactagaagccaccttatacatctttgtatctcccatagcatctaatatgaggtgctcagtaggtatttattgactaaaataatggtatatgcagtacgtgttcattataacaaaataggtttaagctcagtaagggtagaaactatttcattctcactctatattgccaccccctgacacaaaggagaacactcagtagacctttgttaaatgaaatacattacagttatcagtcattgggttataaatttcctgatgccataatagatacctagaaacactttgtctttttttgtttatttgttttgggggttttgtttttttggatggagtctcgctctgtcacccaggctggagtgcagtggcgctatctagactcactgcaacctctgcctcctgggttcaagctgttcttgtgcctcagtctccctagtagctgggactacaggcacccaccatgccccgctaattttttgtattttagtagagacagagtttcaccatgttgcctgggctggtctcgaactcctaagctcaggcagtttgcctgccttggccttatgttgtattttaaaatcctagttatgtatgtttctttattttatattgacaaataccacatgataaaggtcatatattcttattctcactttaagctgggcacggtggctcacacctgtaatcctagcatttagtggggcagaggcaggaggataacttgagctcaggagtttgaaaccagcctgggcaacaaagtgagaccctgtctctacaaaaatttaaaaattagccaggcatggtggtacgcacctgcagtcctagctactctggaggcagaagccagaaacttgcttgaacctaggagtttgaggctgctccgagctatgattgtgccactgtgctccagcctgagcaacagagcgaaaccctgtctttaatataaaaataaaaaatactgccttttggcccaaaatgccatcttccagtaatttgccaaatgactaacacaaagggaaagaggagaggtatccaatatatgttctctaggccttggaaaaaacatggagttgttcctttggccatgtatatgcgaatctataagaaatatgatatcgtagacatcaaggaaatggatactgttcaaaaaggaatgtcccagaagtgttaccatggcaaaactggaagagtttacagtgatacccagcatgatgttggcattgttgtaagcaaacaagggccagattcttgccaagagaattaacgtgcatattgagtgcattaagcactctgagaacagagatagcttcctgaaatcgtgaaggaaaatgatcagaaaaagaaggaagccaaagagaaaagagcctgggttcaccctgaagcaccagcctgctccacccagagaagcacacttttttgtttgttttttgtttgtttttgagacagagtctggctctgtcacccaggctggaatgcaatggcgcaatctcagctcactgcaacctctgcctcccgtgttcaagcgattctcctgcctcagcctcccgagtagttgggattacaggcacccaccaccacgcccggctaatttttgtatttttagtagagacgaggtttcaccatgttggtcaggctggtctcgaactcctggcctcaagtgatccgcccacctcatcctcccaaagtactgggattacaggtgtgagccaccatgcccagcctcagagaagcacactttgtgagaaataatagaaagaagcctgggctgctggtaggtgttaaaaaaaaaaaaactctggactataaaaaataaaaatagaaaatattttcactttacagaaaaggaaagtgagagttaaggaaatttagtaatttatttatgatcacacagccaatgagtaacagaattgaatctaaaatttaagtcttcaaatacgaagtttagagttatttttggcaaagggtgggtttggctaaaggctagttgagttctatttgcattagaatttttggagttaaacttgctgtcatgctgtatggaacagaattaaggccttgattaacattttgtctatgtgcttggtattttaaaaatcaaacagacaaaacacaaaaactatttctgaagaaaatcttagcccagcttgtggacattcccttcaaggtgagagatgactgactgttgaggcagtcttcttgcaggttcctttccctagttgggttggtgttgaagactgggtgtgatttcagcaggcagtgtagagagtaggtctccgggtttttgccaagctatatgacctggcactcacaagtatgcagtgtttattgaagacatgagagacagatgctgtagccagggagcagtcattctgcctttatattataaactcttacatcaagtcacatcgacaagctgattacctaaactctgtcaaattgcttttgtttgattgatctgtgcccatttgccataaggctagatagtaaagattattataggaaacaatcctgtctgtttcatctgttgtaaggatactgtgaggcactatttgttatgatgcaccatgtcttttatgaaaatctcttgagaaaaaactatcggactataatacaaagaattattttacctctcctgagcaattgctttgtttttgtcttatggacattgtgaatgtttacctttctctggccagatgccaaaaagcttagagccaaatttgtggcccacccataacaaatgtgctctatgcctcattaacttcattcttggctccagtttatgtctctccactagtctttttttcttaagaagatcctaattcatgccatcttattatatattttttcttttttctcataagtagccttatgttgtttctcaaatagtcagattatgacatactgtgtctacataaaaccatgttggatgccccttcatttactttggctttttttcttgaggggtgtattgatttttcatataggtttttgcagcgttttgttacacgaaaatggttatatcacaaaaattattgcttaatagtgtagacaagtggtaaaataactggtctaatggtcagaattgattaaattgatgtcataattctagtcttgtcttttacagcattattactattttcttataatatgctttgttttgcactctcaatctgcatgtgacagtttattgctgtgtgattttcagaaatattgtcgtgctgccaggtcactgcataacagctaactctctgttaactctgttgagtctgttaggctcaaatattctacacccatcagacttgtctcactttgggtggtcacaggcatattaatttcatcacacaacttgtcttgcttctcctctaaattagtcattcttttatttagacaagataatgtgaatggatatttgttttcaaacctcattttctttgattggtttggagctctagctggattttctgattatcttactaatgtcatctaattgataaatattattgtacaactttttaaactcttttagtacttccaagtaaaattatttggtcttctctacaactctctagggtatgtaaggtgggtatatgccttttttacagatggcatacaaaaatgattaaatgattttatatgccatctgtaaaaaaggcgtatacctttttagaaaaacaaggacaaagtcatttaaatgactgctcaagatgataccagcaaatcagtggtaaaactaggactagacccaggtttccagaatcttatcccatactaccttttaaaagaagtcaaaagaagttctaacttatattgtaaacattacttcatctttatcataccccttgaagctaaagctatgaaacaggcaaacacatgttatatcactcatgctcatagcagggcagaatcaggaatgaatttcatttgtattagtctcatgattctctgtttttaaaattacagttccttttaactactaccgtaatcactgtcacgttccattatggaaggaggaagcaatattttatcttatcttttgaaaattaatgttgaggccaggcgcggtggctcacgtctgtaatcccagcactttgggtggctgaggtgggtggatcacgaggtcaggagatcgagaccatcctggctaacacagtgaaaccccgtctctactaaaaatacaaagaattagccgggtgttgtggcgggcgcctgtagtcccagctacttgggaggctgaggcaggagaatggtgtgaacccgggaagcggagtttgcagtgagccaggatcgcgccactgcactccagcctgggtgacagtgcgagactccatctcaaaaaaaaaaagaaaaagaaaattagtgttgaaatgaaaagtatttcccttggaaattagtaactttttagattctttgaattcatctttaatataaaaataatttgttgtcattatgcatattcattaaggagccaaataatacagttaatggtatggtgtttggtaaaacattagctataattttaatctctgtgcttcaagaggatatttaaaattcatgcttactgtgtacatggcaagtttccagttctcattctaactaatcgtttacatgtagcacataagctagaatttcttatagttacagttgacccttgaacaacacaggggctaggagtgccaacccccgtatgcagtcaaaattctaggtataacttttttttttttttttttgagatggagtcttgctctgttgcccaggctggagcgcaatggcatgatctcagctcactgcaacctccaccttccaggttcaagcagttctcccacctcagcctttcgagtagctgggattacaggcatgccccaccacgcccggctaatttttgtatttttagtagagatggggtttcaccatgttggccaggctggtctcaaactcctgacctcaagtgatctgcccaccttggcctcccaaagtgctgggatttcaggcgtgagccacagcacccagcctaggtgtaggatttgactccctaaaaaaatacgccaggtgcggtggctcacgcctgtaattccagcactttgggaggctgaggcgggcggatcacaaggtcaggaattcgagaccagcctggctgatatggcgaaaccctgtctctactaaaaatacaaaaaaaaattagccgggcatggtggcacatgcctgtaatcccagctactcaggaggttgagtcaaaagaatcgcttcaacccaggaggcagaggttgcagtgagctgagatcgtgccactgcactccaatctgggcgacagagtgtgactccatctcaaaaaaaaaaaaaaaaaaaaactttactaccaataacatagccaattaacaataacatagccaattaatacatgttttgtaaatgtattatatactgcataatatataccttaccaataacatagccaattaacacgttttgtaaatgtattatatacatttacaaataaccttaccaataacatagccaattaacacgttaccttaccaataacatagccttaccaataacatagccagttaacacatgttttttaatgtattataaactgcattcttacgaaaaagtaagctaggggaaaatattaagaaaatcataaaagaaaatatatttactattcattaagtggaaatggatcgtcataaaggtcttcatcctcatcatcatgttgagtaggctgaagaggaggaggaaaaggagcaattggtcttgctgtctcaggggtggcagaggcaaaagaaaatccatgtgtaagtagatctgcacagatcaaacccaccttgtccaagggtcaactgtgtatttttttaccacaaccctataaaagtaactactattttccagccgcattttacagtcaggtatttattgacaataatattgtcttctagctcttgttcagcttctggaatttctgagcagccctcgtcagtacaagatggaccccgtagtcttgagttacatggacagtctactgcggcaatcagatgtctcactattggatccgccaagctggctcaatgaccatattattgggtttgcgtttgagtactttgccaacagtcagtttcatgactgctctgatcacgtcagtttcatcagccctgaagtcacccagttcatcaagtgcactagcaacccagcagagattgccatgttccttgaaccactggacctccccaacaagagagttgtatttttagccatcaatgataactccaaccaggcagctggaggaacccactggagtttattggtctacctccaagataaaaatagcttttttcattatgattcccatagcaggagcaactcagttcacgcaaagcaggtagcagagaaactggaggctttcttaggcagaaaaggagacaaactggcctttgtggaagagaaagcccctgcccaacaaaacagctatgactgtgggatgtacgtgatatgtaacactgaggccttgtgtcagaacttctttaggcaacagacagaatcactgctgcagctactcacccctgcatacatcacaaagaagaggggagaatggaaagatctcattaccacacttgctaaaaagtagctattgaagtatatttgcgacttttgaaggctcctctttctgcccttccccatttgttggatggctgcaatctcagtgcctgagggaagatgcctagtagaggaaagcttaatactctttttcctgaaagaatatcatcctctgcattatccccatggaacgtttcactttaaccctgactggggagcaatatgttctgtgaaaatatcttgaaattgtacaccaaaaccttacaaccaacttatttgaacatttattacacacagggtttacgtaagacttttcttattggtatataattaatttcctttggtctcccttatccacattggcttattctggaggaaaagcagtgatctgtaaaacaaatcaagaatatattaaatctagaggaatgcagagaagaaaactataaaacagaaccaaaaacttgttgcacagcctacataattaagagatcaactggctggaagcagatcaaggcctaacttcattcaagacctaaatattatgagactcagttattcggttttatgtgacatctcttccattcaccatgcacaggcttttccagctatctatataatgtttgcaaatatttgataaagatgatgttaccctatcttcctccatctgattcctggaatgcttgaagaaaggggaaatcttgagtaacctcattaaaattaatgtctggtggacctctcagtttgctcactgattgggtagacttgctactctggattaataactgcttttctctgccttgtctattagccatgcacacacttcctccttatatccaaagttctttggttctaaaattcatagttgataccttcccaaggttacctgttgtttcagataaacatttgttcttcctgatagttataggttttcctctctgtccttaattctggcagaattgtttttagttatgtcatggtaatttcaggatgatttttgtatctgaaacttaacagacttagagttggtttgttttttaaatataaaggaagaaaagtgacctttctcagcccttttacttaattaaaaatgcagggaatgtaatttgtaaaatgtggaaccaagagtagaacgaaatactatccctccagaagcactgatgtgtttcagttgtttcaaatagtaaacaaccagatgacatgttaggtacacaaattaattctattcctaatgagaattagattgcaaggcctatgagacttgaaaaccaaagatgagcttcagccatgaaacttatttcagctacctccccagcctaaccctgcccccagccctcatggcccaaaataacctcaccactcagtgaccacagagaaagtaacttggttccttttagccgagaagggaaaacacagtaagggtaaataagtacaggttacatagcaggcctgagtgagcaggagctgaaactaaaagtcaaagagaaagctatcaaaaaaagtttccatttcaagtcggtacattttggataaaaaccagtcctaatggaagatggggctaggaaaaagattaggaactggcagtcatccatagaggtgaaatacagagggagggacagcaagagaagtgacaaaggtcactgatgataggccacaagtgtagataaagataagaaaacaatgttatttcagtgactgttgacttaggcagctaatctagactattaaagtcaaatcctctctgggaaaagttatctttctgacaatgcaaagtatgtttatttaaatatcagagtatcttcaatctgagaattaaagcatatgaaagcaatctttcctaactccctacgattcatcttataagtaaatttataagtaaatttttaaactacactagtcttttaaatatatatagaaaaatatatatacacacgtatagacatgtatatgtaatctatctacatatatataaaaaatgcattttccaaatgcattagcctgattggactgtgccacagattagtgtcctcctatgaaattttgagtatgtcatttgtaaatgttagcattataaattgcaggagaatttaagaattgacttgtatttcactggatactatagtacccggtaagttacacacctgcttgaccacataccattcatgttacatgacacaaaataggaaaaaatcttttgctggtattgcgttcccttctctcttagagtcaaaaggatctattctgcaaaattaatcaaaatattcaaaaggaaggcaggtttttcaaaactgggctaagcaattatcaaactgaactaacctgctttcagatatcctgttgtattgcccggtaagtatagtcacacttgtccaacccgtgtctcaatatggaattcagaaaagttaccatatataaacccagctataaatggttgtagaaaatataagtatcagtgggtttcctatgtaatagtgtttaaaacacaaatatttcaaccatttggcaaggtatatgttgaagttcacaagcgctggtcctaaccagatcagataaagtggattatgtttctgatatgtacctaattattttgactatactataattttacaatatgcatattgaccgtatgttttaataacacattccattgaaatgaccaagtagaatttctcagttacatggggcaggccgggcgcaatggctcatgcctgtaatcccaggactttgggaggccaaggcaggcagatcacctgaggtcaggagttcaagaccagcctggccaacatggcgaaaccccgtctctactaaaaatacaaaaattagccgggcatggtaggtgggcgcctgtaatcccagctactcagcaggctgaggcaggagaatcacttgaacctgggaggcggaggttgcagtgagctgagattgtgccactgcactccagcctaggcaacagagcgagactcttatctcaaaaaaaaaaaaaaaagtatttacagaaatgtacatgctatggtgttagagcatgaatgtcaaatccagggtctgtcagattcagtagtctcatctacaaaataaaccttgttttccttctgtcctactcagttccattttaagactaacaacaagtttgaaaacttagttttatattgctatgcagctaaacagctgtgtaaaaaatggctgataattactgttatgtacaaaagagaaacttattcaaggatggtgaatagcaacaactaacctttttatcactctgtaatgtgcagggtactttatgcacacatattacacaagtaccttgcatattatatatgcatcattatatatattaccatatatataaagtaacttgtacatttttgaggttctatagaaatatataatctcattaattcttatgttctcatgtttcaacaggtactgttattctcattttataaataaactcagaagctcagtcacgtggcctccatctcgtctcacactttttccacctattcctttctccctgtcctagaaaatggcaagaacttcacacttgaacattttaaatgtagtctagcctcagtttctaaatttcatatattcagctggtatgttacagaaactaatagtgagaaattgtcatctgaattaactgctaggcagcaggacctatataactggcttggttttatatattaagtcatatctggatcagctccttatactgctctgctggtttagggcaccttaaaagccctacattggccgggcgcagtggctcacgcctgtagtcccagcactttgggaggccgaggcgagcagatcacgaggtcgggagatccagaccatcctggctaacatggtgaaaccctgtctctacgaaaaatacaaaaagaagttagctgggtgtggtggtgggcaccttgtagtcccacctactcgggaggttgagacaggagaatggcgtgaacccgggaggcggagcttgcagtgagctgagatcgtgccattgcactccagcctgggcaacagagcgagactccatcatctcaaaaaaaaaaaaaaaaaaccctacattttatgtcctgtgttaaattacctttaatattacatgtatatgaaagacgggaagttgaacaagagcagcagcgtggggaatctccaaaaaagagggcttaaaggaattgcatcaaataaatgggactaagcaaagatgccctgcacaatagtggcaaaattggtcactaagttccaatatgaggctgaaattccactttgagatggagtctcactctgtcgcccaggctggagttcagtggtgtgatcttggctctctgcaacatccgcctccagggctcaaccagttctcctgcctcagcctcctgagtagctgggactacaggtgcccgccatcacacccagctaatttttgtattttcagtagagatgggatttctccacattggccaggctggtcttgaactccaggcctcaagtgatctgcccacctcagcctcccaaagtgctgggattagaggcgtgaaccaccgtgcctggcggaaaaatcaagttctgaatacacttaaattttcttatgtagggaaaaactaacatctcagagtgtcaaacgaagtgatagtcgtcttcagtgtcagcagtagggaagaattatcattactctggaaaaaatcttacatcctgcagtttgcattaaaagacaaaggctgtttccgggatctttgtcctccgtgtaccaaaaccaagcaacttgtatttagaagaaaaccctttctccatgatgcaggctcaggcaaggttttctacagtaggctttgcttccctagccagctcctgcttcagctcctcacagctgctatctcagtcttcattcctcaaacctggacaatgctcacctccaccctcactcctactttagagagaaaatagaagctgtcagacatgaactccttcaacttccctgacgccaggtctacaagcctacctatatctgcccgttttggcaccttcttcacttatttctattacagagtgacctcagagctaaggctaaccctccatctgcacagggatatcctgcaaacaatttacacacatcatcaccatcagtttctctctattgcctcctttccatcagcatttaagtgtgtaaaatctcccctacctttactgtttattttattttattttgttttattttattttttgagatggagtctcgctctgtctcccaggcgggattgcagtggcactatctcggctcactgcaacctccacctcccacgttcaagtgattgtcctacctcagcctcccaagtagctgggattacaggcgggtgccaccacacccagataatttttgtatttttaatagaggcggagttttgccatgttggccaggctggtctcaaactcgtgacctcaggtgatctgcccaactcagcctcccaaagtgctgggattacagacatgagccaccatgcccagcctattatttatttatttattttgatgggagggaatggagtctcgctgtgtcgcccagcctggagtgcagtggcacagtctcggctcactgcagtctccactcactgcaatctccacctcccgagttcaagcaattctcctgcgtcagcctcccaagtaccagggactacaggcgcacactgccacacctagctaattttttgtattttagtagaggcaaggtttcaccatgttgcccaggctgatctcgaactcctgatctcaggcaatccacctgcctcagcctcccaaagtgctaggattacagacatgagccacagcacccggcctcccccatctttaaaaataaatagaagcatgaccccatgtctccctctagatactgaccttttgcttttcttcagagccagctctgaagtatctgtagtcaatcacaattcctcacttccctcccacttttctacccagtttaatctagattctgccccaactacttaataaaacattaagatcactagtagtttctattttattaggcctcttagcaacattaaaccctccttctcaaaccactgttcctagttttcctcttttctgaaatcacatttttttttttttgacagggtctgtcacccaggctggcaccatcatagctcactgcagccttgaattcctaggctcaaacaatcctcccacgtcagcctgctgagaagctgagactacaggtacatgccaccacacccagcttgatctctctcttatttgccagtttcttctttacttgctatagcttctcggggttttgtctcataagccctcttcttttcagcctgtacatacttgctaggctctcccattcactaccaaggtcaatgactgattgacgcacttcacatgtacacttctgtcctgaacttcaacttgtaatccatttacctgcctgctggtcatcttcgcttagatatttcttaggctcctcaaacccaacaaacccccaaactgctcttgccttatcaaacttgctccatcagtgttccccacctcggaaaatggcaccactgtgcaacccagctccagccagaaatctaggagtcatccttgactttcctctcactttgcatttatcagcctcctagtcctgttgctctacatcttaagaatcctttaaatccatgtatttctattgccaatgctaccactctagtccagacaatcatgccctctcatctgggttgctagactagcttataaaggactcttcagtgttcacttatactcttcacccccactccattttatattctgccaatatctttaagaaagctctgtataacctggtcccttcccactttccctgcctctttgcaatctataccactcttgccttagcttcctgtgttccagccctgcaggccttcttttagttcctcaaacacacactttcttttctccctttccagtctccccatttgctgttccctcctgcactctctcccatagtcctcaacagataatcttctatgtcatctcttcctcaaagaaatcatccccagtgcatctgactaatttgctttccttgttaattcctcagaatcatgaatcctttcagtgtgcccaaatcacatatgatttttggtgttgtgtccttccttcccactaaatcacaagagccatggaggccgggaaccatgtctgactcgttcactattgaatccatgcagtttcatacagtgcctggcacataaacattgttatttgttgaatggataaatgagaacatagaagctgtttatcaaagaaaaaacagcccatcatcctccctggcatagcagcagaagtcaaaatgcaacattaatcagtagaactattcatgcttgcttaagaccaagctcagaggttgatgaacttaagcaacctaacagaaaatagggaactccctaaacttgtacatctaactgtggacatctcttcagtttatctgctgacttcttagagattttcacattttacatcgttgtaatccatgtctaagcactatcttaattctgctttttacaaatttccaccttaatcactgtttacttgtgcttaaaggtaacattgggttacattatatttatagattgtgattttcttagccaattccccactgccgggctttttggttagttctgatttgagattgttatgaatagcagtgctacaaacattcttcataagtaacttatttcacatgttctccttgaatacaaagtgggattaagatttcaaaacatatgaacagtttatatcctatcatgtagacagccagagatttgtctaaaaagaaagaatcaatatatagtaccattaaaattctatgatacaaacctatctctagttctgtatagccctaccaacactgagggtgggttgttttgtttttttagagatagggtcttgctgtgtcacccaggctggagtacagtggtaaaatcatagctcactgcagcctcgaactcctgggctcaagcagtcctctcctgcctcagcctcccaagtagcatggactacagggacacaccaccacacccggctaactttttttttttgagacagggtcttgctgtgttgcccaggctggtcttgagctcctggctcaagtgatcctcctgcttcccagagtgctgggattataggtatgagccaccacacctggccaacattaggttttgcatttgctacatttatttcttggaacttaacagaaaactaatatctgttgagctatttctgtgtgtcagaaacttcaaggatttgacatgacgtttcccatttaacaaattaccataaacctgtaagtactattagtatcccccttttagagatgaggaaactaaggcttagagttgtccaagtaaattggaagagtttaaatgtagatgtactgattccagaacctgtattcttaactactatgctgtactctctctcctggttgtcagtgacagtgttttttctgttatatttaacagacaggaaaaattattaataaaatctgtaacctttctgatttccaagaatgtggtataatttattgctagtgagcttgtttcattgaggtaaacatccagatggagctttttggttaagaaaggtcaactcccagggtttaacacgtgtaggccaggacaatacaagagagatcagttactccaaataataaaatcaaataaatttggattttcactggatgccctagagaaagagaatgaggcctaggaaagaaagaagtagggaaaggttaacgaagagaactgagatgagaagcattccagaaacatggcaggagacaggggcctactggaagacatggccatggagaagctccctactgtagtagagaatggctgctaaatttctttaagcaatcatctatgtattgagtttgaagttttctgctttgtgatatagccttccattaactaaacctttcatgcaatttggatatactcaaccattttggtggtggatcatttggaggaatgaaggatgaggagtggcacatgatgaggcaaaaaggaaatagccaaaggaacaggggacgggacaagcaggctgcatcccatctgcaggagacacagaagcaaccttaaaaacccttggagaaactgaggtctcaggacttcccacagtggttagaaatgggtctcaggccatttcaaattgaaagaatgacccctaaacactaaattatttggggttgtccaagtttggaaatttctgggttacactgaagtgagaaagagcttgaaccacagtaaaataaatttgatgtattagcagcatttgtcatagcctttgccttgatgtatcatgaaataattagcttcggctgggcgccgtggcttacgcctgtaatcccagcactttgagaggccgaggcgggcagatcacgaggtcaggagattgagaccatcctggctaacacggtgaaaccctgtctctactaaaaatacaaaaaaaaattagccgggcgtggtggtgggctcctgtagtcccagcttctggggaggctgaggcaggagaatggcatgaacctgggaggcggagcttgcagtgagccaagatcgcaccactgcactccagcctgggcaacagagtgagactccatctcaaaaaaataaataaataaaataaagaaataattagcttccaggacaccagactcttctggttttcctccttcctcatcaggcatccttagtttccttttcctagttcttccttttcttcctgatcttttattaacagtgtgtgacagggttcactcgtccactctttcttctgtctacagactcagtcccttgatgatctcatccagcagcatgcttttaaataccatccatatgttgacagctcccagatttatttttttattttattttatttatttatttttattttatttatttatttatttatttttgagacggagtcttactctgtcaccaggctggagtgcagtggcatgatctcagctcactgcaaccactgcctcatgggttcgagtgattctcctgcctcagcctcccaagtagctgagactacagtcgcatgccaccacgcccagctaatttttgtatttttagtagacacggggtttcaccatgttggccaggatggccttgatctcttgacctcatgatctgcctgcctcggcctcccaaagtgctgggattacaggtgtgcgccaccatgcccagccaacagctcccagttttgttttgttttttttgaaatggagtcttgctctgttgcccaggctagagtgcaatggtgcagtctaggctcactgcaacctccacctctcgggttcaagcgattctcctgcctcagcctcccaagtagctgggactgcaggcatgtgccaccatgcccagctaattttttgtatttttagtagagatgggttttcaccatgttagccaggatggtctcgatctcctgacctcatgatctgcccgcctcggcctcccaaagtgctgggattacaggcatgagccaccatgtccagccaacagctcccaaatttatatctcccagacttcagacatctctcctgaaccccagactcatataccctattgcccacttgacatccccaccacttggatgtccaaaattcatctcagactgaatatgtccagtactacatttctgattctccttccaaaagctttaccactcatggctttctccacctccattctttcaagccaaaaaacatgaagtcatccttatgactccttttctgttataccccatatccaatttaacaggcagtcctgtcgtttgtacgttcagaatatatccagaatctgcatgtttccaccatctctactactgccctagtcatcagagtcattgtcctccctaacttgtaagggaggctgtctcctaactgatctccctgcttccacctttccctccctagcagtcaagtttgattcttttgaaatctgaataacaaaagattattattcacttatctactcatttcattgggagtcaaagccaaagttcttataatggtcttagatgatttcccagccctccccctttgacttcatctagttctgccccttcttcttctctctcttccagctacacctgcatccttgctgttcctgaacaagccagccaggcaccctcccttccactttagacttgttgcattggctattcactctacctggaatgttccacaaaccttattctctcatttctttttttttaagacagagtctcactctgtcgcccagactggagtgcagtgatgcaatctccactcaccgcaaactctacctcccaggctcaagcaattctcctgcctcattctcccaagtagctgggattacaggagtgtgccactaccgcccagctaatttttgtatttttagtagagacggggtttctactcttgacttcaaacgatccacccgcctcggcctcccaaagtgctgggattacagacatgtgccaccgtgcccagccctactgtctcatttcttataagtctacttaaatatcaacttctctgttggaccttccctgataatcatctaatgtgatgccctataagcatttccaatctcccttttcttgttctatatttgttcttttttctttatctcttatcaccttctaacatactatatttatttatttatttatttatttatttatttatttatttatttattttattttatttattttgagacagagtctcactctgtcacctaggctggagtgcagtggcaccatctcagcttactgcaacctccaccacccgggttcaagcgattctcctgcctcagcctcctgagtagctgggattacaggtgcccgccaccacgcccagctaatttttgtgtttttagtagacacagggtttcaccatgttggtcaggttggtctgaactcctgacctcaggtgatccacccaccttggcctcccaaagtgctgggattataggcataagccaccatacccagcctataatttattatcttagttgcttattgtctctctcccctcatcactaaaatatatagacttcacgaaggcagagacctgtatttgctttgttcactaatatattccaagctcttaacacagtgcctagcccattgtagacactcaatgataattattttgatgaaaaaataaatgaaaatctggcctggaaaatctgtaatcccagccctttgggaggccaggatggtcggatcacttgagatcaggagtccgaaaccagtctggccaacatggtaaaactccatctctactaaaaatacaaaaattagccaggcatggtggtgagcatctggaatcccagctactcaggaggctgacacaggagaatcacttgaacccaggaggcagagactgcagtgagccgaaatcacaccactgcactccaccctgggtgacagagcaagactccatctcaaaaaaaaaaaaaaaaaaggccaggcgtgtaatcccagcactttgggaggccgaggtgggaggatcacttgaggtcaggagttccagactagcctggccaacatggtgaaaccccatctctactaaaaaaaaatacaaaaattaggccaggcctggtagctcatgcctgtaatcccagcactttgggaggccaaggtgggaatccagactagcctggccaagacggtgaaaccccgtctctactaaaaatacaaaaattagctgggtgcggtggcaggcacctgtaatcccagctactcaggaggctgaggcaggagaatcacttgaacccgggggccagaggttgcagtgagccgaggtcacgccactgcactccagcctgggcaacagagtgagactccatctcaaaaaaaaaatacaaaaattagctgggtgtggtggtgggcatctgtaatcccagctactcggaggctgaggcaagagaatcacttgaacccaggaggcagaggttgcagtgagccgagatcacgccactgcactctagcctgggggacagaacaaggctccgttattaaaaaaaaaaaaaaaaaaaaatcacccctaggagtctaaaagcatttttttttttaggccagggatcagcaaacttttccttaaagggacagatatggtcagatgatctttgtcataactcctcaaccctgccattggagctctagagcagccagagacaatacataaacaaaggggcatggctgagttccagtaaaactgtatttacgaaaagctggccaggctgtacagcagtctgtacttagctgattcctgctttagacaaagacacatcttggtaaatcagctctcttcattgataggccagtgtctattcatcccctctcccagttgccaaaaacaaaattctagaagggtgaatgcaaacctagcaaaattatagatcattagcttctctgcctgcatgcacatgggggcattccttactcaatgtggcccttgagtaagttgtgatttgcgggatgaggtagagagagaaatcctgctatcaggtgctgtcttgctaatgagtcttgagcacattatctgaagctttggagtatcctctagaggtttctaataggcagaatgatctacttctgaagcctcttttctctatgccattaagttctttggcactgatgatgaatttcctgcggcaaggaaaccattttttacttttatcagctattctgaaagtcaatagactgacgcagttatcaaaataactgccaatattataaggtccaggccctaacttcctgccacctaaagcaatgatactcaattaggggtagtttgcctgctctggagacacttggctgtcataaccaggggtggggggtgctactggcatcaggtaagcagagaccaaggatgtggcccagaatctttcaatacacaagataaccccctataacaaagaattagccagtccaaaatatcagtagtgctgaggttgagaaaccatgatctagacttttctactgaacttttaatccaccttgtactctactgagaaaccaatatcgccaaaccatcacttttctccttcactcctaaactgcagtagctcctcagcccggggagactaagtctgtccttgtcatcctggcacttagatcctggggattctgcccacatacatattcagactctgcttctttcagatttttatctgtcccgccctcagcactaccatactttaactgatgttaccccgcaaacacacattttgggaagatcctccccacctctctcctcagatccaaatcttactcattctttgaggcccacgcatgctgcatgcccctgtaacattaagtctgcccataccactgccttttgcacttacacggattcacccgtcttacactgttacattgctattctgtctacctcgcttcctcagctactccctgaaggagtccatattgtatttctggcctattgatctcagtttacacagcgtaaagtgtgaaaactgtattagtgtattgagattctcttcaatgagataatgagtataaaaagcactctatatagtgcctggtacacaattaagtgctcagaaaattatagtgtcatagtatctatagaagcatgcattcaggagcccatagaaggtgcttaataaattgtttaaatgtggttatatattggggagagcatgccacacagactagtctggtatttggaactaacagcaaagaaaaacttgcatagaaatcctacaccaattaacacaccttcatgctagactgaatccaggagcaggggtgtcatgttttcccagagtggtgcccaacccaacctttttgcatttagcaagttaatgaacaccttgtgaataacactttgccaactctggcccagtttagaaggctgccaataggatatcagtatgccacaccgtctgctttcctggggaccctgctgtcctctccctaagtgcttctgctttcagccggtggagagtctgatgtgcctagagaagttgcgcagtgggacgaggctgcagcgagagcctggcctttccccaggcggaagagagccttgtctcagatcctgagagagaagtgagtgggggcatggcattccgagcagcccaggtttggctttgggccaggcactgagtggcaaacaagaaggaacacattccgggaaggcaaggagccctgccagcacgaaggcagcagcgaaagcagggctctgctgggtaccaggtgttccttggctctgtggaggtcaggcacgcaggcggatgaactcaggtttctctagaatatcatttcagaggcttaaatgcctcccaccctctcgctgtcagcggacagggcatgtggaactgttaaacgttaaaactctctgctctggggcccagcccgtgctctctaaataaaggtaggagcggaaagagtgttgttgccatcatgaaatcacacttcacaggagccagatttcggcgattctgtgtctaagagaaaatgctaatccaaacaagggcaggttggagaagagcctgggatttctatgccctagaaactgcactctccacccttgcagcccagaaacacaaacacacacacacttgttctccacgcctgccttccgagtggccagagctgggggaagtctggagagccctcggaaacgccgtcctttcagaatcagcgctggcccttccccaggtgatgagagaagagagcgaggaggaccaaagcggaagcggatagagccattcttttcggggcaaatggccacacaagccttcctgaagattcccttcttactttggataggtaggtgacctggactggaggggccctgggcccgttttccccagcaaggggacaggagtagctttttctgagggaggacaacgaagtctttactcacccctctgcctctgcgtctttttgctggactttgctgccgcctagtggctcagttgtcatcacttccttctctgagagagagacagccagccttggattgagtttgaggatctagcctctcagtctagtcctgaggcaacctggagatccttctctgagaagtttctctgctctaggactccctggttctgtggcccagcagctaggagagaggagcaccatgggcttctaggcctcactcagtctggcagtcaggtagaggggccatggctggctggctgggcacctgggagagggggtgggggtagtttcttattcccaggacatctcagtgggatgaagttgtccttgagtccccctcattcctgaatgcctttttcgctaataatactgcccctcccatgacccttcctttctgctaaggcccatgttgcaaaactgaggctctggcataatgtatatttcctttctgtttccccaaatttaaggcagctatttctccctgataaagttagctcattgccatgataaatatatgattatatgccttctctgtgatgctgctgctatgaatcagtccctgggaatagtgaggagtgggcatactttaaagaattttattggattggtttctctaagtccctgaaaagcctatagattataagctatatttttctgtgtattatatccaggtgtttatttcctctagcaaaggaaagcacttggtttcaacaaccactgatctgccctaccaaactttccgatctgagctgtaatacccagggactatataaaatccaaactcttctgcttaccccaccaaactcttttcttttaacttttaaaaaattgtggtaaaatgacataaaatttaccatcttaaccatatttagcatatagttcagtagtgttaagtacattacactattgtgcaaccaatctccagaattcttcatcttgcaaaactgcaactctatacccattaaacaatagttctccacttcccccttccctcagcccctggcagccaccattctactttctgtctctatgaatttgactactccacataccacctataagccaaatcatacagtatttgtcttttttttaagagatggggtctcgctgtgttgcccaggctggtctcaaactcctggcctcaagtgatcctccctcctatgtagctggaattacaggcataagccagccactgcaccctgcccagtatttgtgcggggttttgtttttatttttttttctttctacaagcctggattccagaaattttttttttttggactggattatttcacttagcttaatgtccacaaggttcatcaatgttatagcatgtgtcagactttttttccttctcaaggctgaatattttttcatatatatatatatatatatatatttacatatccatgagtagatgaatatacatatttcattgtgtgtgtatatatatatagaatatataaacatatatatatagaatatatacacatatatatatatatgtttattcatccatgggtggacacttgagttgcttctacttttcggttattgtacataatgctgctatgaacatgtgtgttcaaatatttcttcagtttgggccctggaggtcgaggctgcagtaagctgtgatcacaccactgtacttcagtctgggtgactgagtgacagagtgagaccctgtctttaaagaaaaaaaaagaaaaatttcttcaagattattctctcagttcttttggctatatacttagaattgctggatcatatggtaattctgtttttaattttttgagtagctgctgtcctgttttacacagtagttaaaccactttacattcccaccaacagtacagttctccatatcttcaccaacccagcccaagtcattcccagagttactaattctccacatcttcaccaacacttgttatattctgtttcttttctgttctttgagagtagccattctaatgagtgtgaagtggtacttcattgtggttttgactggcatttccctaatgattagtgatgttgaagatcttttcattggttattggccatctgtgtatcttctttagagaaatgtctattcaaatcctttgcctttttttttttaagacagtcttgctctgttacccaggctggagtgcagtggcatgatctcggctcactgcaacctccgcctcctgggttcaagcaattctcccacctcaacctcctgagtagctggaactataggtgcataccaccatgcctggcttttttttttttttttgagacggaatcttgctctgtcgcccaggctggagtgcagtggcgcgatctcggctcactgcaacctccgcctcccgggttcaagcgattctcctgcctcagcctcctgagtagctaggattacaggcacccaccaccacacccggctaatttttgtatttttagtagagacggggtttcaccatgttggtcaggctggtcttgaactcctgacctcgtgatccacccacctcggcctcccaaagtgctgggattacaggagtgagccacaacacctggcctaatttttgtatttttagtggagacagggtttccccatgttggccaggctggtctcgaacttctgggctcaaagcgatccacctgcctcagcctcccaaagtgttgggattataggcatgagccactgggcccagccttttgcccatttttcaatcgggtttttttgttgtgttgacctctataacctcttttcatgtcactctcccacttagcatcctaggatactaacatgcagctagtctctctgctcctcagagacaaacatgtcctttcctaccttttgcagttgctgatccctcttccaggaatgtgttgttcccagctcctctcatgactgacttctcatcctttaagcaccagcttgtcactttggagaactttcttaaccatgtcatctaaagccacctccctctttaccactgtttatcacacttcatcatgtcactgtttcttcttgaaaatcactatctgcaattatcttgtttgtttacatatttacttggaatctacctgtacatggaatgtaagttaagttccatggacacagatatgtttgccatgttcatggctccagtgcccagcttagtacctggcatgtagtcttggctcaataatatttattgaatgaatgaatcactactagagggggcatcacagggaaaaagaaggaaggtgatatggcccaaattggaattttacctccttacataggctctgggtcatagaaaaggccacacgagctttctggctctgaactccgtatgttaattcctggatcagaggcataatcctgtttgagccagggacattgctttggagttgctcagagaaaatgggtaagtattcccggtgtccacccaacagaggcagagggctgtgggggtttgctgtggccaccctcactcttccccatatgccaagtcctttgagatttgcagagtacttgggattataggaatgacttgggctccatcagtctcctgggggctgagtatgtcagtaagagtacctgtagtgagtagtcagaggataaaaatgaactttctataccataatacactagaaaaatcaagttttttattttaaaatattttcaaaggctaaggccatagcaaaacaacccaagggtggttgaatcaaactcagggaattagaggagcatcagccaatgcaagcaggtctatataaaatacacatcatttataaatgcacacagcagaaagcacagtggccccagaggaccaggcagggggacaacagagagaaacagagcactatctggagggacaggcacacccgcaacactcaaagccctgggccccaagtgcacctccaaagtcacctacgctgcagcatggctcttgccctttctgagcctgggtatagctgaagaccaagttcaccagcatcttggcacatccacctataactggcacctctcatggcctctgacaaccaagcaaggctcagagaatggatttttatctctgtctttcagcaaggaccagggagaagtgctgaagcaagaagggttattttcctaaaaaaaaaagacggatgaaagggtgaaaggggctggttccaaaaaaaaaaaaaaaaaaaggatgaccattcatggaacagtgagtttcacctgagacatacagatttggtgcaagcaacacaaaaggccaggctctaaatttcatcctaaaaactgggatggggagagcatgaagagaccacttactggtagtccctccaattctcatttgggtttgtcataaacaggacagacagtcgtctgcttcacaataaataatttccacctggatttcattccctgattaatctctcagtgtctgaagaggggaaaacagtggctgcttctgacaccgcccaccccatcaccagcaactttccctgatacttctggcctcctcactaagcccttccagaacctccaaagccactatcttagcagatgggagtcccagggcgatgaggccagagttgtgggacacagagaagaagagaaggccttgatagaggaagaggaatatccaaggcaaagccaccaccacgtccaacctcctcatcctctacctttcctgtccccagaggtatgagatagaccccctggcctggttcctgcactgtgctaggcccacagtggacacttccaccttaatggagaataggccccatggagtggaggtccctcctccatggcctgcaacccaatgactatgggggtgacacaagtgacctctgccctgtgatggctcaacaccatcacacgcaactgtccagacaagcccccctcaacgggctgctgttggccatgcctgagatgcgggcaggcaggcagggagtggacagcaagacctcagatccaagcctccacccttcccttccctatttccagggcttgggacaccttagaaatgtttgagcacacaagggcaaaacccagtaccaggtctgtgaccacagtgatcaaaggccctgctccacttgtctcaccggaaagtgacagctgaggacacagaattcaggtacctctgttcttcacagccactgccaccatctccgccgtgggcagcatctccccataatgcagccagccacctcatgaggggccggcacagagccctggcccagagcatggaaattcatctctggctggaatcctggccatgagccctcccctctgcattcacagattctcagcaggcccctgcccaagcctgacaggtgcctggctgcccgcagagaagccctgtgggaacacagagtgttgggagggagcagagcccacatgggtggtttgtgttctgacctctgaccccaccataggagtgagctgtgtggcagagccacattccaaatgcgaaagcatggcctctgtcctttgaggtggcctccagtgttctgcctgtgtgccagaactgtttccaaggacccagtttgtttgtttgtttgttttctctaagtgtttgctgaagctttgtgtacagaattcctcagttggttccaaaaaatctggctttttgcttgagtccaaaaattgtagaagccagttactttgtaaacacgtacttcagatctctcatagagggaagagaagagctgcggggaggaggagggatctggaatattttccttcataggcagtcttagcacagcagcagcataaaccacagggatcattggtggagacttagcacccagaacattcttcttggagaaggaatggggacaaaggccaagtggctgttacctgcacacaggaaagatgtccacatcagggaaagggcccagaatgcagacggacgtgggcagaagggccagtgataactttacttcccccaagagtgggccagggtgggactggtgtaccctgcacgctgcccaaccttgcttagggtcagaagccagctcaaaacaggaccaagtccagccaggcagcctggcctgaggttcttggctcctgtcctcaaccctcaatatcaaaggcattagaaagagaaaaggcctcacctgtgcccagggactgggtcatcccaactcaaggagcataactgctgctctagccgagaaatacggaacgccaggtaggatgaggacatgaccaggaagcagatcctgaagaaagcggcaatacggagttaaatatttcttccacagaaagagcatttctggaagttcaccggaaatagtggggaccaagctacccctgcagttggaagaattaaagagccctttgtcctgcagccagttcaggcctcagcatctttcttcccagacaccatgtaggggtcttcagacttgtccccatggaagtgtccttacagcccagctagagctctgggcccttcagctgagctctggggggagctctggccagacagccagatcagtcatcctaccctctctctcaccagccatggtggtccttcctgtgcctcctctgggaggtcatgatgatgaccccctaggcggtgggcccattcccccagcaggtgctgatgttgatggtcaaaacccggccagccgagccagaggaggctgatgagctaaggtgagggaaagcaggggctggctgttcatgtcacttcccacgatgctccctgctctactggtccttagacagaggtagagacaagtcaggggttccagaagctgccctagtggtgggcagtggcgaggccaagcttttcctctctctctccaattttcctggccctccttctcccaaatccttttcctcttctcaacatctccatatcctgcccctctccaccaaatagtcttaaccctaaattacagggtttcaagaataaaaactggagatcctttctcttgctacagaagggcgtgccacatggccttcagataccacccaagagcttgaatttgactcagaaacttccccctggttctgaatagtgaattccccacactccaaggcccttgttccaagcacctagacatgcaggtgggtctgtccccctccccagtatagtcacttacagcacaaagaagaccttgaggagccggtaatcccagagcctcagctccccagtgctcctgggctcctcctccagctcatcctcctcatagacagcattctttgcagtgggagagcagttcggcatcttcttagggcaggcaggaccccagcctggcatgggccatgcccacctcccaccattttctgaagctacttgggctcttgacttttctttatggattgggagaaaaaaaaaatcagctctcagaagccctgctggctgtggtgagccctttttatggaactgggaagacagaaagtctggcctttgcaagtagttgccatggacaagccctcccgaacttaccagacattggaggcttcctggaggggaagaaactgtctgtggagtccacggatgatggagggatacaagggatgttgtctgggagagacagggacctggaggaagggcatacctttctccacttcatctcagggatgaggacttcctgcagtaagacaggagaagctatcttaccatggcccttgcgatctcacttgccctaaggagcccacaccaggtttatcagagttttctccagatattaccaaatatagatgcctagccagggatggaagcaggtacaagcgaggagggcagttgctatagcaaccatatgcctctcctctctgctcccttgctgtgactagctattctgccagcaaacgatgtctttgaacactgctagtgtagaaccacagtgggatcttagatgtgagccaacccagatacatgctcagatctgaggccaagaaagctcggcacaacatgtcttaggtaggataagttcctgctcctatcccaagccctaaccttggcagggaggacttagcgtccccatctacaaaaatgggaacttcaccttctatccggcacatggtattatgcatatcacatgcttggctaaacactaatagttactaaaggagccttcaaacaccccagggtcatttctacgccatccctgccctagaaactcagttctgcctacccagggccccagctgccaaaggaaacttctggaactttggcaaatctaaaataagtctgtctgggttcttcagggatagtctttggagttcttccctagggacatcttttattttttttttttttgacagggtctccctctgttgcccaggctggaatacagtgttgtgatcttggctcactgcagccttaacctcccaggctcaagtgatcctcccatctcagcctcctgcgtagctgggactacaggtacgtgccaacatgccctgctaatttttgtatttttattgagacagggtctcactatgttgcccaggccaatctcgaactcccgggctcaagccatcctcctgctttggcctcccaaagtgctgggattacaggcgtgagccaccacactcggctcccagggtcatctttatccccttgaaggccctcttgactcagctgaagaaaagaggatgggccactggtcctgcatctgtacaggtgtgcagcccaacctggccagtgttttggtgcttggacttctgttctactcagaaagtcagcctatcggctgggcacggtggctcacgcctataatcccagcactttgggaggcggaggccagtggatcacttgaggccatgaattcgagatcagcttggccaacgtggtgaaaccccatctctactaaaaatacaaaaattagctgagtgtgatggcaagtgcctgtaatcccagctacttgggagggtgaggcaggagaatcacttgaacccagcaggtggaagttgcagtgagatgagatggtgccactgcactgcagcatgggcaacatagcaagactctgtcgtccaaaaaagaaagaaaagaaagcctatctgctgaggccctggtggctctgcattatggtgtggcaggtttaagagatgccctggcatagcatggccactgactcttgagcctggtgccccagttctgcattgtgggcccccctaggaggcccagaagcctcagagctccaggcactgtcagtccagcagtctttgctcccagcttcagctctcaccagagactcaggttcccctgaaaattctcttacactcagactcttcttgctggaaggctgaggaggaaagggaacagcagtcacttgtccatctggaacaggcaaggtcaggcagggggaagcatcagccctctccaagagagctttacctccaaataagccactttgtgtcaggtgaagcccagctcccagggtctatagggggccccctatttaatgctggagcagagaggcaaaccccaggaaacttactctcccacctgctgccccatccctcccctcttcctcaccataggcagagagagtcatagggcatgttgggaagcagctacgcgctcctatctgtgcattaaggaagcacaagtgagggcctggacatagagacggtccctgacctacgatggttccacttaagatttttcaactttatgatggtgcaaaagtgataggcttcctgtagaaactgtacttcaagtacctatacagccattccggttttcgttttttgttttttgtttttttttgtttttttgagatggagtcttgctcttgtcacccaggctggagggcaatggtgcaatctcggctcactacaacctcctcctcccgggttcaagtgattctcctgcctcatcctcccaagtagctgggattacaggtgcctgccaccacacccggctaatttttgtatttttagtaaagacagggtttcactacgttggccaggctggtctcgaactcttgacctcaggtgatccacctgcctcggcctcccaaagtgctgggaccatacagccattgtttttcacattcagtacaggattcaataagttatataagatgttccacactttattataaaacaggctttgcctgagatgcttttgcccagctctaggctaatgaaagcattctgagatgtttaagggaggtgaggctaagctacgatgttctgtaggtgatgtgtacctctattaaacacatttttgacttacgatattttcaacttttgatgggttcatgggacataagcccatgaacaaggagcatctgtatatggggacacacaggggctcactggcctcaaagacatgcttgcaagcatagacacacaatccaagtactgtctcttgtacattgagcctgagcctttaactcccctctccctgccccattccctgtgctggagagatgggcgacctcccccaacacccttgtgcaagacctgcatccaggcctgagcgacttccctggccttcctgctcccaagctccatacctgtaggtgggtgcagactctcctcagcaggtcatatacactgtcccgggagagcagtgacacaaagatatactgggacatggaaagaaaacagacaggggtagggtgagatgagactccttgctgtgccagccagcccccttgtggattgggcacaggcccacaggggtatcaggccatgagagccaacagaagctctgcctaggaacttctcttccagcttgttgtacggcctgaaatacctactggagagctgcagggtggggtgaaataaagacctgggaatgtgcccgagtcagactgtgggctgtcagggctgggagcgggagactgacaagggagcatgggcccagtgcactgaccttctggctggtgttggtggtgatggccagtccattgggaaggagccgtgccatcttgtgttttttgatcatttgcacagacaccacaggaatgaccacctgagagggagagggatgcttctctcaggactaacccccaaggacgtggtccctttgctccctgcctagggacccagctgtgagcccagcatggccaccatggggaagcctggccccatgtggggaagtctctgaaccttctaccttttcatccaggctccccttccagttgtccctgccaccctgccccagccttggcaggatgtgtcactcttggctgtcacataggtatgatccctgttatccaggaggccaaggatggtggctctggtaaatctcatactctagtaatggagctccccaggctacttcttggccacagctagggctccgcctaaatgtgatatcccactctgattctcaaagcatttctgaaatacccagaggcagaatgatttggctgtgaactgttcaggccagctcaggccagatgtggggtccagattgggcccctgtttttgaaggggcaggactactttcctggacactggatgggatgcctcgaagctgcgcatccaaccagcaaggggcttcacccggggcccagcacgcagagagataggcatgactttgaggcatgcccgtggggcaggaggctggctcccctcacagggtcatggcagccctcaccactcattactaccttgatatccttgccaaagaggctggcatggaagcagagccagttgggggagatgtagagccggccctggaggaggaagtccctctggagggcacaggaacacactaggatgtcacaggagagaaaatggccataagcaaggtcagcccaggaagccccaggacctgggtcctcacgttctggagtccacagtccagcctcaggacctgtcttcctcagactcccccttccccaccgcaggccccaaaccccaaacagtccattccccagcgtcgaagggtccttctcctgactgctcctccactccaccagcctgctggatgtttcttccttctccacccttgctccagagggtccaggcaagttcctgccctgatctccaagcctgcattctcaccacctcaggcagaatccctgacctttccctgctctgctctgccccaagggccttgattgtgcaaatgcccccacctgctcagtgagaggccagagcaggtaagaagtcaccagtaagagcaggacacaagattccaaagccctgacgtttccccaagaaaaccttcaaaaatgcaatgctatgtccaaaccagcccagtcttctcaccagcccagtcttctcacattctaggggagtggtccacatctaaaggacagccagttcccatttctaagtcgtgctttggaggctccagagcagaggcccctggccccaggcactctgggtgcctaaccagctataccgggagacagctcacctttgagaaccacttcctccaagggaacatccttaaacagcttgtggtattgctggttgtatttattcagtgttatctgcaaacacacaggctgcgtctgagaagcgctgggagatgagaccgccaaaggggccctgctccagccaacaggaaatgccacagccccccggcccatgctggggacttagcatgaggcagctagtaagcagccagtgagtatggagggctgtgtgccaagcacagcttgtctcctggtgctgctaggtcctgacaggcagcttgtactagcagagggggacacactactcccacccaggaagggatacacactcaggtctcctgatttcctgatgacaggcccggtggccaaggagccaaaagtcactgaattctggcagcccaggaccccttcctgggtgaatagtgagaagtcagcctccagacttaccccttctcggccacacttctttatctcttcacccttcaagccttctggccagtgcagactgcaaaggagacattccatttcgggaacaaggaaccccagtcctgcccatgcatcctcagtgccaattctgccctggccttgagccagaagcttgaggcagagatcagagactaggacccttctctaggggacacagcaaaatgacaagtacagcgagcacacagctaaactatacagctcatccctgggggagggcactgcgggaggtagagaggggtcgccaagggcccaccttccccagtgcgggtgagcagcatctcctggaggtgcgcctggtctcccagagatgctgaggagcttcccacctgggtgtcaaagaccctgtcccatttctctggccaaggggtaagcaggggagcaggcagtgctggaatagggacagtttggggtgtgggtgaggtgaaggtgtcagactcacagcgccggggcctggccacaggccatgatgccagcaggactgccctccctgccgcctccttcctgtggcctgagctctgctgcggggagcttggcacagactcacctgacctggctgaggctaccacactgggagagggggatggcactgagaaaaaaaggtaaacctttgccttggccaggttggcccagagcacaggtgagcagggaggaggctggaaacccgagaagcatggactctgctaggtcccagtgcactgggacagtcttgaggggcgggaggaagaagcctggggcagcctgtgcctgacctcacagacctgcaaaggggccccggctctgccttgaggtcctcttacaaacaggtcacttcctgagggcttcccaccctctagtctgtgtgtatctatgactgggaaaggggtcctcacctgtagtccgggggctcctcaactctgtctggtttctctttgcaggacacaggactgttcagagaagctgtctttctgtgcatttgttggttgctagggaaaaacaggcccatatcaggaagggggcttcatgaggacacctttccctaacagccccaccatgcccatggccgctgcctctggcccccacccaagactggccctgatattgagggtgacactgaaaatgtcacagttcagaggcagcagcgcaggcagaggttctgggatggctgacggagtaggcgggtctcacacagcgtctttcccgaaagccagaagttctgcttatgcctaggctgggaggaaaatcaacctgtctacctcatctccagtgccaggcagctcgtaggccaggctgagtgaggcctctagccccacccttgaggaggcacactgagagggaggaccctgagactcgcttatgccgagaacaaaagtgtccaaagtacccgcgcagcatgactgtaaaccatcaggttccgggaaagtaggctgagcacaggaggccttatcaaagctcaggagctgatgcgctgaaggtgtgggaggtggacgcccatcagcctacaggtgagtgtggccaggaggggaggagccgtcttataccaggaagtggcctcagccaccttggacagtcaggacagcttgatgatgagagccaaaccatctcaaaaatgtccctgagggagagcgtaggagggaacagatcctctctccctgggcaggtcgggctctccaatggcctttgagttcctgcctccactaatcgctccaaagaatcattaccctgttcctgctcctccaggctacacatcaataaagcctgagccgtcaagccagccccaaccaagtgggcccaggggctgaccaagaaagagagggtggccaagaagcagggccgtgctggggcagtgtggtggtcaggaacaggtaacaaggtcacgtgcagtggtcctgctgcagattaggagctggagcctggaacctacaaatctcaatgctcagtcaccctccgctctgtgactgaggccagccaaagttctcttcttcaagaacagagttttcgcctcagcccaagatctgccaggaccctcagagattgattcagcctcacccgctcccaccataccattgtacagattatgaaactgagacctgccaagggacaggctgtgtccggtcctacagtgaacagccagtgacctcacccacaaaatcagcccagccatggccatgtggcctggttacctctgtcctcaaccttagagaggattttgccacacatatcaacatatacctacaacagtcttgtgaagtgacagattttgctagagatttgactctcaaagttgatttctggatttatttggttccatcatgtcacatttcacagaggtttttttttttcccttgatttttaaagattatagaaaatatgaaaaatatatataagatcaaaatcacctaaagattccccaaaaatcacccaaataaaaaatgtatgataaacatataacctatgtaaatggttatataatctataatttgtataccctacttctgtggcttaacctgatttcatgagaaatttcccatgtcactcactgtccattcctaagatagattctcagaagtgaaattagtggattgagaatgaacagatgctgttccagttaacccagccatcagcacgacatgaaggtgcctgtttccccatattcatgcccttctctggatattgtctctcgctcacctttgcaaatctgataggtgaaaatacgttgtcttcatttgtatttctgcttactggtaggttgaacagttttttccaaataattattaaccactggaagttcattgtcttatagagaattcacaggtgaaattctttcttcatttgtattgaagttctttcttcatttgtataaattttttctggcttttttattttttttttttgagatggagtctctctctgtcgcccaggctggagtccagtggcgtgatcttggctcactgaaacctccacctcctgggttccagcaattctcctgcctcagcctcccaagtagctgggactacaggcgtgtgtcactgtgcctaatttttgtattttttagtagagacgggggtttcaccatattggccaagctagtctcgaactcctgaccttataatccccctgccttggcctcccagagtgctgggattacaggcatgagccaccacgcccggcctttttttttttgagacagggtttcactctgtcgcccaggctacagtacagtggcgcaatcttggttcactgcagcctcagcctcccgagctcatgtgatcctcccacctcagcttcccaagtagctgggactacaggaatgctccaccatgccgggctaaggttttcattttttttgtagacagcgggggtctcactgtgttgtccaggctggtcctaaactcctgagctcaatcgtcccacctcagcttcccaaagtgctgggattacaggtgtgagccaccatgcctagcctttttttttttttttggagacagagtcttgctctgtcacccaagctggagtgcagtggtgtgatctcagctcactgcaacctccgcctcccaggttcaagtgattctcatgcctcagcctcccgagtagctgggattacaggtacctgccatcacatctggctaatttatttatatatatataaattttttagcagagatggggtttcatcatgttgaccagtctggtcttgaactcctgatctcaggtgattcacctgccttggcctctccaaagtgctgggattacaggtgtgagccaccatacctggcctgtaaattctttattgagaacgttaatccttagtttatcatttttgtgatgttttccccagtttgtcgtttctcttttgtctgtggtatttctgctgtgcctgtgtgtaattactgcatgggagattccatctatttcttccatgtatgtttctcgcttggtctcagtcctctcacaggacaggcctggggggagtagatatgcaagtcagaccactgagccattacagcgtgggcctggcagtgaatccatggggccgccagggaaaaattctgtgggctcagctctgaagaacctgcatcccagactgaaggatggatgagggatagaacgggatgacaatgggaaggagcttggacagtgctttcagaggcagggagcctgttgcttgagaatgtgagtcaaattctcaggactgcaggagctcagaggatgcacagatccctgggaactgaaatacagtggggttcctagagaaaaggaagctgagccttagaaactgggtataattataatcttgcatggattatctaatcttgcatagataaccatgtctttgcatggattctaaaccaaacacatccttaggttcaaatgtgactgtctcagggagagaagccttccctcagccctcccccagcctaggtgagtagtccctgcttcagatactcactcacagcaccctgatcggaagtctctgctcagcatctgtcacactgtgtctgtgtgccatgactgtgcatctccaggggctcacagactctgcctggtccttcattgaatcccctgagtccagtgctgagcatgcagcaggcgctcacgacaactccagggaggagctttcctgccttcagaccaggctcagccaccaaacccggccaactttcaagtctctttaaattaaaagccaactcctggccaggtgtagtggcttatgcctgtaagcccagcactttgggaggctgaggcaggtggatcacctgaggtcaggagttcaagaccagcctggccaacatggtgaaacccgatctctactaaaaatatataaattagctgggcatggtggcgggcatctgtaatcccagctactcaaggggctgaggcagcaaagtcgcttgaacccgggaggtggaggtttcagtgagccgagatcacaccattgcactccagtccagcctgggcgacgagagtgaaattctgtctaaaaaaaaaaaaaaaaaaaaaaaagccaactcctttacacatgatcaagaggatggttgcaagccattcctttctgtttgcccactgaagccagttcctcctgtctctctgctgataatgctcttggctcagagaccctgcctatggccaaaatgagtaaacctgccgcgctctcaaaacgatcttcagttcactttccactcaatagtggtgtcttctcccctgtagtgtttattttgacgaatgaaaataaagaaatgggagtagtgccacctgaagaagtacagggcagactggtcactgagcactcaccagcagaaccactcaggcaggggacacccagtgaccagctgggccctgacccagagggccaagaaggaggcttcaagagcacagggctcagcctggtcccccaccctgcaggcagccgctgtagactctactcacagactttttgtcgcgctaggtgttcatgccctgtgggttgtgaaccacatctcctcccgctctgtcccatccagtcccgtcccatccccatgccccagctgtggaattcatgtcaggagtcctggaagccataaaaaactacctaatttctgtcaggagaggtatggagcaggggagtggcagtgttttgacattaaaggaggtacaaaagattggaaatcctccgatgaggcccttcccctggctgagcatggtctgaaggcaggaaggcccctccctagagggcacaggaggtgtctgcctgctctccagccccatgcagcaaaaaatactccctgagcttttcacatcatgaggcaggtagggagctccccagcctgagaagctgccagagggcagggatggcaccagcacagggagatgtcaagaatggggagacagggcaggagaggagggggcaatgagtgggagcccagatacacaggagtctaggggcctcgtggtgcacctgacacaggcattctgctctgcacacctcccccaggctccaaatacccacaccaggcagtcactcccaagtctacctctgtaaccttgacacccacaccctcccgagcttcaccccctgccatctagacgtgtccatgcatgtaatctcagtagcggccccccaaacccacttcctccttggcatccaatgtctgtgaaaggctctgtctccccacagttacccaggccagaatactccactcattcttctcctcacctccacagccaatcaagccctcaggtcccccccaagataacccataaaaccatctcttttctcattcccactacaccacgcaagcccaggccacaatccttttcccagatgctggcaacagctccctgaccaaaactgcctccggctgtgcgggtacacactgcctctctcccacatgcacactgcccagagggccagctggggcccgggtctgatcctgccactctcctgctgatgctccttcttcacttcccgtcacttcttcagctggcctcccagaccttcctgctttccagcctcatcgcccgtcattccctcccctgcagtacagcccagcaccttcacttctatgccacagcagcccttcacacctgcgtgctttgcctgcatacctgcttacccttctcatgcttatctacctggggagttccggtcatctttcaagccccaggtgaaacgtcaccacctctgtgaagccttcctcagtttcccccagcagaggggctcatccctcttctgtggtccactgtcgcttcttgcaggctgctgccccagcacttaccacaccagagtgtgcttgtctgtttacacatctgtgtcccccagttgactctgagctccagcaagggcgtgtcccgtacatctctgtatccccagcatacagccagcacccagtgtttgctgaatgaatgaaggagagacagggaaaaagagataacaccccaaaagggagaagcagaggaaaaagcaaggcagtaagagtgagggggcgcagagaatgacacacccagcaggaaaggaggggacaggctggacaggagctgatggggtcccccacagcagggccctttcctccaggagctctggttcggtacctcaaggcactcagcccagggtggctgactgatcaaagaggaactcaggtgggaggtaggaggcccaagcaaagaataaagggtctgggcaggatggggtatttgggtgaaagcacaggctgggcccctcctgtctccagtgggctgcacacacctgggcgggccatgccctggcaacactcccccagccttcccagcccttcctaaccacagggcaaacctccctccagtactcatccaagcctctggcagtggccaagcctgtggctgatgctgaagcacaaatctcagccgggcctgcgtggtcacaggcagggccttccccacagctggggtggggtggtccccttgggcatctcctcctccaaggaggtgaccgcactctcccaagctgacttcttgtggaccctgtgggtcctgccaactcttctcaaggccaggccaaagacagctccacccttttgtgcagccagccaggacgctcagccccagcgagctccaagcagagacctgaaaacaccactgttctcttccaaacaaaaacacatcatggcaacaggccccgacagtacaaacccagaaaccagggaaatagccatccaaggacaggaagcttcgtggacatctgtcctggataaaacttcgcaaactggggctcaataggctggacctgggactcttccccccagtggctgctccagatcccccgacaaggtctcttcactccacctgcacttctcactcagctcacctcctacttcagggggaaaggacactctccttttaactctaaagtgtagccgctgggtgcacattagaatcacctgcagtgctttttttttttttttttttttttttaagagatggagtcttgctctgttgcccaggctggaacacagtggtgcaatcatagctcaccacagcctcaacttcctggggctcaagtgatcctcctgcctaagcctcccaaagtaggtgaaactacaggtgtatgccaccatgcccagctattttttaaaaaatttttttatagagataaggtcttgctctgttgcccaggctggtcctggcctcaagcaattctcccacctcggctttctaaagtgctcggattacaggcatgagccactgtgctcagcctgcagtcctttaaaaaaaaaaaaaaatgatgcctgagctctgtctcaaaccagttaaatcagaatatctgggaatagcatttaaataactatagatttcttaaattgttgttgaagtattatttacatatagaaaagcacatgttaagtaaatgtacaattcaatgcatttcacaaacgagtacacacctgggaaccaggcccccagaactacccgctgcttcctctggtttcactggccacaccctcctggccatggatagccatcatcctgacttccagcaccacagagtgcttttgctgcttttgggactttaaatgaacagaatcataccatacatactcgtgtatgtgtctgcttttactcagcaatgcatttgaaatatggatagaccacaatttatttattcgttttactactgatggacatttaggcagtttccagtttttgcctcttatgaaagtgctatgaaaattgtagtaccagtcttgtgcatgcaagtattcacttccgtgggtaaacacttaggattagaagctctaggtcataaggcaggtgtatgttcagcttctttttttctttttgagacagagtctcactctttcaccgaggttggagggcagtggcataatctcagctcactgcagcctcgacctcccaggttcaagagattctcatgtatcagccccctgagtagctgggattacaggcgtgtgccaacacgcccagctaattgttgtatttttagcagagacggggtttcaccatgttggccaggctggtcttgaacccctcacttcaagtgatccacccgcctcggcctcccaaagtgctgggattataggcgtgagccaccgcacctggccggctttagcttttaaaggctcccaggtgattgtaaacccccagccaactaagaaaccatgggaagaatcctgcccccacccctcctttctttgtggcttctctccaaggccaatccacctgcctgggctctgaaactggggtcctgaccctcctgagccttcttcaccctggccctcttgagtttcaggaacttccttgacaaggcagggaaccccactgtcaataagctttccttcatctgtttaaggcctgggggcccatttcctaggttgtaccacagaagtcacaagaccagcttttccaggtggcagaggccggctctgaaccacactgtgtccttcccgagagactccctatgtgctctcagggccacagtcctcacacacagtcagaaactgggtgacaagacctttcctgatggcaaactaggattctgtggagagaggcaggcttattatcatcaatgtgctgaaacttgaagataaaaggtaatttccttcttttgcaaaaataatgtcattattgctgtcttgcactttctttttttttttttttttttttttttgagatggagtcttgctctatcgcccaggctggagtgcagtggcgcaatctcggctcactgccagctctgcctctgggttcgtgccgttctcctgcctcagcctccggagtagctgggactacaggcgcccgccaccacgcccggctaattttttgtatttttagtagagaaggggtttcaccgtgttagccaggatggtcttgatctcctgaccttgtgatccgcccgcctcggcctcccaaagtgctgggattacagttgtgagccacccggcccggctgtcttgcactttcatagaagctgtacctccctttttattttctcagatgacattccatatctaggacaactgctttgtcctttccactgactggaggaggggagaaaaatccaataatcgagtctcatactgagtgtaagggggtgaggcttagtgagttggggtcccactcagctcccctggcagcgggctccagaggggcgggaactcaacctcatcacaatcccttcttccaggaagggttctgagaacacccaggccgggaacgggcttgctctcccatcactgcctgtagcagctttgagatgaaggggggatgtggagggccagaggcctatcttcccaagacctaccaagtgaccctggccacagccagcggaaccatggtgtgctccaggcccaggaaaagccatcacaagctgaccagcagcctctttagagtgaaaagatgagccggcctgtcagattcccttcctaaggaatcctaactgggaaatccgagatgtggaggtatgcagccaggagggaacaggcgagagagagccaggtaggtgcgagctgcagctacactagagctgaacctctgggtgcccccggagactggctctagagcgagggaagagggggcaggaggcagagagaagcagggggccatgggccaggcctccagtctaggagagcacgaactggctcccctaagatgcccattaactcctgcatttgtgtctccacaaaatggcaaacagagaaaaaaattatcccctctgtgacctgcagatcgtcagggctactgtgaggatctgcaagaggtcttgactcagtctggggtggggctggggacacccataaccctgcccattgagcaggacgtccccgactagcactggtgagcgctgtgttagcctctgtcccatcacatccttgaaggatacctagaggggcatctacccacggcaagtgaagacaggggtaccactgggcctcaaaggcacccagaaagctccatacatgtcctccatgcctgaatctttccactgggactacagtccaaggaaccagccgcggcaaggccctctctacacctgggccacacccagtgactgcctcccaccaccatgggctcggaggcacgacccaacttcagctcaggcccagcctccctttcttctcctccctccaccagaggttagaggccagcaattgctgccccctcctgcccagagctcaaaggcctgtgcagtgagaacagtcgccacggagacagacagggacaaacagctaaaaccgggaagctttcctcctggggatatccaggatttcctacaaagcataggccaaatcacagagccggctctgcagagagtgccctgccggctgctggcttcgtcccatcatgcccgctgctggagcggcatctatttgagctggcacccccgggtctgctcatagaccactttttcttggcaggccacttggggcttggccatttccagacaaaaagctggtcattcaggtctaaaaacagacttgcattcattaaggaacagagcgcccctgtgctcttgggggccgccctccggccaggcctgctaagtgagggggcctgcagacaggctgagccgctcagacgcccccactcagggctgccaggggctgtggctactctggagacaagtcagttctgtccatccatggatactgtccagacagcccaccccaaccaccctgggatacccacctcagaattactctggctttgtggatccatcaggctcttctcaggaccacaggcaagtgtgaagggtcttggggtcctgaaagagcctggagttggggacaggaagacaggaatgcaggcctggaactgcttctcactgctgaggggctttgagtaagccactcttcctttctgggcctcagtgactcctctgcaaaggggcgagaaagtcacagcccaggagggacaacaaatgttgtctgagggaaaaaagcagaggccacgaactgtataaactgcagatggccactggccctctgaggtcagatgaaccctcatcccaggagggacctctattagggcatcctgactcaaccatggagggcaaggaagacttttctgaagacgtacaacattggagctcatctccaagggatgctagccaaatggagaagggggattctgggcggacagggtcactgtagaggggttgccatatacaaaggccccaaggccagaagtgtgcagcatgtgtgagaaagctaaatagagcctttgagtctggagggcagaggtgagcagcgaagtggtaaacaacaaggctggaggggttggcagggccagatcatgcagggcccatgggcctctataatggttttggtcattatcttaaaagcaatggggaaccaatgtagagatttaaacaggaaagtatactatcaactttgtgtgttaataatttgtttccaagtaatcccatggaagtggggcaggggagtggagggtgaatattggtgaaacaggaatgactcgtgttgttggttattgtagctgggtgatacatacgtggggatccactggacaactctctcatcctttgttatgttcacaattttccatggagagagatcaggtgaaaggctgtagctcagcagagagatgatgtcttggactgggtggcagtggtgatggagggccagggatggatttggaatatgtatttccaaatataatcaatctgacatggtgatgaattggatgagaggtaaaaacaagaaggtgtcaagtatgactccagatttctggcttaagcgagtaggatagtgggctcttttgctgagactaaatgaggtaaaaatggactagaagaaaagcctagttggaagcaacagtcacgagttcagccttgaacatgtgtgagagacatttaagtggagatgtcaaactatatatgactaagaagctcagaagaaaggtttaggcaggagggataaatttctgagttactggcccataagtgagaagaggagctagtaagactgtgccagggaaagtgggtacacaaggaacagaagctatcaacaagaatgccaagacttagggggaaataaaagtcttttcaacaaatcatgctgggacaaactgaatatccacatggaaaagaataacatgacctttagctcacactgtatacaaaaattagccaaaattcggccaggcgcagtggctcatgcctgtaatcccaacactttgggaggccgaggagggtggatcacttgaggtcaggagtttgagactagcctggccaacatggtgaaaccctgtctctactaaaaatacaaaaatcagctgggcgtggtggcgcatgtctataatcccagctactcaggaggctgaggcaagagaattgtttgagcccgggaggtggaggttgcagtgagccaagatcttgccactgtactccagcctgggcgacagagtgagactgtctcaaaaaaaaaaaaaaaaaaaaaaacccaaaatttgctaaaactatgaaactcttaaagaaaacataagtgtaaatctttatgacctatcaggcaatgatctcttagatatgacaccgaaagcataagaaacagaagaaaaaaacagataaattggatctcatcaaaattagaaatgtttatgctgttaatatcatcaagaaagtgaaaagacaatccacagaatgggagagaatatttgcaaatcatctgtctgataaggatttagtatcccaaatatatagagaacccttataatcttgaggacattatgttaagtgaaataagacagtcacaaaaacacaaacacatatgaatccacttaaattgggtatctagagtagttgaattcatagaaacaaagtagaatggtggttgccagggcctgggggcagaggggataatgagttgttgttctttgggtatagagtttcagttttgcaagaagaaaagttctgaagattgcacaacaacgtgaatatacttaacactactgaactgtgcactctgttgcccaggttagagtacagtggcgcaatcatggctcgctgcagcctcaacctccctgggcttaggtgatcctcccacctcagcctcctgagtagctggcactacaagcacatgccaccatgcccagctaattttggtattttatgtagagacagggtctctctatgttatccaggctggtctcaaacttctggcctcaagggatccttctgcctcagcctcccaaagtgttgggattacaggtgtgagccactgtgcccagatggtagggttttgttgtttttttttttcttaactacaatttaaaactgttctaaaagaactcttggccgggcgcggtggctcacgcctgtaatcccagcactttgggagccgaggtgggcagatcacatggtcaggagatggagaccagcctggccaatagggtgaaatcccatctctactaaaaatacaaaaattagccagacatggcgatatgtgcctgtcgtcccagctactcaggaagctgaggcaggagaatggcgtgaacacgggaggtggagcttgcagtgagctgagatcgcgccactgcactccagcctgggcgacagagcgagaccatgtctccattaaaaacaacaacaacaacaacaacaacaaacccgggcatggtggctcacgcctgtaatcccagcagtttgggaggccgaggcaggtgaatcacctgagatcggcagtttgagaccagcctggccaacatggtgaaatcctgtctctactaaaaaaaataaataaatacaaaacaacaaaaagtagaaaaccaggtgtaaggctgtcatggaagccaaaggagggtttcaaaagatggaggagaacgcaatgctgaagtctgctgaaaggccaagtaagagcaggacgcaaaggcagtccctgaatttaacactgcagatgagttactttggtcaggacaactttggtgcagtagtggggtctgctcctcctccttttctcctgggccggtgactgcatcccagggatggatggtgaggacaggtctctgtccaccagcaaggatgctgctgagcacagctggaaactcagtcccagtccagctcagcgccacatcccctctgaacctgccctccgccctccctcgcgggaaaagaccacggagatactgggaacggatagataggattgcatctttctctcctggttccccgagggggttgtttgcagtcggggagggagagggactgccctcgccccacggcctcactgccctgttccccagttccccaagccaccttcacctgcagcacctccacccctcggctagcacaggcaagagccacaagcctattttctgcgcctgccttggaaagggctgggaagctggtgaggcagccgcacccagcattccacagccacactcagtggctccaaagcggcgcccgcggcggcactgatcccgcccggctggccccagctgaccctttgcaggaggctggtggtcacagccagagcttgcgcaggccggggagctgccaggagtgccgcagccgtgcccccacctgctgggctcccgggaaaaggagcgcgcgcccctctgagccccttcctggtgcagtgcgtgtaccaagcgtggtaactggcctggctgaggacgcccgcgtggggacgggctgcgcgccctgcccaggctcctgccaactcggctcccccaggctgggctcggccgagggctcagattcctgaccaatgacctcgtcttgaggagcttgctaggtcctgggacctcctcctccagggagaaccccagattgtctaactgcgggaacgctccttaggaatgcctgctctcgccactgttattcaaccttgtcctggaggttccagccaccgcacacaggagagaaaaacaaataaaaggttcacttacatgttaaagagggacaattattgtttgaagatggtcagataaactacctaaacaacacataatcaaccgacaaatcataaaaacgtggcgcagatattttcatatttgggcaccaaagtaggcagaactgtgatggggtagacacataattaactcatggaattaattactactttaacggttacaagatcaatagatcttgtccaataaatggtattggggcaattggctacctcccaaacgactgattttttaacttgtaaaaatcaatcgttttcctgtagacctacaatacagttataaagtatatgtgggaaaatacctatattcatatgacaacaaaaatatattttgttccagttttttttttttttttttttttgagacggagtcttgctctgttgcccaggctagagtgcaatggcaccatctcggctcactgcaacctctacctcccaggttcaagcaattctcctgcctcagcctcctgagtagctaggactacaggcacgtgccaccatacctggctaatttttgtatttttaatagagacaggatttcaccatgttggccaggcaggtcttcaactcccaacctcaggtgatccacctgcctcagcctcccaaagtgctgggattacaggcataagccaccattcctggcctgagtcaaagttttaaaggagcaaatttaccccaaattaatttgtaaatgttccaacagggtgcacgtgcatgtgcacacatgtgaaagagagcaagaaaattttgaaaaagaaaatgatgtaaaggctttgccttaccagatgtcagaacaaattacaaaggtaggataattaagtagcgaagtattaactggcctaggaaagattactagatcaatggagcataagacagtccagaaaatgacctatgagtatatgagaatttagtatagcatgaagaatgtgtttcacacaagtaaggaaagaatgagttgtccaataaatgatattggggcaatttggctacctcccaccattcacaaaaagataacccagggagataaaacacctaaatattttctaaatctataaatagctagaataaaagagaatatttttaaatatcaggaaaagtttttctaagcaagatataaaacccagaacacataaaagatttaattgcataaagatttaaaacttctgtatatcaaaatttaagtggacaaaggattggtattcttcatatgtagggagctcatccaagtcaataaaaataggtaaataacctaatagaaaagtgagcaaagaatatgaacaagcaatttagaaaacaatctatcttacctattttatcagtaaacactaaaattatagtgctcagtattaccaaggatgtgaaaaatagtcattcattattccccattataagactaaagactgagttaacctttctaatatacatcaaatgccttaagaaatacaaattcttttctttttcttttatttatttatttaattttttttttttttgagacagagtctcgctctatcacccaggctggagtacagtggcgccatctcggctcactgcaacctccacctcctgggttcaagcgattctcccgcctcagcctcccgagtagctgggactacagaagcatgccaccacgcccggataatttttgtatttttagtagagacagggtttcactgtgttagccaggttggtctcaatctcctgacctcgtgatctgtctgccttggcctcccaaagtgctgggattacgggcgtgagccactgtgcccagccaagaaatacaaattctttaacccaacaattccctttaagacacttgatgtaaggaaataaatggacaaaaatgtatattcgtatgattaacaattatggggaaaaatgtagaaataccataatggtattttatcagtataatggattcctatgcaattgataaaaaagagtaagttagagctcctatatgtgctaatatggaaaaaaagtccaacatgtattgtaactgataagtaggtacagactgaatgcagtggctcatgtctgtaataccagcactttgagaagccgagacaggtggatcacctgagctcaggagttcgagaccagcctggccaacatagtgaaaccccatctctactaataaaaatacaaaaaaaaaaaaaaaattagctgggtgtggtggtaggctcctgtgatcccagctacttgggagactgaggcaggaaaatcacttgaaccccagaggtagaggtagagtgagctgagatagcgccactgcattccagcctgggcaacaagagcaaaactctgtctcaaaagaaaaaaaaaagaaaagaaaagtagatacagatcagtatgatataatctataacataaaaaaactatacttaagggtatatatcaatcatgactacatccaggagaataaagggatgatgttcactctttatacactgttttgtttgaacttatactaacaggtataagttcccatctgctacttgggaggctgaggtgggaggatcacttgagcctgggatgttgaggctgcagtgaactatgatcatgtcactgcactccagcctgggcaacagagcaagaccctgtctcaaaaaagaaaaaacaaaaaagaaaactaaaaaaaaaacaacagtaaattaaagatataagttatatatatattttgagacagggtatcactctgttacccaggctggagtgcagtggtgtgatataaactcactacaacctctgcctgctgggctcaagcaattctcccactcagcctccaaagtagctgggactgcaggcatgtgccatcaagcctggctactttttgcattttttatagaaacagggttcttgccatgttggccaggctagtctcaaattcctgggctcaagtgatctgccagcctcagccagcctctgaaagtgctgggattacaggtgtgagtgagtcactgtacctggccataatatctttttttcctaactttttagattttaaaggcttaaagttaatactatctaatgttgatcaacatattgtgaatgaacagtctcacatacttgtatgttacgacagtatgaaaaaggtacataaattttatgtgtagacacctgtcacacctgtaaattccatttctaacaatttattgctaggaaataattgagcacaaattacaatgtataataagaatgctcactggctgggcgtggtggctcatggctgtaatcctagcactttgggaggccaaagcaggcagatcacgaggttaggagttctagaccagcctgaccaatgtggtgaaaccccatctctactaaaaatacaaaaattagctgggtatggtagcatgcagctgtaatcccagctactcaggaggctaaggcaggagaatcacttgaacccaggaggcggaaattacagtgagctgagatcctcctactgcactccagcctgggcaacagagctagacttcgtctcaaagaaaaaaaaaaaaaaagaatgctcattaaagtgtagttagaggagaaaaaaaggaagtactataaatgtccatcaataaggcacaaattatgttttatttgtagactggaaggctatgtaaccattaaaaatatttatcaatatttattaaaacttattaaaaagtctatattaacatgaaagatagcattatataacattggaaaagcgttctgtagaacagtgtgcctaataatatatgtagaaagatgctcactaaaattctaacattttcctccacgaattgggatttttacatgtttttttgttttctttatacttttctgtatttttggtatactttgcctcaatttttttttttgagacagagtcttgctctgtcgcccaaggtggagtgcagtggcatgatcttggctcactgcaacctccgacccccaggttcaagtgattctcctgcctcagcctcccaagtagctgggattacaggtgcccgccacctcagccagctaaatttttgtatatttagtagagatggagttttgccatgttggccaggctggtctcgaactgttgacctcaggtgatctgcccacctcagctcctgaagtgctgggattacaggtgtgggccaccatgcccagcctttaagagctttattggttttgatcttaaaagtattatacacctgttagaataagttcaaacaaaacaaagtattcaggccactttgcctgaattttataattagaataaacatactattttcatttagtaaaagaatttttaaaaaggaggagaaggagaaggcaggaaaaagaattgttccaaaggcactgcgatattattaatgaatagacacctctgaaattcaaaattcctaaaatctcattcttcactacatggaaactttcagaaccaacagaaaaataaagctttgttttaaaaatgaactttgccaaatctacatgtgataaaaatcacacaagactaaatataggtccacacacatgcagagacacaaatgagtgcatgtaaaactagtgaaatctgactaaggtagatggattatatcaatgtcaattttctggttgtgatactgttctattgctattcaggatgttaccattgggggaaactgggtgaagaatacatgagatctctctgtggtattttataaaattgaatgtgaatttacaattctctcaaaacaaaaagtgtattttaaaaagtgaactttgtgcctggaaaagtaaaacagaggtagcttttcttagagctgtagctgaattatcactaagaagtcccattttaggttctcaaagttagaggcactgaaaggaaagtacgttttagtgagcacctactgtgtactaggccattacacagccagagtacctatgaagcaggttagatgtgagtctgttttatagaatgataacgggaggctcagagccagtagaaactcagcagtaacttgtggagcaagaatttgaacccaggtctgtctgaaagcttaggctgtcctattgactacatggctggaatggcttaaaagacaaaaccaaaccaaacccttactcagtgttatccatatcaagaaactccatataaagaaataaatattcgagtgggtggggaaaaaaaggtgcattgtaactaggcaacaggaatttcaaaatgtatgcctatacatgaatatcatctattagatctgtcactgcagtcctgactattagaaagttctaatagtcaattagctgggcgtggtggctcacgcctgtaatcccagcactttgggaggccaaggcgggaggatcacaaggtcaggagatcgagaccatcctggctaacatggtgaaaccccgtgtctactaaaaaaaatacaaaaaaatagccgggcgtggtggcaggcgcctgtagtcgcagctactcaggaggctgaggcaggagaatggtgtgaacctgggaggcggagcttgcagtgagccgagattgcaccactgcactccagcctgggcgacagagtgagattctgtctaaaaaaaaaaaggttcttcccaatacctaaatggaccaccttctagctaataatccttcaccaaggaacaaacctttgtcctcatgttccttccttaataaaactggatctccactgctggtgtgaccagggcaaagtctgctccacaactctctgttctcttgtgtcttcttatattgcaagattcattaacttttccagtttctgttttcacatggggacacttggttatttcccattctcccaagtcttccatcattatggacgcagattgacaatctaatgtaaattacatgcctctgaggtccaggcaagagttggagggtggatctgtgaactcctggaactttgggcaaaattgttgggtctgaacaaaggagtatgtttctgggaagagagcatttcacttttattagactctcaacgtagcctatgacccccaaatgatagaaaatactcctctaattaagcagctccttggggaaatggctgattccggatctgaggaaatgcaaaaaggagcctaaaacatctaatcataccagaaactaaagaagtcattgaagcctggagtcatggctcaagaactcaggaaccaacttaaagatgggaccatttgagcatcaataagaatggattaaaacacatcaaatatgtttaaatccatgagattataatacaccgaaatgactcattggccacctttggtggctactagagcccataccacgattttgaaaactaagaaataagagtcaagtatttattctgcctttctagtactggctacacctcaggataagcaaatggttgaagagggaacacatcttttttttttttaaatggagtttcactcttgttgcccaggctggagtgcaatggtgtgatctcagctcaatgcaacctccgcctcccgagttcaagcgattctcctgcctcaacctcctgagtagctgggattacaggtgcccgccaccatgcccagctaatttttgtattttttttagtagagacagggtttcaccatgttggccaggctggtctcaaactcctgacctcaggtgatccgcctgccttggcctcccaaagtgctgggattacaggcaggacccaccgtgcccagctgggaacacatctttttatagaaagagtctcctaataaatgatgaaaaactggtaggattagactaataccatatttcagtccctaattaaataatgggtctgcatgaaataatcatcaatggctgctaacattcttcaaagagaaataactgatattatatacttcttgaagcacacaataccatcagaatctgaccgagactgtaggtccaactcccaatgtataggaaatacataaatcaaaggaatggtttaaacaacatcaacacatcagaaaaagttatagaaaacatagcctgtttttttcaacaaataatttgcaaggaaaaaagaaaaggaagaaaagaggaaaccatagactaaagagataaagatatagagattcaaaatggcaactctttgactttagtcaaagtataaacttcatttgaatccttattaaatggtacaaagacatttatgagacaatggagggaatgtaaatgctgactagctatctgattaagaagttactgccattttttagatgtaataatgatattgtagaaatattttttaaaggctcttttatagatatacattgaaatatttttggataaaataatataatagctacaatttgcttcagaataatccaggagacagggagaagggaggtatatatgaaacaaactttacccatgacttgattattgctaaaaccaggagatgggtacatgccacttattatactattctctctccttttgtatatgtttgaaattttccacaataaaaagttagcaattcagaatataaacatgtttcaacttgtctggtaatgaaggaagcccaataggaataccaattctgaagtactgtcactgggttattttaaaataaaatttctaagtaatccttcaaaaattcaaaatgtattttaaaatagcattttgtgtggcctgagtgattactggcaggttttgagtaatctgattaattctaacacatattagaaatatctaaacttttttcctacagaagagagaaaaaaaatcctaataatcagtcacagttgtttggtcaggcatactgcccacgctgctgtgcggtgggtaaggcaatgaaatgaaataccagcaggatctcgacaattaactactataccattgatgtgccatgtacagatgttaggaggaaaagcaattcatgtttgatttaaactaattcttcaagtgatctttactttaggttaaaaagaaatagagccagccaaaaactgcttaaaaattaacaatgtaattacaaacatcactgaggaaacactaatttatgacaaggctttaaagattggttcagtcggccaggtgcagtggctaatgcctgtaatcccagcactttgggaggccaaggtgggcggatcacctgaggtcaggagttcaagaccagtctgaccaacatgcagaaaccccatctctactaaaaatacaaaaaattagtcgggcgtggtggcacatgactgtaatcccagctactcggaaggctgaggcaggagaatcgcttgaacctgggaggcggagtttgcagtgagctgatatcgtgccattgcactctagcctgggcaacaagagtgacagttcgtctcaaaaataaataaataaatagataaataaataaataaataaagattggttcagtcgccacaggttattaaaacacgcctccagtcctaaatgatgaccaatcatttcttttttttttttcattcttgttgcccaggctggagtgcaaatggtgtgatcttggctcactgcaacctctgcctcccgggttcaagcgattttcctgcctcagcctccctagtagctgaaattacaggtgcccgccaccacgcccagcaaattttttgtatttttagtagagacagggtttcactatgttggccaggctggcctcaaactcctgacctcaggcgatccacccgcctcagccccccaaagtgctgggattacaggcgtgagccaccacacccggcttgtgcatttcttttttttttttcgagacgcagtcttgctctgtcgcccaggctggagtacagtggcgtgatctctgctcactgcaagctccgcctcccaggttcacgccagtctcctgccacagcctcccgagtagctgggactacaggcgcccaccaccatgcctggctaattttttttctgtatttttagtagagatggggtttcgccctgttagccaggatggtctcgatctcctgacctcgtgatccgcccgcctcagcctcccaaagtgctgggattacaggtgtgagccaacgcgccaggccgtgcatttctaaactaataaaaatgtatagtagtgggaaggaggggcgaggaatcactttctcctacagtggcttatatccctgagaacaatgcctgtcttttggaatctgtgccggagcacgcaggtgcacctcagggaggctgttacttcttaattacacaggaagctccattcccaggggcttctgccctccccctcctccttcctttcccacattagcaaataactggggaattaaagcttcaaaggttggtgatgacaggtggtgacagactgatgccctgaagtccaggtgaatagcgcacagtggccaaggccgacctcaagtgaaactcacacttgcatcagagatggctgcagaattgagggaaatcattttcactttcctggaagggagaaaaattattttctggtgttcaggctcacaccagatgtcagagtggaatgctacaccgttcttgacttcaagggctttccatgggtagccacagcaaaggagaaattctgaaaataaatgaaacatcttccgaaactgggaaggaaattggagggattttggggggacggggaataagttttattttattctttctcctaagcttatgattttagtattccaagaccttatgcttgaattacttagcaagagggcatgcttatgcagaagacagggaaatgaagagaaaacagcaggcatatacaaaagtgaaggttccttaacagagttcatggtggagatagtaggcaccagtggagtttttatccagaacttaaaacttaggaaatacctatgatgacgctttagctggaagtaatggagatatctgattccaaactcatattttttctttattatttattattattattattattttgagacagagtctcactctgtcgcccgggctggaatgcagttgcgtgatctcagctcactacagcctctgcctcccaggttccagagattctccagcctcaacctcccaggtagctgggattacaggcacacaccaccacacctaactcatttttgtatttttagtagagatggggttttaccatgttggccaggctggtcttgaactcctgacctcaggggatccacctgtctcagcctcccaaagtgctgggattagaggtgtgagccgccgcgcccggctcaaattcatactttaaatgcctatttgcaatcagcaaagagccaggtatgctgcatgctgcttgctgtaaggatttggcttcactggcccaaattttttcactccaccaaaagataaggcacaggcccacttgtccaatcacatttgctgaaaatactgtagcatgagtgtagacaaacttcccctgaagctgctagaagtgtctagttaggagaatcactggatgactgcatgcagaaggcctttagggaacctacagtccaatctccttaccttatggtgtaaagcaggcccagaaagcggaagtgacttgtcccaagtcgcagcaaaacaggaacagcctgaggcttagaactcacttctgattccagagtgaggctcttccctccagctgataaacatggtccgtggcaggcaaggaccagagcgaacctaagcaggttaggggcggggtggagccacccaggaggcactaacagcgcagcagctcatgggagagcttccaagaggccagctggcagcaacccaccttgggtactgccgacctcaacctcagggggtcacgggagcaccctaggtggatgaattagcatacaagtctctctggtctgtgccaaagctttggggccttgctaaatttagaaatttgaggccaggtgcagtggctcacacctgtaatcccagcactttgagaggctgaggtgagcagctcacctgaggtcgagagttggagaccagcctgaccaacatggagaaaccccgtctctactaaaaaatacaaaattagccgggtgtggtggcgcatgcctgtaatcccacctactcgggaggctgaggcaggagaatcacttgaacccaggaggcggagactgcagtgagccgagatcacgccattgcactccagcctgggtaacaagagcaaaactccgtctcaaaaaaaaagaaagaaatttgaaagcagccagcaacatcaaggcacagatggagcttgagctaccctcttcaggctattcagaaaattctcccaaggggaagttgggaaggagaacttctatttggccccagcctaaactctcctggaagctcgatggggcctctgtcagctttcccctctggacctgcccatttgtcccagaggtgcccactgaggctacctcaatgcctgtcaaactaaaacttaaacctaagagtgtctgcagcatggtctccagccagcctgatcagaagactatggagggggccaggcacgtggctcacacctgtagtccctgtaatgctagcactttgggaggctgaggtgggtggatcacctgaggtcaggagttcaagaccagcctggccaacatggtgaaaccccatctctactaaaaatacaaaaattagctgggcgtggtggtgggcacctgtaatcccagctactcgggaggctgaggcaggaggatcacttgaacctgggaggcagaggttgcagtgagccaagatcccaccacggcactccagcctgggtgacagagtgaaactgtctcagaaaaaaaaaaaagaaaaaagaaggaggggcatactgactcctcactgaagaatgggatagacaccctctattctacctctcccagcaaggccataagtctttgctctgaaaggagccagactttagagccggctacaggtggacatggggtgaagacatcaggttgcgagggtaccctctctcgttccctaggagcctggcccctgcaaggaggggcacctttaaacaatcaagcatagtgagtggggcggcaagcagagcagagacacagacgacagcggggtggagccccaccagtccctctgagtataaggcagagggagtcccgctggggtccacatccctgtgtgtctcgggctgatttggacacaaggctcacacattcatcctacctgccccagtgctagctggccgaggatgccaggctgtacccgaccttaggctgtgcggcttggaacctggaccggggcaggaattgacaggttcccccaaacaatgtcactcccaggaccctaagacctcaagcagcagaaaccacaattctggatgttacgtgcagcgccagctcctgtctgccctgcctccttatccctttctcccagggcgactttggaccaggtctcgaggccgggagaccggccccagcccgcccgaccgggatgggcctggcgcccgggggaggccgcgtcgtgctgagacagctccgagctgcctccccgcagccgcgggccgctacaatacggattcggcggcgagaggaaacagtctggccctccaggggacgcagggaaatccaacctttgggtcgggggcaattaggactgggagtcgataccgcgggcaacgaatgatgaatgaataaatgaaaggatgaacagagtggcgaggcggagatgggccatgcggggcgtcccgaggagggtgcccttccttgccccgatgctgccgggaccgtccctcatcccccaggtcgcagcagactcagccaagacacccggtcctagtgcgaacacctcgcgggccccgggagacgcctgggcgcgcggtgcagctctggcccggagcccgcattccggcggccgggaagtgcctgccccgtgggcagaacgcgccgagttgccgcggccccaggagccgtcctgccccgcgcggcagcagcccctcgcggcggcctccggaacccccgagaccggcccccgggccgcaaccccttacccgccctcctcggtggcctcgctccggcttaaagcggtcatcccggcgcctgcacccagcgccccgaccgcgcgccgggacccagcgcccgccggaccccgcccgccccgtcgagagcccgccccgcccgcccgcccattggcgggtcgcgcgggccgggcacagcccattggccgttcctccccctcattccccagcttccccagcttctctccttccccaccttccccaggtggggctccaagctctgagcagatcctagcgctcggttccccggactgggaggtcccggaggccagggcctggcgcggcacctcctgtccctcacgtcgagggtattgtgtcccctctggacgcttctgtcgtcctagtcttgcggcttgggtccctctgcaggaaccaattccggcccctctccaacctaacccttcccaacatagagctccggataagtttcaattttaccgtcagtggggaacaccaaaggggatattgaacaccatggtctgacagccaagtcaccaccacgaacccgggagccaggatgctcccacgcacttttgccggagttaacattgcagtttctccaaggaaatacacttttggaggagtctgcaaaggggctgaaggtggacacaaatcaaaggcagggaagcagaggcacgtgcgctcagtgtgacaatgagcttttgcctggcctgcaggccctttcctcttccatccccaccaggacacttggtccttgggagtgtggtcaggggagaggaaaagcgcaggccagatttggtcccattcccaactctctcccccagccctttggcactacagcatcatggtgggagggcaccagcaaacaggaggggtcccaaggggagcctaggtccacaactgaggacctgggagccaaacccagtctcaggcgcccagagctgactcctcctacagcccccataagggatacgctaatgcaggaagaccaaagtggaagaaccatggccaaggccactttgcaatttgggtttatctaccagagtgggagggaggccttgtccctgctctttcccatcttcggttcacgtaagccattaaagtctccccgcagcactgaagggggcaacctgtaaccctaagatagtaagctactgctttcccagcgcctctgcaccaggaggtgggcaggatggcaggtgacaccaccatagctcccactgcggggcacgaggctgcagccattcccagcctgctcagagggcagggttcaaccacctccccctccccagcagaaaagagaggaaacaggtgcttcagctgttgtttattgacatacaggtaggctctatagcaacaggcctggaggtgctgcagtagtgggggaaaatggaaggtggagggtggagtgtttgctgcaggacagctgagtggagggtggggacaggtgcaaactggagaggcctagagagctagagaagcaagtaagggccagggccagagtcggcttcaatggaacaacagcccagtgccctaaggcccctaactcttgctggctgtttcttgaccccaagccagggttgggagtcctctgggcatccattttttctaaaggaactggacagagtacacacaggaaaggaagctgtcaccctcttgccatctggctccaggggcctccagtccagcattcctccttcttcccttgattgggtggggccacatgatgggcagccaggctctgggctgtcccactagagcaggctgcaaacacagccatgtttcagtgaggcgttgatcttcttccctggtgtcccaacctaccagtgccacgttacagcccagagtgagttctacaagcgttgctggcctaatggatgggctgggggaagggggtgggacaggggctggaggaggggctctggggtccatcacggcacaggaacaacacgcatggtgttggtgaagccggagccagggcgccatccggtcagcacaatgaccacatctcccttcttgaagaagcctcgggccttgcctggaggaagagaagggaggttggtgagtaaaagccaagccaggcaggtttgcacctgggcagctgccccatagcctgagtactgaactaggctggctgaccactacttcctcacaccacaaggtggcaccaaactcacagcccaggcaaacaggaggaaggccctgaaatgtccttatcactcagatggcagggttggcagggacctttggacatcattcactatcctggagagggtgcaaagccttgcccagggtcagagctagctgcttcctgtcatctgatgataccctaccttatacagggacaatggccacatcagtacgtaatctgtgtatgccaccccacagcacaggagctgtggccaattttatttaaaaaaaaaacaaaaaacaaaaaaaactctcagtaatgagcagatgccaaaaaatggacaattttgctttgagccccagactagaagagaagaggaactgaattgctcagccctacaactcaaaggacccttttccctcctggctcagcttaggacttcggagaatgagagattcagaatgaacattcccaataagggagaggaacagtcgctgggccttttgccccactaaggtctgtgtgttcccctttctattccccaaactttcggggtcccacagaagccaatgctcaagcatccccaagctcctctaggctctagcccctgctccagccacgtaccaacattcatggcaaagttcacccggaggtccacgtcctcagcccaggcctcctggactgggtccttgcacagcacagggaagatgccacggtacaggtgggcctgacgagctgtctggggattccgggtcacagcaatgatgggggcacgtgggcggtatctggccacctggtgagcagacctgagatgggatgggggacatacagaagagaccattacacgaggccccaggaagtaccctcagggcgttcaaacagctcaccctctcatccagctcactgagggctctggcctcttcaacatctgctccctaggacccctcccgaggctcgggcagcccctcatcctatatcccccacagcatgctaggttaccatttgccctctacccccattccacaggccaagggctcaggatcaccttgacccagcaagatcagcctcacccacttaccccacacagcccatggttggcagaacccctcctacaccctgaactctgacacagagaggcagccctggcccaatgtcaccagcacccattcctctcgctgccaatgacagtgacaagccaagcagcacgtgactagcacctgactcttgacatctgcaaggagcagtagcagagctgaccagccccctgggaatcaacatcaggcttctctacttttgtgccctctccctgccccacatggcccctagctcctgaaacagtcccagcaactgggctataaaggcccagaatcaaatctgagtatctagatgaggcttagaaatctaggtgctactcagcaggcaagaacaggaaatgggagtgttgctgcaggagcagctctgcctgccaaagctcctttggaaggcaggggacccttctaaagcccctctgccaggcactttcttgaacactgacactgcacacttgtagctgcagctgtgtctcaggagctggggaggggcaccagaagggaagttatgaggacactcaacaggtgtcagggaaacttaagccacatcacagcagagaagtccctgcacttcacgcttggcctctatgcaaggccttcagagggaagcaattgctgaagccaggaccagctgagtgaaaccccagaagactagagcttaaaatagccaaacagcaagaactggaccttttaagaaaggtcaaccctacgggttggagctgttcagccaagagtgggaggctggagccctctgctgagggcatctgcacagagcttgtgtcctggttctctgggctgcccacgcccatctgctgctcctcagtgcatgggcactgcctgtttgctcccctcttccaggaaacccttgctgccctgtggacagggacaaggagcatactccctaactaggagagtgaaggacattaactcaatgtcctgggccaaggaagggatcccaagttggaggcccagcataggccacacagtcctcagcctggctgccaggccccacagaatgtcagccaagatagcacagcaacctctcctgagctggaacccaatttgtctttagggctcaaaaacagcagggactagtgtgccaaatggaggcacagtaaacagcatttaaataaattcatttcccaactgaaatttttaaagagcacatagtaactggaataagcaaaagtggttatcttttacaattttagaggactaaattttcaatatcaaataaccatttgtagtcagcctgtgcactgttatgtaataaatctccagcataaatttgcttttgatccaaatgttctgacattccttatgagtgctacctagagtcctttgggcccagggaaggggctctgctcaatccttccctgcaggcccaaggtggcaggcagaggggtcttaccttggctcagtgccacctgagcattgttcaatggactgctcccaggacccccaaggtgaggtaccactgagcagggcattccagggagccgctgccgcctcctacctgccagacttggtgaggacgattatggccccactgcagcacttgaaggaggcctccacggcacccacggcggtggcttctgtggggtcgctggtaatgggcgccaggcggcggagttcctcaaataattgcaagtggtagatggcagcctctgcctcacgggcaatctaggggagcaacatccgtccagagggacgagagggggacagagctttgtcagagctttgtcacaaaaggagagggaggggaagagtcaccggacagctggtgaggaacatgttcctgggaacaaaggccaagaggagcccaatcactggagattctgagctgagccaagatcaagactccacagaaaccagtccttcaccaagtgcctgtgacatctactgtgcctactgagccacaggaccctttggtcctgccctgccatgacctccctggcggtgttcctacagacgagaagaggctctgtgcccagatgccaggttgggcctggctgtcttctcctagagcaggtggagcaagaggctggttatcctaacagtgttacctgcccttagggccctacctgccagactccgtcagaactatcaaagctgctgctaaacacttataagaagcctccacgctgcccatggccatggcttccatgaggtctgtggagtgacttgaggctcgcacaagttcttcaaacagcttgcggtggaacatggctgcctcagcctcacgagctatctgtaaggtttaggggaagagggggcaaggaagagggaaggaggaggaaaaaaacgagacacaacacatgggaagacagaatggggaatttatcagagaggaaggtaaccttaggttaattggctaaatctgtccttcaggcagatgcagaggtagggtgatgaaagtccaactgcttcaggaggtgctgccacttcccctccaatacaggggaaattggctcttcccttctggaaggattttttcattgggggtggagggagacaatctggcagtaggctctagcaccctggcatgaaaacatgcccaggctgggcccaggccactccctggcagaggacttgaccacgctgcctcatgacatagcttacaggaaggaacaggccctccctcctcacatggctggttgattaggcaggctcctgcccagcctccatgcatgcatggagtgagcgctcacttggcttcaggcacggggatgcactgagcctttccaatggcctgccatggcaacagattgagcagcgctggaaagctgggatcaaagccaaagcaaggcagctcaactgagtttgaagcaggagaacagaaaacgtgggctaacttgtgagaggcacactgaacagccatgtgaagagacagatgcctgtggaagcatgcagatatatttaataagacacttgattaaaatctaataattaaaacagtcatgagaaagccactgagttatttatagatcacttgctcagataagaccaagaatcagaaagacaatgtaagctttagaggattataatgcaatcaccagcatctcagtaaatgatgggtgagggaagaatcggtaataccccctcatcaatttcacagtagaagcagatgtgtggcaggatgtactaggttaaaggtattctttctgtaagaacggaatgcatgcagcccagaggacaggggacatgaacaggaaacagagccatacctggtactgctcttagttatgggtcataaactgcatcagttagacacaggagaaagcagtgaacagttaatggaaggaactgttggccagtgttaactggtgacacagaaaggaaaggtctagccacctggaggggcagctacagcctagcccagacctgtaacttatcttctgagcagtgccatgcaatccaaaccttgcagccctaaagtatctatctgttcataggaaacaccagggtatggaagaaaggatatggaatttagaccctgagcctgaatcttagtctctgaccccactgacaggctccaaatggagacctgttctcatctcctgctagacagagcatgatgttgcaggagagaagactggctttggaggcagtagacctagattcaaacccaggctttattggccatataaccctcatctataaatggaggtaatgggagttaggaagattacatccatgtacacagagacttatcagacacttaataataacagcaatgaatatttaatgctaaggctataattaaacatatctaatccattttacagatgaggtcttaagaggttaaatgacttgcccaaagacacattcaagtccccacattctatgcagtgatttcatggttcagtatatctaagtcaagatcagcctctgttcctcctttgagaccatgaagtcacacgattaagtagggaaattagagagaggggatgtgtggagagacccagaaaggcagccactttagtggtgactggttcaaggtgcaccgtctcctgggacaccttcctaccatggtggcaattgtgagactgcgccaagagtatctaagcatcagaacagcaatcacatcacacgaatggtgaggtgtcagccaggcccagtctacattaagtgggcctgggagagaaatcactctctaccgatttttttgtttttttttttatgtttgtttggtttcttttttgagacagggtgtcactttgtcacctaggctggtaccatcttggctcactgcaacctcaacctcctgggttcaagcgatcctgctgccccagcatcaccccctctccaagtagctgggactacagaagtgcatcaccatgcccagctagctaacttgaatttttagtagagacagggtttcaccaggttgcccaggctggtcttctgagctcaagcaatccacctaccttggcctcccaaagtactgagattacaggtgtgagccaccatccctggcctctaccaatttaaatatggggaaacccactaaggatgctgatgacagacagtccggaaaatatccttagtcaagtgtgaactcagttcgctactgaaagagcatttaatagaaatgacatctcttctctgaaagctgtttaagcccagtaacaggatacatagtgaaaaaggaaaggaagatgcccagaccagatgggtgttttagttttttttttttttttttttttctgttttttctggtggcagggggtggcgttttaaacttgggggcttggaggggctgaggtcaaagggcagcgggtctttcactggctagaaagggaatagaaaggctgaaggaaaaccatatctggataaagtttaagttcactgagcatgacctaagactactgggagaaagttaatttccagcactcattttaccaaacctatgtaaccctgatcagggatccctgagttagctccagagctggaacagacagggcaaagggactgagcctccaaccctgagcagtggccaggcactcgacatgacaagctggaagagcctgaagaacgagctctcagaggagaaagaagggaaagagcctccacgactcctccagacgctcagtccagggccgccagggtcagccaccctccccgctgtctctatctgtggccctgccaccagtcactcaacccgactttttggtctagagtaagagcagcagctgtaccccaatggcacagcaaagcaaatccccctacaggcaccatgcaaggccagcacaggcagctcagtgaaggcaacagactccagtgcaggtccacaagggccccctgcgggagcgcctgtctgcaggatgcggggcagagggaactgaattggaagccaaaggaagagggcagctgggagcaggagcccctagcccttttcagaatagggcaaaggtactcagaacttctgactctgaggaagaggtacaagacctcctttcactgcagaagtatcccaggacttaagccatgggaagaattcacaaccttgaagtcagaagtgaaataaactgtgtggtgtccaatgaaggaggatgcctccagagcagaaggaaatggaggggtgggggtgtgggcaggaatgcagaacaggagaaaaaaaaaagccacctccacttccacccccaccctcttgctgctgtaacttggaggataatgaaaggctgtgcataagaggatggagaaacctaaaaagctctgcaccagagcttgcatccatcccaggcccagtccgaagccctgggggatggggcaggccccagaactcaccaggtgctgcatgcgcacagcctccagaggatagtcccctttggctgtttctccagacagcatgatgcagtcggctccatccaggactgcattggccacatcactgccttcagcccgagtggggcggggcttcttgatcatgctctccagcatctgggaggggacagagcattagtgagatgtagcttgagctgtcttcagagacaaatgacagcaagctgatcctctggatagtgagtaggtacacagagtatggctttgtgtaggtacatgggggaaggggattatctgtgtgttacgtgcgacaattccatgggaagagatcagacagcctccagagctttcccatacaaacatgcgagtgtgcacatgagaatgtggggaagggtgggcacatgcctgagtagcacagatgacaggcttcccagctcggttgcaccgtccaatcatcatcttctgagcaaggaagaccttctctgcaggaatctcaatgcctagatcaccacgagccaccatgatcccatcactggcctccaggatttcatcaaacctgatggacaaagttggggggagagaggttatatagaacagaggccacaagtatggcagtagacaagaagtttccctgggattccctaacttagatgtccttgtaccaggacagacatccatgatatcatcatgggtgcacacagatggcaaggcagtccagctaccttaggcccccagagtgggccaacaattctgcctgctgggcttcaacaccaatatggatgcttcattgacggaagaaaggggagagggcaaatccaaatgggctcattcccaaggtctcctctccaaatcccatgcatgttaggggtctctctagggcctccattttccaatcagcacttcaagacagggaacctgaggcctgatgactgcttccaccacaaagacccatggcctcatctagtcaaggacacttgaggactgccctttgaggtggcccactccaacctgctgaaggcaagagggaatgtggctttgcctggcctagggccaagttcagctagcctatggcttatcaggatggcaaaggggaggaccccaaattgcctggtacagaggatatctacacaaagctcagacagtaaggccactacagtgggtgcacagggttgctcccccaccctccccaaacacacttctaatccacaagagtgtgtctagcatcttagttgtgctgagttgtattcctagcaggatgccaaaaatggtggccatgcccactgggctctactttgtgagcattggggagggggtaagctaagttggggcaatctgaaactggagaagaaccacacatcttcctctgagagtggaatggaccataccagagttagcatgatcactgagccagctgcattctaagtgaagaccaggaggccataagctttaacatggacaccaggccctgaaattccacatggctccccaggaagggccaaaaagagccctttcttaagtgtctgctgtcatctttccccctggtccccccattccagcaaacactggtagtgtttctgatcaggaacagaacatcatggcccctggtcctgtgagcagtgaccctgttctctcaaatgttggtccccaggcccagggaacaatgtcaagctgccagcatctcaattacctgggaagcttttttttaaaaaaaacaaaaaaacaaaaacaaaaaaacataatgccttctactctcctaagatattctgattcagcaggtttggaactggcttgggagtctacattctgatgggctaggggctgggaatcagacattcacaggatggaccatgcccttcggagagctgcgctgggactggagcagggacaacggggacttgcctccgaaccccctcatgattctcgattttgctgataatcttgatgttctttcccttctctcccaggaccttcctaacttcatggacatcagatgccttgcggatgaatgacgcaaacaccatatcaacatcctgctcgaccccaaacttcagatcctggatgtccttctccgacacagcaggcaagtccacagcagccccaggaaggttcacacccttcttgctgcccaaggagccaccattttccacctccgtcaccaggaagtcggcacctgtatgaaaaagggtaagtaggggaggcagagcacgagggcacaggtcaacaggaagcaggcacctttcccgcaaggacagtgagctgggaagtggtgcattatgggtgctggagctgttttaccagagttgaaaacctactacactgtgtaatcctgggcaagccatttaacctctctgtacctcactttcctcacccataaataaggataattaagactgttctgactttgggaggccaaggcaggcagatcacctgaggtcaggagtttgagaccagcctggccaacatggcaaaacgccatctctactaaaaatacaaaaaaattagccgggtgtggtggcgggtgcctgtaatcccagctactcaggaggctgaggtaggagaatagctagaactctggaggcagaggttgcagtgagccaagatcatgccactgcactccagcctgggcaacagagcgagactctgtcttgaaaacaaaacaaaacacagcgaaacaaatatatatatatatatatatatatatatatatatatatatatatgtatatatatatatatatgtatgtatgttcctgtgttctccagaaccagaagaatgtaactatgctggattaaagcctatctttgaggataaatgagttataaaagggattcctgagaacacacagactcaatctcactgccaggcaaccaaccttcccatcttccttgtgtcaaggaagtttagagacaaaagactgttttagacaactggactccagctcccatacgtacctttctgcttcacctggagagaaataagcccatcatccacgtagatcttgctgcccacttccaccaccttgcagatgttcttgtagtccagccacaggatgttctcgtcacacttttccatgtaggcgttatccagcgtgattttgagagtggctcccttcttcagctccacctctgcagtgccgctctagggacaagagagtaagcaagagtccaaactggagacaccagtagcagcatcacctcagaaggaatggaaaagctctttcctcccgggaacaatgctcaagtcactgctaaaagtaatacagttttttgctcttattctctaactctgtatacttcacggaaataatccaagaaaagaatatgtttcagttatgctacttaatgatggggaaaaagatacaaagagatggttctccaagttagaaagcctaaagtttaggtttttagggtaaaaaaaaaaggttcctttgtggtaccatttcctagcaaagtagatcaaatcaacattgtttacagtgatgaataaatcctcatttgtagacctcaactcctctgcagtccttcatagtactgggaagaaacatggcaacccagcgctttggaggacatgtctctggggcatattgcctactgagccttcccctcgctctccgcagaatactcacgcccttgatgagcccagttcggatctcaggtcctttagtgtctagagccacagcaacgggccggtagaggatggggtcagaagcaaagctttccgtggctgtgcgcacattcttgatggtctccgcatggtactgggggaaaagaaggaagatgacaagcgtgctcccacactagaatccagctccaattcccctgcccaggagccaaagctgatcactcaggaaaggcccgtggatgtcttagagctctatctccatcctcagcacgatccatgcactgagaaatcctctacctgcttaatccaacctcctcagcctccacccacttctactacagcactaattcacccaaagggcaaatctttgaaatgtaggtggcaaatttcagaatattgccaccaaaacccattaaggtatgggtgcaaacatgtctcatcataaaagcagctgtgtccccagggctgttcttttttccctaagactcatcaaataccctcagcatataaagctcataaacagggcaaaaagcctaggacttgtgtttggataaggctggtctggcaatcaatgtcacattctgatatatgtggtaatgctgagagcttttcctctattgattccaactacaacgcaaacttgaagttattgacttaagctaacagtggcccaagctaaataactcattgctaaggtcacacagacctgattttctcaatcgctttgttttttttttttttgagacagagtcttgctctgtcgcccaggctggagtgcagtggcactatctaggctcactgcaagctccacctcccaggttcacgccattctcctgcctctcagcctcccgagtagctgggactgcaggcgcccaccaccacgcctggctaacttcttcgatttttagtagagacggggtttcaccatgttagccaggatggtctcgatctcctgatctcgtgatccgcccacctcggcctcccaaagtgctgggattacaggcgtgagccactgcgcccggcctcaatcactttctagattctgattggagggggaaaggtggtcatatgcctttctctaaatgaactgccctttattactccttgcttacaacaaatcctggcttcaatcttttttcttaagcctttcctcctttccatttaccattttgtttgtttaaaagagggactcaggctaagcacagtggctcatgcctataaaccaaacactttgggaggctaaggtgggaggacagtttgggccaggagtttgagatgagcctgggcaacatggcgaaacctcgtctctacaaaaaacacaaaaattaactgtgcatgatggtgcgtgcctggggtcccagctacttgtgaggctgaggtgggttatgtctaggaggtcaaggctacagtgagccatgatcacaccactgcactccggcctggataacaaagcaacaccctatctcaagaaaaaaaaaaaaaaaagacgcagagccaagatgtcaaaagagctctaagatagtgtcatcaataagacattagcggtaacaagggcacctaattcagcactttctgggccttgtcctttaaccaccactgtccaggaaagtggcacctgcaagtaagcctgcctgttattcacaggaggctggagggagctggagccagagcctagcctctaaagacagtgttgcctgaaacctgtgtctaaaaatcttcagcttcttattcaggcatacttcctaatgacagacccttggcttgtctgttttttatagggttccttataaattatgatattttcttgcttactggcttgtaatagaaatagaacaaaatagaatagaatagaggctgggcgcggtggctcacacctgtcatctaaacactttggaaggccaaggcgggtggatcatgagatcaagagattgacaacaaccaggccaacatggtgaaacctcgtctcaacttaaaatacaaaaattagctgggcgtggtggcgtgcacctgtagtcccagctattcaggaggctgaggcaagagaaccacttgaacctaggaggcagaagttgcagtgagccgagatcgtgccactgcactccagcctgggcgacagacagagtgagattccgtctctaaaagaaaaaaaaaaaaaagaatagtaatagttgttttcttttaaggggataggtggtgcctttccttcagagttgacgtgaggagtaaaagaatacatgaagtattaggacaaagtacatggtaattatctaataaatgttacctattatcatcttataatgataagactcaggtgtactgagttccactacagctgtggctttgttgggatgttatcacgtggataagagttccacacatcaatgctgtcctgcggaaggctctatatttagctatatttaggttgtttaaaagtcaaccttaactcaggccaggcgcagtggctcacgcctgtaatcccagcactttgggaggccgaggaggggggatcacaaggtcaggagatcgagaccatcctggctaacatggtgaaaccccgtctctactaaaagtacaaaaacaaaattagccgggcgtggtagcaggcgcctgtagtcccagctactcgggaggctgaggcaagagaatggtgtgaacccggaaggcagaggttgcagtgagccgagatcgtgccactgcattccagcctgggtgacagagcgagactccgtctcagaagaaaaaaaaaaaaatgtcaaccttaactctacttaatcccgatgtagaattttgttctcctagaataaaatctacttggtcatggatcaagacattcctttcaatcactactggatttggattattaaattttatttgttttctgcatctaagtgagactggtctagcacactaactgttagtacctgcctggttttggtactgtccttgtttgatctcagtatcagcgtatattggtttcaaagaacacagtgggaagatttctatatttctctaggctctggaacagtttaacaatgtaactgaactttgaaggggagacaattcagccactaaaatcatttggacttaagtgttctgaggtgaaccagatcttaatcactttttcaactttttggctggagtgcagtggcgcgatcttggctcactgtagcctccacctctcaggttcaagcgattctcctgcctcaggctcccgagtagctgggactgcaggcatgtgccaccatgcccagccaatttttgtatttttagtagagacagggtttcaccatgttggccaggctggtctcgaactcctgacctcaagtgatccctccgccttggcctcccaaagtgctgggattgcaggtgtgagccaccgcacgcccagcccactttttcaacttcttatggccactggtctattcatattttctatcttttggatatttatcttttctttgaaaatagccagagtcatctctctatataggaattaagttataagtctttcttgacttttaaaatctccaatgtgtaggaaatattctcttttctattcatactcttatttgcacatcctcgcattcttcacctggcttctcagaactttctattttactattttttccccacaaagaatcagctcttagcttaatctgtcaaatttattttcatttcattgagctataatcttacaaaattattttcttcaccctttttagggttttcctcccctagtgttctgagttaaatatttatttcatctaccttgagatctttgctttctaaagtaagcacacttcagttttcttgactttgttcttaatttccactaaaaaattttatcagagaatgtgtctgtataatttctactttatgaaacgtgggggtttttttggtggcctaatatatttttgtaaccatgagtgtttcatgcaaacatgcatttttggtcttggggatgtaaaaccatatattataaacataccaattattaggtatattattcaaatctatgtcatatatcataatctcttagagcatctctgggaggtgtactgagtcttccacttcagctgtggctttattgggatgttatgtggtaaagcatccatcaatgctgtcctgtggaaggctctacatttaggttgtttaaaagtcattatttctaggccaggtgtggtggctcacgcctgtaatcccagcaatttgggaggccaaggcggatggatcacttgaggtcaggaattcgagatcagcctggccaacaaggtgaaaccaagtctctactaaaatacaaaaattagtcgggtgtggtggcaggtgcctgtaatctcagatacttaggaggctgaggcagaagaatctcttgaacccaggaggcagaggttgcagtgagccaagatcgtgccactgcactccagcctggatgacagagcgagactccctctctaaataaataaataaataaataaataaatctggaaaacatggcatatggaaccacatgttcagcaagaatgcatcttgcccatgtgaactgccaaaagtgagggctgaagactagttgccaaagctgttaaaagagggctgggcgtggtggctcacgcctttaggaggccgaggcagtcggatcacctgaggtcacaagttcaagaccagcctggccaacatggcgaaaccccgtctctactaaaaatataaaaaaattagctgggcgtggtggcacaggtctgtaatcccagctactcaggaggctgaggtatgagaattgcttgaacctgggaggcagaggttgtggtgagcagagattgtgccagtgcactccagcctgggcaacagagcaagattctgtctcaaaaaaaaaaagctgttaaaagatcagatgcagacatttgatgtccctctgtcagagtgagagggaagacagtaatctcaacgttctgctcagaagagcatttaaaatagtcagaaactggaaaagtacgccccagcccctagtcaaaggtgcacatgaaacgatagccctgacgtatggtaaggctgaaactgtttacattacattatataaattagaataatttcagatcagtttccaagctgagcccacacacaacctcatcttggtctaaaacttcaaaatgaacacacaagagggacatctttaaaaaataaatagataaaaaataaaaaataaatcttaattataatctgggaataggagtgaaagtagagataatctccaaaagcctcttaaagtttaaaataccaaaatcggagccagctctcatccagcaggtgtggcaggtatcactcgcccttgccatgttagagctatgtggtgttattttactggatgaaggaaccataaagcctacttaaaggtcaacttcttaaaaatctatttctgctccttcccctgaatgcaggagcccatggcagactacagcagcagggatcaacagcgaacagacctccagcattgtcttcagctctctctaagctaagctaacacttaattctctaacaagtaattctcggtgactcctgctaaggaccccttgcttttggaaaactacagaattttccaaaaggtacagggacatgtcttaacctacatggtatgtctgctggacttggtcaggtccccatgacatttaagggccagccactagccaggccataggctgtttatgaacacaggttagggaatctatgatgaagagtcttgtgtttcccaaaaggaggaattcactcttggattgcatttcctgaggctttatttttagtccaaacttaataccaacttccaaatgccagagggcaacctctgtaaggcaattggccttacaggatagcattttctttactctcaacaggaaatacagaagccaagacaggtgcaaagtttgcctcttctgtaattcctcttatcaatgccattacgaaatcccatgatctatgggaaacctatggttaagtctgaaggttttaaaaaggcacaatcccaggctgagcatggtagctcattcctgtaatcccaacatttgagagaatcacttgagcccaggagtttgagaccagccaaggcaatatagtgagacctcatttcccccaaaaaaatttttaaattagccaggtgtggtggtgcatgcctgtattcccagctactcgggaggctgaggcaagaggatcacttgaacctgggaggtcaaggatccagttagccataatcataccactgcagtccagcctggatgacagagcaaaattttgttttataaaataaaaaaataaataagtcatggtacctcagggaaccccaagctcctcagaatgggttaattctaaatctggcaatggaggcaggaatggagccatcccaacagctgctacctggctcctgggcaaggcctctgtccataggtaaagccagctaataaagagcccagcacaaatacagtcctactaggctcctggggaagagtgctaactggtgttattttaatgtaccagaacccctgggaaggcacaggctgagaatacagtgctgaggaagtggggtattacaccccagatagtgcttatgcattaggctcagtccctcaaaacttagaatagtggaaaccgttctcatggacctgcccagttattttggttctaagctagaatcaatctgctagatggtttaccatggcaacacaaggtgaagcagaaaccctgggacaggagagtcaagcgctgtggccaggacacctaaggcttagagggttttccagtagaacctttccatatcttcctttgtaaaagctaagggtaggagaggtgtgtgggagaaccacagccagcaacaaagggggtcctttttgctaaaagagactcagccagttgctttgtcaggacaagagggaaggagagtagggatgggctagtaaagacaaacttcacactgactgtgaaactcagactcatccttgtctagtccactgtggctaaacgaacactgcaccccctccctgtttcctacaggccatcacaatggccatagggtccagccacagctcacctcatgagttccatgagagaagttcagacgagccacattcattccagacttaatcatctccttcaacgtctccactgatcgggaagctgggcctattaggaaaagttttaaagccacaagtattaattattcaaagaaggaaaaacatttaagtttgcttaagtttaaagaatttttttccctgaaaacttttcctctcccaaatagctcaaaagtctttaaaaagtgcatggaaggctactaccgtgccagcttactttcttgatctactgggacacttcgaccatttccttcaagttctgcaggctcccactgtatcagaaaagcctaggttaagacttggccagccttctccaccctcactgaaacccagccagatgtccaaccacagaatcttggtagcacagaacatgttagaaagatctttcctaggtctttaagttgctcctacaaagacctgctaaggaaaacatcttctaaattttgcctatagcataaaacctaaaccatatggattctttttgcaacaaattattttttattataaactggtaatttataatttgggttacaaagttatgtaatccaatacatacagtttggatacaatgtggaataattaaatcaggttagttaacatatccatgacttcaaatacttaacatttttgtggtgagaacatttgaaatttactcttagcgatgtttttttcttttttcttccttttttttttgaggcagagtttcgttcttgttgccaaggctggagtgcaatggtcagatctcagctcactgcaacctccgcctcccaggttcaagcaattctcctgcctcagcctcccaagtagctgggattataggtacccgccaccacccccggctaatttttttgtatttttagtagagatgggatttcaccatgttggccaggctggtctcgaactcctgacctcaggtgatccacctgcctcagcctcccgaagtgctggattacaggcatgtgccactgcgcccggacaatttttttttcttaagacaggatctcgctctgttgcctagactggagtgcagtggtgtgatcatggctcactgcaacttcaatctcctggactcaagtgatctttgtctcagcctcccatgtagccagaactacaggtgcatgccaccatgcccagctaattttttttttttttttttcactttttggagagacagggtctaagttgctcaggctggtctcaaatttcgaggctcaggcaatcctcccacgttggcctcccaaagtgctgggagccaccatacctcgccatcttagcaattttgaaatgtctaatactctcttattaactgtatttgccatcctatgcacatactaattctttactgcaacttcctatgacctgagtcctttcataagaatctgtgtagtatcccatgtagcacctaggtttgttaggacatttagttactcttttcaggagagaaaggtcactgcccatgaagcccttttttgggggaaggggcacacccactcaccaatggtacagatgatgccagtgttccgggctgtgatgggtggtgaatcaatgtccaggcggcacatgtgctccaggaatgtgtcagccatggctgcgtgcagctgctgggtctgaatgaaggcagtcccggcttcactatggggcttcgacatggctgctgaggtcctgggtcgagacaaattgaaagagagtggtaagactgagaagtggttaatataccatttagcacagaaggctgtctcctgcttacacattaactcaataagcacgctttgtacacaagccacagggaagccagacatgatctggttatgtgggtgctcctcatgttagaaaaagggttcaccagattgtgaacaatggaaaggaccttactgaacaagttaaaacctcccacccactccacatagtcccaagcacccacagtaagcaggtctctcttacactgggctgactgacatctacctagacagctttctcaccaccctatctataaataacatcatttaacatgcactgaaggagcttccaatgaaggaagttgtaaccaatcttccagtgatacaaacaactgactcctagcttagtgccttgataagcctagatctctgcatgtcaagctgtcacaaagctacaaatagctgctttgtcgtggggcacccatattgcctctttacaatcctcacccaaacccaaagtcattcccctgaatgcaaaagcttccatcccaggagtctaaacctaaaaccacatctactgttggccagaaggatgtcaggacacgcaaagcaatttgcaatttgcaaagcaaggataacataagggcactggtataattctgaaattatcacaactacattaacaggatagttgcaaacatagagaaattaaagttgctggtcaaatcttttccccaaatgatttttgatacacatcctgatttcttttctaagcctgacaagtataccaccactctgtaacacagaccatcagttccaggtaattaactagcccaggtcacaaccctgacaatggccccaacctttgctttcttcattaatgacttacaactaaactcactcagcctgttagttagctgattagagacaaaaactcaggagaagcttccaggcagtgtttgaataactatcaggtaaggatgtgaaccagaccaggcagtgtttgaagaactatcaggtaaggatgtgaaccagaagcttgctacacgtctcatcagaaagctgtttccttgagttctcagaccaagggctactctttctaaaacgcttgagcctaaatgcttcggccaagcaaggctcaggaacaagctcctctttagcccttccccacctcatcctaaatctcaaagttccaaatcaaggcatctcacacatatgacccttactcctttaccctgttccatctctgactttgtgggctctctgggtggctcgagtagagtatacatctaaatccatctctgccatctccaaagaaggcccgctgaggtccaaggagctctgaaggcagtagtgaacagtctgttggctatggaaaactgatggccacaagtcctcaaccacagattctaaaacttttaaaatggggaaataagataccggctaacggttcaacatggcaaatgcactcttcatttcgatgtgtatttcctaagcccctaatatctactacgtaccaaaatgaaaaaatcaatcctcccttccaggacctatatggttttgtatctcctagcacctagtatgtggaagcattccagtgtttgttaaatgacctttcagtctctctgaatgcctctttgtcagaatcaaagttatgcctctgctcccccttccctaaatctgaggaacttctgcattactgacaggaaagcctggggcccctggtccctttccctacactcatggttgagggagggctcgcataccttcagagctcccagctgggcttagggaagtctggctgttaagggaacattactgagagatggcacatcaggccaactggaacacaaaggctttgctgtggcctccaatgggcctacaatctagggactgtattgtgaacaaaataagatctgaataagtgggttggagtaactaattccactctttttaaaaaccatcagctggctcttcttagacctgagatatgagggtcttcctgtaaagacctggctggggccactgaatatcaggtcatacctttggttctctggggttgggcttccggtgacataatgctccccttttggctcagggtggctccttggcctcactagcaaagaccgctcagagctgaatacggtgtgccctggagagctgcacaaggattaaggaaaaagctgagtgtaactaaagctctttggggtaatggaaaaattaccttaataaccaggtatccaggtgacagctgctctagagattccactgttatgtctctttaaacctgtgatttactaacattccactattctatacaagaacctggtccctccccttttgggagcggggaagggacaccaaattaaacatacctaaaagacctgggaggatatatactgaaattttaataggacgtcattggggtggtaggattacagaaaaaaaaaaatcctctttattaacaaatttactgatataaatataaaaatacttttatagtaagaaattatgtgtacctcttttggaaatatttatatgcatcctataaaattgttgggaggaagtaaatgaaatgtgaagacaccaattccattaatcaattgctgctctatgcacttcaagaataatctgcttttaaaaggtggcagagaaaagacgcatgtctcaagttctgtacactgggttgtgattaaaaaaaaaaaacgatacaagtcttaggccctacatcacaaatgtactgcagaacagtttcaacggcttaagaaggtcaaccttaatacattcagaacctcaaagcaaaaaaaaaaaaaaaaaagtccacaggataatcccatgcctcaaacctgttagttacatgcccaaatccagcaaactagtttgttctcaagctttacagtaaaagcttttgacaatgttctggtacagaagggctgcctccaagtccacgagatgccattagcagataaaattatattggcctcaaacacaaaccctatttcaactatctcaaattaaatctgatgcctataagctctaattttttgccaataagtacaaaaatgacaaatgaaaatttctatagtggatttacgcattagcagtcaaaaaaagcttgcttgtcagcaagttcatccagactccagatctcatgtgtccttcatgctctctacccagccagagacctcatatctcatgcccaggtctttcctcaggctctgacctgaagcctcccttgcagggagggccagagctctcctgccttctccaaaatcctccacaagcctcttcccagcacaaactgcccatcccaccaaccacgtacctagagttgtatgtaaaacactcactggactcccctggctccaggagagcagcccagccttggtttctcagggcggacttctgggaaagactcctctccctcatgccagctgcctggacagtgcctgccaggacatgtggccccacccatgccagtctgactcactattgcatcctcctcctaggaaggcacagacatgcagagccaacctccagccagcagtggaagcctggcgtatccactgatagcagcacacaccatgcccaggtccaggagccttattcttgagcccgagcccctgcagtaagatcttcctcagagccatgtctcctctgtgagaaaggagacaccatctctaagaggccttagtctggagtgacaggttggaacaggcacaatcacagctcagctccaagtgccctattctccctttcctttctcatctcagacagctcctggctttttatattagtttcctttgtgtcagacacaattttttggccattcttcagaaaccaggagacaaaaatcataaaaaatacccaacactcctccctccaactttttttttttcttttttttttttttcagacagggtttcactctgtcacccaggctggagtgcagtggtgtgattatattatattatagctcactgcaccctcaaacgatcctccagcctcagcatcccaagtagctgggactacaggcacgaaccacacccaactcccatgctccacttcttagggccaggactgttgttgggttgtgctgggaaagattcacgcttcactccaccaattcttccacaaaggaccaaatcattctgccctaataaaatagcctggcccgtgagtctgcatctgcctaagtcatttttcctttgtaccaattatgctccgataccaacctcatcacatagatcaactataaaatgatggcacctgatgctcactttctccctccaacgttgccagtaggtacccaagattgtgttccttcctgtgacgtcagtttgctacctacacctccaagccatcatgaaggcgtttcgatccacaactcttccgaacacctgcatccgttagaaagtctgcatcatgatacgctggcattcaggtcagcctgctctctagttctcttcctcaacaatggaaatggagtttctaagatttgccctaatcaaactaggccagcaacatgatcaaaatgggtgacgggccagcagaacctagtaaggtctggaataggcactgttcatcttcatctatagttaagggtaatgacaataatgtatttgcatatgggtgcaggatacagaggataagatatcttctagctaagagacctgggtcttaagcccacactttaaccccaggaggccccacagcagaaagcagtatggtgttaccaggctacacagaacaaaatgagcccacttgtaggttctagtaaaattccctggctttaaaaaaaaaaaaaaaatcttggctcttttatttcttcggggctgaaagtaaatgacttgtcaacaggaacctaaggtcctatttccaactagagtgtggaatagggaagagcagctgatgctaaatgggcctacttccctcaaagaccactcaacttcaggtgaagaagccctaagtcagagacccctcaatgtcctcagatgccgaggatttcctggttccatcccagctgctcagtgcagagaactggtttcagcctgaaggaggtggtttgggggaagcattagttgtcctgggacatggtgcctccttactaggattaaaagtagggcggtgtttctgggtatgatatccacactctaaaatcagcaagggacctgggaccctgatttagggtcctcttaagtgcaactaaggtgggtgatggcctcagcaaagtgaggcactggctcaacatttactggaagggctgccctgcattctagtcggggggataaaggaggaaaggcagtgccaactctccaagagcactgaactagttactatgactggtcttcctacggcagcctttataggtttgcttctatgttacgaattaaagaaaaaaaagttttaacatctgcctctctaccacccagaactgaccattaacactgagccatggctggctgtgttggctcacgcctgtaatcccaacagtttgaaaggctgaggcgggcagatcacttgaggctaagagttcgagaccagcctggctaatatggtgaaacaccatcactactaaacatacaaaaattagccaggcgcgcacctgtaatcccagctacttgggtggctgagacacagaattgcttgaatccaggaagtggaggctgcagtgaacggagatcgcaccactgccctccagcccgggcaacagagtgaaaaactctgtctcagaaaaaaaggaaaaaaaaaaaaacacaaataaaggctgagctgtattttctttaatttcttttttctttttttttttttttttgagatggagtctcgctctgttgcccaggctggagtgcactggcgcgatctcagctcactgcaagctccacctcccaggttcaggccattctcctgcctcagcctcctgagtagctgggactacaggcgcccgccaccaggcccggctaatttttttttttttttttttttgtatttttagtacagacggggtttcaccgtgttagccaggatggtctcaatctcctgacctcgtgatccgcccacctcagcttcccaaagtgctgggattacaggcatgagccactgtgcccggccctctttactttctaaaaacaaaaacaagaattttaattttatacagttcattttttctccatccccaagctcctccaaccctttccacctccatcttaaacttttttttctattttatttatttaaatagagatgggaatcttgcgatgttgcccaggctggtctcgacctcctggcctcaagtgatcctcctgcatcagcctctcaaagtgctgggattacaggtgtgagccactgctcccagccacatcatgcattttgacacccaatcactgtcatgaactctatatccttccagttcactgaagtctatgtacagtgtatctatgtctatactgaaccctataatattgtggttttcttaatgccctaagtggtatactgtatatatcactgagtaacttgtttttcactcagcagcacatttaagatccatccagtgggtatatggatctagctaattcatttaagctgttacactagtccactgtacaacagaccattttatttatggactgtcttactggtggccactctccctccccgttaaactaagtttcttctattaatcaatactcttgtagtacatgtctccctgtactgtgtgagtttctatatatccagaaattgaagtcttaggtcatggagtatgtttatttctatttttactaaataaggctgaattgctctccaaagtggctatatcaatgaacgctgagttgctgccttccacacctttttccacacttggtactgccagactttttaaatgtttgcccatcggtgacatttgtttttctgctcatctaatgttaataaccaaagagggatacccagatagtttcaacgtttacaacatctctatttccctgcttaactcaatcaaatctcctctgaaatggcatggtggacacagtgtgtcttatgtgccctgactgactccactgatgggcagttctttttcgttcatggccaagggagatatcagttgtttaaaattgaagaaacatggccaggcgcggtggctgatgcctgtaatcccagcactttgggaggccaagacaggtggatcacgaggtcagcagactgagaccatcctggctaacacagtgaaaccccgtctctactaaaaaatacaaaaaaaatcagccaggcgtggttgcggttgcctgtagtcccagctactcaggaggctgaggcaggagaatggcatgaacccgggaggcggagcttgcagtgagctgagattgcaccactgcactccagcctgggtcatggtgcgagactccgtctcaaaaaaataaaataaaataaaataaaataaaaaatgaagaaacattatctgcaagtaaactgaagatgtttggaagggataggactcccttcagagaatcttgactgcagtattcagccagcagctgtgctggtccacagtgtgaaatgctaggactggcaacctcactgcccttgaataactggtcttggcatctctcccactgcagccccagcctgcttccaagactgcttgctggcatgaggaaagaggcttagggctccccaggagctttgtctatggacagaagtgggggaggtgagtctcagaggccaccgaaggtactgcagccggcttgttccctcctacgtgcagacaagcacaaaccactgcaggggcggggcttcaccgcactgcatggtaggggccctaaagcacccaactcctgagctgagcagtcataccaagaggcaggaaggcccagcagatgctgcacatcaccctccaccactcacccaggctcaccttcccccaacagcttctttaacaaagtcccaagtatttaaattactcaattatccagtctgccccttggtaaaaaaatgcaagctccccgcaagtatggtggtatcaaaaatggtcttcatatatctggttgtttagctctattcccatctgtatcagaactgatgcttaaagggacaacttaaaatccttaagacctcataccaaataaaccaatctcacgaagacccttgaagatgcaataaaactctgctcacagggtcaacgcattcttgtgttataccagctaattgagatttgactgtggacttttggagtgattcagaaagaagggtaatgtcaaatgagtcattttcctctactccggtctcagtcttagctcttggccaagataacacatcctgacttgccttcataaaagctgaagcaggccaggtgcagtggctcacgcccgtaatcccggcactttgggaggccgaggccggtggatcacctaagtcaggagttcaagaccagcctggccaacatggtgaaaccccatctctactaaaaatacaaaaatattagctgggcgtggtgcaagtgcctgtaattccagctacttcgggaggctgaggcaggagaattgcttgaacccaggaggtggaggttgcagtgagccgagatcacaccattgcactccagactgggcaacaagagcaaaactatctcaaaaaaaaaaaaaaaaaaaaaaaaaaaaaacaaaaaactgaagcaaaataaactaaaacccaagtaaagtgagtttgtaatgtaagtgctgcattttcttctaccttcctgcccacggccgtttcctcatttcttccattgcctcaatattaagaaataaacagctttaggaaataaaatggtttttcctgtgaccccacatcagtgtcacaacattcaaggcacagaagcaactcccataaagtgctagctgtttagagtcaccgccaccaaatttgctaagtcactgggggtacggttcttaaagagctaatgatgctctttgctaaaatatgaatacaacattatttctaatgcaatgcttaaaatgaaagcagttgtgctagacaggagaccaacatccatacattttggctcaagtcagtaactgagaaatgagttcaagaaccttctttaagtcatcattaatcaagtcccaggagaggcggctgtgcccgctacaaaagggccaggaatgaagctgcacagacggcattagctgggcaccgggctctgccagtctacacttaagctcttaaggcagtacagagaaccaggtgacccggaccaatcattttttaattagttgtggctttttttttttttttttttgagaaggagtctcgctctgtcgcccaggctggagtgcagtggcgcgatctcggctcactgcaagctccgtagttgaggcatttttaattaggggaaatgcatgcttcattatctgactcactgaaaggggagaagggactttttaagcctgcaagaaccacaatgtagtttccccactcacccagcgaagataattctctcaaaagcagaataattgaaaggttgagtcatcttccccacagagccccactcccccacagatttggtgatacgttacatttcccttccccacaagacagcccactcctgcccccacagcacctcaggccaccaaagggcaaattatttgctaacaacgctgcagcaggggagtcctgacctccatctcctctgtgacctagggagtggccacaccctcaagacggccaactgggggctactgaccctggctccaatcctaatctcaccagcaggcagagcaagtcaagggctggaatgttcctctggtaggtagtattctacttacagcggaacaccaaaggcttaactcagcccctccttgcctgcctttgtctacaggtcccaatctcagatgaccaaaaagcatctgctccaagcagagagttggaaagttacattatcagttactttgtcaatattaaaccagatcccttggggaactggtttccaggagacacgtggttattcagagagcctgattcctcacgattagctgtaggcgtttggggacagtaggaagacaatggatcaaggcccttatgctcaattgtggactaagtaattgtgctcaaaaataatatattcagtcacaggcttttcttctgggtatttcgccagagattagacacttactgagtgtgccacatccacgtaagcatgaatcctttcaaccatcatgaggaaaatgttactcccagttttcccaggggaaactgaggtgtagaggctgaactccttcagagtctcaggaaattaatgagtcaaacctgattctaaacgcctttttgacaacttcccaatgtctctctccacgtggaccttcactgtcggcctcactttaacccgtaccagcaaaggtccaagccctgggtctggagtacgtagattaagaagccaagggatgcccttacatgactgagtctttaaatgatcttcagactggaaggtgctttcctgcatcttctaatccagtgtgcttgccacctggtgagaccttacgaggcttcctgtccccctccctcccacagcaggaagctcgtaccccactcccagcattacaggagatacattttaagattgtgagctcggtgggctatgactcgtctagtcatcctggtctctaactctgacccccaaacagcccttgacccacaccgtttgcgttcagtgaacgcgacagatttcctgccccctccgtaaccagatccccaccccaccccgcggcctccgcgttccacaatcaggacgcatttgttaaaaaatgtgccggataattaaaaaaaaaaaaaagaaagaaaaaagaaaggaaaagaaagaaacgtgccggagaggcgcggaacgggcgagggccaggaggccccagcaaagcctgcagaggtttatcccgcccgttacgaggcccaaggccatcgcccggtgaagcggggtgggccctgggcgcggccgctacgtgcagcccggccgcggcgagatggagcgtggtccctggcggccacccggcaagggccggtcgagctctcgggccccgagccattcccaggccctcgcaggccgcccatctaatcccggccacaggggacggcaccgcgccgcaggggcaaccgccctgcctcccggcagcggggcaggccaacgttacgtaagtctccagctgcccccgggccgccgcatcccgcccgccgcgcggggcacccagcccagccctccgcccgcccgccccggacacggggcctcagcaccgcccgagcctgctgggagctgggaggcggtgatggaaaaggggggtgggaccgcgctcggagaccggagcaagtgggcgggcgcgaccagagcagagagggagggagggagcggacacgccaggcgaggaaggggatgcgggggagcggacgtgaccagcaagcagggggaggggcggcgagagggaactggggcgcgggaagggcggtcgcgcatgaatggagaatggacgcgggaggggaaccagaacgcagtttcaatgagttacacagaaagcattagaatcaggggacacgcacagcttgaagaggagggggtggaaggaccagacttaaggaggaagaggggaaaacgagcacggaacaggcggcgcggagaaaggggaagcaagggtggaatcaatcacgagggaccgagagaaggcaggcgaggatggaggcgcattgaggattggggcaggaggaagaggatgggaccagaatgagggggtagggctggggcgggaaaggagccggcggacccgcctgatctggaaggaacggcgctggggacttctgaagagcaggccccaggcgtgaggagccgttctcctctctctgagctccactgcatcccagacgccctggatcctgcgccgccctgcctgcgtgcccggggccggccggcgcgccgggattccgcactagccgggcgactggcccttggtggggactgatggcgtagcctcctgcaccgctcacctccggcgctgaccgactcgggctacgctgcaaagacgaagagatccggagccacggcgcgtgcagctgctgtgcaaggagccactgcctcagcctcaaggttatcccgctgcgggccgccgcaatccctccgccgccccgccctctgcccaatcccggctccgggcgacccgggccccgccccctgcgtccccgcgggcgcagtcaccttcaggaggaagcgcggcggcggcggcggaacgcgcgggcaggttgccctttcggtgggactaaattctgcggcggaaggacacagattcagagtcacattttaagaaacctgatgaccaatggggacgcggcggggcaacggggcccgcccccggagcgactttcctcccagacccccgggcgccgggccacctgttgccgccaagttgggctgccagatggggtgtcttttcttggctctcggcccaggccaccccagctgtcccggcctacctgggcagggcccagatttatgggttccggggcagcattctcccggccccgccctgccactccccactcctccgggtgtctgctctggcgcaccctcggagactgagctgaacggaaagttggggagagctgcagacttgtgcgtggttggaggtcctggccgccttcggaggggctctggcactggagcggcagtagggagaactagggactgcgaagtgggcctggagcgggagcgcgaggccgttttcctcttaggaccattcattgtgttaggaccgcggaacaaggaaggaccggttggggccatgtgaataatttagtagggtctggaatcctgcagagcgaatgcctcagagtagaaagtaaatagacggtgttgatattagcgcagagctgggcatctggaaatatcaagtcagaacattagggccgataacctatgcaggagtcagcatttctgttttcacctttgtcgtgtttaagtcagtattgttggaacttttcttacatttttctacaagacattttctgatttcccagttgttagccagcaactaatgatgcgagcagttatcaattaaacagctgttaactcttgccttcattcacagatacaatgttgcgcattcaaaatgtgaagaccgttctcttaggttctttttttattttcctggcaaaagagaccaaatgggtgtgacctgctcaggcatacccgctgcctgcagctgaatcacaggccttcattcgcttcctgttagctcagataagctgggaggagacagtgacagcctaaaagtaaatttctgtttgaagtgagataaaaatctttcactttcttctgtaagtctttcctggtccctttagttgttgttgggaaggaaatgcttgattattaaggtggtgaaagaacatgaagttgttgagaaggaaaaaagacatgcccccctagggagggttagattcctctctatcagagaaagagggatggcataaaagtccctccctggcccctgagctgaggacaaactaagaacagtggtggacaacactgggatggcaaggatctggccgatgctggactatattgtattttaaagttctaaattgtctgggtgcagtggctcacgcctgtaatcccaacactttgggaagccgaggccggcgaatcacatgaggccaggagttgagaccatcctggccaacgtggcgaaaccccgtctttactaaaaatacaaaaactagctgggcatggtggtgcacgtctgtaatcccagctactcgggaagctgaggcagaatcgcttgaatccgagaggtggaggttgtagtgagcagagatcactccactgcactccagcctccgtgacagagccagaccttgtctcaaaaacaaacaaacgaaaaagttctaaatctagatatgttcacaagactgaaatgtacatgtagagttgatggcaaactaactcctcagttgcagattttgatctgacagttctagaaatgctgtccacgagcctctggcagagacaaatccagcgaatcgttgctcacattaggtgcatagtaggccgggtgcggtggctcaggcctgtaatcccagcacttggaggcagaggcggtaggatcacgaggtcaggagatcgagagcatcctggccaacatggtgaaaccctgtctcaactaaaaatacaaaaattagccgggcatggtggcgggcgcctgtagtcccagctactcgggaggctgaggcaagagaatcgcttgaacccaggaggcagaggttgcagtgagccgagatcgcgccactgcactccagccttggcaacagagcgagactgcgtctcaaataaataaataaataaataaataaataaataaataaataaacaaacaagtgcatagtaaaaatttgtcacactgaaggtaattttctttttgccgataagtagcacagtatagaagatcaagcttggaggcctggtgccagccattggctcacgcctgtaatcccagcactttggttggccgaggcgggcagatcacgaggtcaggagatcgaggccatcctggctaacacagcgaaccccatctctactaaaaatacaaaaaattagccgggcgtggtggcatgcacctgtagtcccagctattcgggaggctgaggcaggagaatcgcttgaacccgagacgcggaggttgcagtgagccgagattgtgccactgcactccagcctggctaacagcgagactctgtctcaaacaaacaaacaaaaaaagatcaagcttgggttccatcataccttagttccagttccctatgaccaaatattgtaatttaatgtgtagaagtccagttcctcaaaagtaaattgaggacaatttacttttatggtggagtttgatgatgtatgtgaatgattccaacactgcccaataggcatcctctttctttgggaattgactagtcctggagggctgtccttgtgacacacacacacacacacacacacacacacagaagttttcatccaaagttccttgcttataactcccacagctcttgttagtcttttgtttataatgttgggggcactttaggctcagaagcaggcctcagagaacagaattctctctctctccctctctggccttcttctgccttcctttcacctgttccttttcccccaaggcagaaatcttcccccaactttgtgtcttggagctggctataaataagttatttgtcatatcttttctgattgtaggttgcaagacccccatttcagaaggggtcctgccctgtaccttggaggaagggatgctgcacagaggccaagacaaatctcgacagtccttgctgggttccctcactcagtctagagtatcactatgagatcataccttttggtccaagcatatttctacatggttatcaatcatgcctatccaaggaagttttcataaaaggcctacgaggacatgatttggagggctttcagataggaggttcctggaggatgccactcccagggagggcatggagcttccaggccccttcccccatacctggccctgtgcatctcttcatctttattcattataatatcctttgtaataaaccagtaaatgtgtttccctgagttctgtgagcctctgtagcaaattggttgaacccaaaaaggggatcatgggaatcccaaattgaagttggtcggacagaagttctggaggcccatactaactactgatgtccaaaccaggggcattcttggggactgggacctcaacctgtgggatctgatattatctccaggtacagtgccagaattgaattggaggacacccagatgatgcccgcagcagaactgattgcctgtttggtgtgagggcaaatcccccacatatttggtcacagaagtctgtgttgattgttgtagtggtggcatgagaacagaggaaaaatacagtctgagttggcttttccacaaacaccttctgaccagagccagaatgttttcctgaatttaagcttgcccttctctggaccatcactcctttgacccagtaacaggtcgggactacaggaaactggggttgctgaaggaggacacaggcttctccccctagagccagcccttccactgtgttcctggacttgaccaggatgggatgggaaactgctaggttcactggatttgggtgtgagtaaaagtggaaattggtatgttttctgtttggattcttgaccacagaatctgcagtttaatggtttaactctctaaaatcattgggagtccttggagaaggggtggtaagtgtgtcaacaaactgtaatgaacctaatcctggagcctaaagacaagctttggccctgatgaagagggtgagattacaggctttacatcaattatgtgacatcttagcctctatctgaaatggcagtgttctctcaggacaatacaatttccagggcagcctaccacgcccggcctctatgtgaaatttaaaaattagccagggccaggcttggtggcccacgcctgtaatcccagcactttgggaggctgaagagggcggatcaactgaggtcaggagttcgagaccagcctggacaacatggcgaaaccctgtctctactagaaatagaaaaaattagccaggcgtggtggcggctgcctgtaatcccagctactcaggaggctaaggcaggagaatcacttgaacccagaaagcggaggttgcagtgagctgagattgtaccattgcactccaggcagggcgacaagagggagactccatctctaaataaatagtatgtagagatggggtctcactgttgcccagactggtctcaaactcctaggctcaagtgatctgcttgcctcagcctcccaaagtgctgggattacaggtgtgggtcactgcaccgagcccaggtgaacttttttgtttttttgagacacagtcttgctctgtcgcccaggctggagtgcaatggcgtgatctcagctcactgcaacttccgcctcccgggttcaagcgattctcttgcctcagcctcctaagtagctgggattacatgcacccgccaccatgcccagctaatttttgtattgttggtacagacggggtttcgccatgttggtcagactggtcttgaactcctgtcctcaggtgatccacctgcctcggcctcccaaagtgctgggattacaagcatgagccactgcccccagcctgaactttttttctaggtcttccttcaaactcctacaatttcttcaggcctatgagggtggcatatcagtttccccagacaaatcctggaagataaagttagactttggagttagggataaagagaacaggctgtctgtgtggaaagggcatgcttcatggaggagacattcaagctaggcatggaaaattggttagaatagagataggtatggcaaggccatggtgtggggggtggccatggggagggacagttaaacaaatactgagtgttttctgaatgcaactgtgtatctaggtttccccaggctcctgcaacctcatcagtgcttagaatggaagggagaagcttaaggagtccttggtcactctgatggaagtatagtcttagccaaggtgaccctgtcaaccaatgtgacctccagcagtctttctccagcccagaaatgctgggctcactggacaaagccccgttagagtgatctaatcctatccaccaagcaactcccttcgaggccctgtgctctttttttccctgttaagtgtagccagagctcaggtccccaaagatgcaagtggcactataaacagaccctatccccccaaagtaatctgcctggatatactttggcactttccatcccaaggagaggcagagactggagcatcctgacacatggcatatggggatgagatggggcatcaatcaagatttggaagaacaagaaggcatcagtgaagccctgatcaagtgactccctcccaaggagccctctggcttcagttccaccagtctgctttttccctgacacacttccactctccacctgtgtctgcccttgctcattggctgccagctaatctgacccacttatcccaggaaggacagctaggactgaggagactttgggtcttctcctaagcaaaataatttttaacttaaagagtggcatctctggctcactgtgagaggaggagaggtctgatgcatttgtggcaagtcctgtgctccaaaggagccagtgaatcttcaaatgagctgcagcctaccttattcccacttctcctggggtaggagggctctacaaggaattacacgatccatagagcttcctctacaccactcctgaattagtcccagaagctgtggcatccctcagacctccatctcagaatccatcctgtgagaagctggtaagaaacccagtaatgactcagcaccagactcttctcccctctccccaccagccagaatgaaaggcagaatcgagcaggctcctccccaatggatggccacatcctcaccacaaactgagtcatggtcacaccctgcctgatggaaaattaccaggaggagggaaacggaaggttaaactccaggggtttgtaatttctcaacctaaaaatcagataaatgtttgaggtgatggataccccatttaccctgatgtgattattgttcattccatgcctgtatcaaaataactcaagtaacccataaatatatatacctactatgtacccacaaaaataaaaaataaaataaaaatagccatctactctgtacccagaactaatgaagaaaatagttcttttcctgaccctagtcctaaccaagcatgtctaggtctatgaagtgagactgcttgagcccaggactacatgaaaagtaggaggccgctgtcaacctgtatgtatggtatttgtaataggcttggccctgtggaggatgccttgttgctcacacctgggtttcacaggctccagcttccccacctccagaagaaccaggcctgggcagagaaaaggggcaactttacctcaattccccctccaggctgtgggaggattcctctccagaaactcagggtcccacccaagtttccctacaatgaaggcattcttgttgtttgtggggttttaattatatttgttttacctcatatatgttaagatattatcatttgtggcttctaaacttcttagatccaaaaagtcctattgcttttctgtggcactatgaaatgatgtatttaactttattacaattttattggcataaaaagattattatacagatgattttttttttaaagtgacacccataaggctagctcagctatttgagtttttctggtaatatacaccatttgttccttctcattccatcatttgctagtactgctatattggatgtcagtgatacagagaaactataagaaatgcttacgactgagaaaaatctattaacaatctttgaaattgaacagaaatgttgttataccatttgagtagccacacaccaaagttcagttgctggaacatcagtgagaacagttggagaccatctaggataacagagtggttaaaagaactcaggttctggagttggtcagatctagttagaaacagcactggctgcgcacagtagctcatgcctgtaatcctagcactttgagaggactgcttgaggctagcgattcaagaccagtctgggcaacatagcaagatcccatttctacaaaacaattttttttaattagccaggcatggtggcacatgcctgtagtaatagctacttgggaggctgaggcaagaggatcacttatactcaggagttgaaagttacatgagctatgatcacgccactgcactccagcctgggtgacaatgagaccaagtctcaaaaaaaaccaaaaagcaaaacttaacattgccaataaccagctgtgggaccttagatacattatttaagatctctgaagaaaacctatcttccagctttgttgtcaggattaaatgaaaaaatatttgtaaagtttgaacacttttcagcatagaaccagaacagcaatctggagtcaggctgcctgtcactagctgtggaatatgttacttatgctctgtgcctctgctttctcatctacaaaataggaataatcacgcctacttcataggcttgttctgagaattacgagtaaatatatgtagagaacttataatactggctgggcgcagtggctcacacctgtaatcccactactttgggaggccaaggtgggtggctcatctgaggtcaggagttcgagacctgcctgaccaacatggtgaaaccccatctctactaaaaatacaaaaaattagctggatgtagtggtgcatgcctataatccggctactcgggaggctgaggcaggagaatcacttgaactcaggaggcagaggttgtagtgagccgagatcacaccactgcactctagcctgggcaaaaagagtgaagctccatctcaaaaaaaaaaaaaaaaaaaagaaaagaaaaaagaaaatttttaataccaagcacacagtaagtaatccaaagtgttagcaaattattaaagtgcttagcataatgtcagcaccttcttagtaaaaactaaagaaaaggtcagctatctctaatactacagagatgggcacaaagtcctctcaggaggcaggtatttcagtcagagtgggctcagtgatgaggtcatttacttggtgaagaggttatttcctagacctgaaaccagaatgggagaagagggcttaggagacttgtaaattagaatgtgttagtgttgatcaagaatgagcaaagtttaagaaacagcttctagagggatggaccttaagaatggtacttgcatgttaaagcaggtcaggaactgaaaaccagggtaagatacccaggcaagaaggtacctctaaagtacggtgaaggtgatgaaagacaacaggtagcctagagtgtgctttgtaaatcaagctataacagattaaaaaaccctatccttgaaatgccaggcttatttaatgctttttgtattctctgtgcttatattcctgtttttcttcattaatatttcataaagtatataatcccagcactttgagaggctgacacaggcagatggcttgggcccaggagttggagaccagcctgggcaacatggtaaaacgccatctctccaaaaagtatggaaattatccatgtgtggtggcacctgcctgtggtcccagctacttgggaggctgaggtgggaggatcacctgagcttgggaggtcaaggcaacagagtaagaccctgtctcaaaaaaaaatttttttttcacaaaatatttggaaatgtccaactgacacagctatgcttataactaaggatctggggcacatgaagcacagcctgaaaggccagcaaaaggctgaaatgggaatttcaacagggagaagaaaaaattcactacaacaattaggcttcctagaaagagctgccttcctttaccaccttactaaacttggtgaaattgggttgtttcattaagtgaagctgcattcccttaggatgtctttatagatttcgacttagagacaaaccccacttcctgctcccaccagttctcccctaacctcacttaccctgaagaaacaggttggaggagaaagagagtaggggtccagttcctgagatatagagcaagggagactgggcaggtttgtgcagaaagcaataggccctaaaggcagtaaatcttagctgctctggcctcaatggcccttttaaattttgactaatagtcattagtggtattctatattctcggtttgtttcatctgcataactgataagtttccctttaatccactgattaaaaagctgacacatctgtagtatactacaataaatggacacaactttgataccatgcaacataaacagtcccaatccgcaggatattccagtctccccaccccctgccccttgtgagggcttggggcaggtgctgctccaaggctagtcaaaccacagtgatcatatccagtccacagcaccttccattttattgttttatttacaaacagggtgaagtcaaagggaaagtcaggggatggagtcagtctgggccatccgaatgtggagtagttcttgggtcaagctctaccatgaaggccacctcttacatatccttttcctgccccttggtaatggccccttgattcctcagggcagcctcagctgctgtacctgaacacttttatgagggcagatggatcctggggtaacaggggtggtacgagggctggggccccctcagtttgtgtaaacctgagttccgatcacacgcatgatttccttctgtatcttggggtcctgagtattaatgttggcatcgcccacctgaccatcctcatatctgccaaagatagggcaagtgtgagcataagagggagaacaataccagaataacatcaatcagtggaactgtatttcaaggtatggccatcccatcccagaagtcaaagccctttctcactgcttcatagtggaagatattcagcttatctggtttcctctagatagatcccaaccatctatacccattcccatcctccaatggtaaagtcccagtgacagctccactcaggtagccaaggacatgtctcagataacagaaatagacttttcccagtagccacacaccatcacacccccaacctcactcctcgagtaatccccagagtccctccgacacttacacaaagaagaatcttgtgcagacatggtcggacacagggcacacccagatgttcccatgcttctggaggtccttagatgtaatcactgggagaaagagggccagaaatcatagatacaatgcttaaggcacagagtccaggcaggagaaggaagccatgccacttcaacatcactcttggccagatcatgtgccaaaattacatcagaaacaaaggttagagacccagaaaaacaggacatgggcaagctacctaccttcacaaagtgctatacagtttagattccgactctgcaggaaccgtgactgaatggatcgggtctggaagagaaggaggcaaaggagaccagagccaggtagatgggtacagctttccctagagaggctggttagctgatgattgggagtggggatcagagatatcctgggctcccagcaacacccctcgccgcccagaaaattcttctttcccataatcagtctggatagggtcacagcttccatctttacattttcatctaaactcagcctctgcttttatactcatgacttcagctacatatgactccagacgtgtgttcactttagaacatacctgactcctttaaatgatctcaaatcactccccaacccattctcaccccactgtttccctgtccagctctggagcctaaattagccccagggaaaggtcctgcctcattagaatagttccaatacctgggggatggtattcatcctgttgtatctctggaccagctcatccttggagggcatcctgtgctgtccttttcccattcctgtcacagaacaatacacccacttcatttatcaaaaatttacgaaagtgcctactatgtcccagcactgagctagatgctcatcaaaacagcagagaataaaacaaagaagattattttcccccacagaatttagtctgctggaaattacaagcaagaacaagtaattaacaacacagcatggtaaggggttgtgatgcagattatagagcatggtgtgagcctagaggagggcaactagcctagcctaagagtttaaagaagtcatgtggtgacagctagactgagaactgcaggattaggaagagttaattaaataaacagcggggaagtgtctgggaagaagtaataggatacagaaggcctgaaggaaagataaggtagtgtgtgttagttgcatagagaatagtgaattgcagaggagtggtgagaaatgatgtagaagaggcaagctaggatcagatcaagccggctttgcaggccatgttaaggcaactaaagtctatcctcagaacattagggaaccactgcagggttctaagataggggagcagcacatgaaatcagccaggaatgaggggcccaggagagtgggacatcaataccttggtgtcaagtgcctggatgagtaaaatgaatggaaaggaagcaagcagaacaagtcagatttgctctagtctcaaagttacattaaaaacctgaccagtcattcaagagaaaagcatcagcagttaagtgatgaataattttgtacaggaaatcacaatggcaactaacttgaagaatcctacttcaaacagtcttcccaggcttgagaaagaagtgcccattccttctagtttccacattatctaaatccataaactctctaccttccttacccgtttataacatttatagactcaacttggacttttcttatttagatatgaaaatgtgcttgtgtgctcccactcctcactctttttggtttgaggataggacgttaagtctctgtactcagctttatcataggcccaatcttaccacagttagggataaaaatgtctacccatgtgtggacacacgtgcctgtgtgtgtccaccagggagagagatgaagatggagatgatgctatcattataggtcataagcactctcaccactctaccctggaactttctattactattaactccactctgatcagttcttggttttctcatagccatggtgtagaaatagactgatagctgttgaactgacattcttcactgctcaggctgtcaattcatcatgcatttacactcaagtctcgtgacagatttaggtagggcctgaacaaaactcaggacaccaagagcctcaaggcttgaattgcccatttcttccttttacaggacaggtactcataacccctgttttcaccttccccattagccttaactaggttcagctctccacccaaacatcatgaccttctctcaaactgggtatgtcagtgacaaaaagtaaaattcccattcaggttatactccagaggaggcacataaaagataataaagaacaatctgatttctctggcaggtcttagagatggcccttatgatataacccaaatcttgtcccaactcaatcctgttgtacactatcctttccacactgatccaatgattgtccatttcctgagcccagaacctgagatcatggtggctagaataatccctagatgttctgtgtccagagtatgcacttatcagaagtccctaaacaagactaaacaaacagatggagtatatcacctcctttttcactgtcccctatttcaacctgaactttatagccaagtcactggaactagatatatgaacgctatttacaccaaccctcacttccagagggcactcaatgccattaggctaaagatagtgtgagaaagaaaaaacagaaaaccagagcagaatagcgtagaagaaaacatacaagacagttggtcaaatgctggagtaactacagtaagtggaacatttgcacacatttcccccaacatcccattatacatactcacatatctatagggccctcagagacccgtcattcaagcaaggcctactctgtcagtctaatatagtgtattagtccattttcacactactgataaagacatacccaagacttggtaatttatacaggaaaaagggtttaatggacttacagttccacatggctggggaggcctcacaatcatggtggaaggcaaggaggagcaagtcacatcttaaatggatggtggcagccaaagagagagcttgtgcagcaaaactcccccttatagaactatcagatctcatgagacttattcactatgacaagaacagcactggaaaaacctgcccccatgggccaggcacagtggctcacacctataatcccagcactttgggaggccaaggcaggcggatcacgaggtcaggagatcgagaccatcctggctaacatggtgaaaccccacttctactaaaaatacaaaaaaatcagctgggcgtggtggtgggcgcctgtagtcccagctactcgggaggctgaggcaggagaatggcgtgaacccgggaggtagagcttgcagtgagctgagaccgcgccactgcactccagcctgggcgatagagtgagactctgtctcaaaaaacaaaacaaaacaaaacaaaaacaaataaaaacctgcccccatgattcagttacctcccgctgggtcccttccacaacacatgggaattcaagatgagatctgggtggagacacagccaaaccgtatcatatagtgataacaacaatggcctagaaattaggagacctggattgcagccctatctctgctactcatagctgtgtgaccataagaaaatcatttaacttttctgtatatcagctttcttatctgtaaagtaataagggattaaattagatgatctctaactccaatagtaaaattcaactgcattttgtatctataatcaattaccctttgagagagggagatgaaaggtgtctatgatatctttatgtaatcggttaagtgatgaagaaagacgagaggtcaacagagatttctggcttcatctggtaactaaaggtatttaggcacttggtagtaaacaaaggccagggggagaaaagagaaagaaagggagggcatagggagaaaacagaaaagaagaatctcagtgggcaccaagaaccatgagaatctcactactcggaaagacaaaagaacttaatcagagggatgcttaggctgagacaaagataaaaagtgaagaatccagacaaatcaaaaagactattccaaccctaaccccactttggatgccaggcacacagagtaagattcactcatatattcaataaatatgtgttggtcacttgccctgtgtggattaatcataatctttgtttcataacacattattgttttgttttgtttttttgagacggagtctcactctgttgcccaggctagagtgcagtggcacgatctcagctcactgcaacctccgcctcccaggttcaagtgattcttctgcctcagcctcccgagtagctgggactacagatgtttgccaccatgtccagctaatttttctatttttagtagagacagggtttcaccatgttggtcaggctggtctcgaactcccaacctcgtgatccacctgctttggcctcccaaagtgctgggattacaggtgtgagccaccatgcccagcctcattattattttttaataagacaatgaatacccagagacccaatcaaagaactaaattctaaacctaaaacattaccagtgacttacatctaactatatgcctccctttggaggtaatcactatcctgcaatttgagttattattcttttgttttttctttttcctttagttttcacacacacacacataatacacatatatatgcctaaacaatgtttaattttgtttgcttttgaacaatataaaaaaggcatcacagtctcactctgtcttctgggacttccctcttcttattgaacatatttattattatttttttttttgagatggagtcttgctctgttacccaggctggagtgcaatggcgcagtctcacctcactgcaacctccgcctcccagattcaaacgattctcctgcctcagcctcctgagtatctaggattacaggcatgtgccaccacgcctggctaattttctttgtatttttagtagagatggggcttctccctgttggtcaggctggtctcaaactcccaacctcaggtgatctccctgccttggcctcccaaagtgctgggattacaggcgtgagccactgcgcccagccaaaaagtacacttttattactaatcttttgtggttatatgtgctgcaaatgtcttctgtcggtttgtagcctgtctcttcactttctttagggtgtcttctgaagaatataagttttaaattttttttcttttttgagacagggtctcgctctactgcccaagctggagtgcagtgacatgatcatggctcactgcagcttcaacctcctgggctcagtgatcttcctgcctcagcctcctgaccagctaggacttacaggcacgcactgccagacctggttatttttatttttttgcagagatggggtattgccatgttgcccaggctggtcttgaactcctgagctcaagcaatcatcccacgtcagcctcccagtgttgggattacaggtgtgagccactgtgcccagccagaagtttttaattttaatatagtcaaatttatcaatcttttatgatttgtaattccattttttctattctctggaagactttagataaaactaaaataatttgttccttgaaagtttaagattaatttgtaaaaccatctgggcttggtgaggtttattttgtgtgtggaaatttttacacaatttctatttcttttatagtattatgattatacaggctatttcttgtcagatttgttatctttttctagaaatttatccattttatcaaagtttttaaattattagcatagtgtaggtaactctcttattactttttattttttttttaggcagagtcttgctttgttgtctaggctggagtgcactggtttgatcttggctgactgcagcctctgcctcctgggttcaagcgattctcctgcctcagcctctcgagtaggtgcatgccaccatgcctggctaatttttctatttttagtagagacaggatttcaccatgttggccaggctggtcttgaactcctgacctcaagtgatctgcccacatcagcctcccaaagtactgggattacacgtgtgagccaccgtgccccgccttattacctttttaaattctgcttatctatagttgtactgctttttttggtcattatattatttaattgtgtcctttttctcttaatctaaccagggtttatctgttctgttagttctttgaaatcatctttggacttttttggtactatctattgtacctatttttatttcacaggtgttagttcttacctgtattatctccttttttctattttgtttggtttattctgttgttagagatgtttttaggcctctgattctggcactttcttttttctttttttttttgagacggggtctccctctgtcaaccaggctggtgtgcagtggtgcaatctcagctcactgcaacctccgcctcccgggttcaagcgattctcctgcctcagcctcctgatggcactacattttctgatctttgtaacagttacaaattactacaggatatcaagtaataatctattaagaatctagcacaatccccttcatgtagtgaacatgcaactacatggtgactataccttgtacagagactacatcaaacaagcacaaaagcagactgaaaatgaactaagacataagccaggaagactgagagaactctaaatcagatttccttttctgagcttgactcatctcctgattagaatctggacctcatctttagaataaaatgctttatcttgcattcaatgtgactaacataatagtgtaagattatagacagtttaaattttaaaagatggttgagagagagaacagtgtctctagaaatataagccaatggaaaggacgcaagccttcaggccttcagatgttttcacatgtaaacttacatgtacaagtatacacaaacacaatctataattgccaacaccaaacgtgttctacaaaaagccttgttatgtccctgttattcctccacccattcccagggccaagcccctgctatgaataaaaccatcatttttaacaataactggcctcaccttgtaaagaatctaaatttctaataagaaaatgtagagagagagagaatatgtatccatgatcggggagagagctgacacagaccaagtatccataatgagggaggaacagacagcacaaatcatgtattcacaaatggaggcaatgtaaatagagtcaaggtggccacagaatatttcttacctgagtatccaaaggaaatactggagatggggctcaggtagatgcctttgccataggctgctccatgcagcttgcagggaaacaccaggatgagtaatatgagcctgggccctcccatggctatttattaggcagcagcaaggcttatccagccctctgtccctccttctaccttctcattcaagtaaccctaagcacctattctcggaaagccaactggctgaaaagtggatgcaggttaacctgcttgcctatgaagtgctacatactgacacattcgagagtgggaaatggtagaaccactgagtcagtccctcagcattcattttcctgtctccaggccttggtacatatgcagattccaaaaaagaggaactacagaacgggtagccagaaggagggccaatacacactccctggagtctctcagggcatagaaaaagtctcccatatctactccttgaatgaatagccacataaattgaaaagctctaatagattaattcatcacagtggctacaatcagcaattccatattcctgcttacaggtacattcccattccccaaaccaccaaaaaaacgcagactgagatcaaatacacaacagccacgttctctattcatacagttctaacttcctctctagggaactccacaagacaggttaggcttgaggacactgaggcaaaaacagcttactctagagcagccttccacaaaactgagtagggaagggagcggttagaaataaaggagaaaggggcacagcctcacctgcagtttggtgtaggatgcattgaccagcccattgcgcaggatcgaatgccagttctcaatgtgggacccactgtaaggcagggtagaatacatgtctccttatgatatgaggttcccaggaacactcccaagactgccattcccacccattctcacccacacaggacatgaagatggacaggtacacctagtgatggacatgcacatggatacagtcacaggcatgcaagatgtgtgtgtgtggttaaactctacgtctctatttccagtcccatcctctcttcggtgcttcagctactcccatcctaaatcctcaactgctggttcagtatttttatttgcccattatcctgacatttcaaattcaataaattcatctgaaaatcaacaaatttatcactgaccccaaatatggcttccagttctgacttcatgttctattttaagaaaagggtactaccactccctataagttctctttaatacctctctttctctttccctcctctcaaaattaggcataaattgtggatttttccatcaaagtagctttcagatctgttctctccaatctatttcttcagccacatcttttcacatgtaaatgtcatttttcctcaactacatcataaatagtttgagaataaagaccacattatatgtacctttttgtcctctatagcacctaccacaatagcatttagtaagtatctgctgactggttgatggacacatgtaacacaaactcatatctcaagggcatccttcttgctcatccccgccccctcaccacccccactgcccagcccccagcctcctcactggaaggcaaaggtgctgccatagagcttcttggcggtccggaaccgagcctccttggcaggagggctgctcagcaggaggaactggtgtgaggtgtgcatgaacttcagctgctgcccagggtgggggtggaatcaggaaaacagagcagaaatcgagatcagggagggaagggttggggataggggaaaaaatcaggcttgcattaaccccacacaagggaaatatgctaaggcccaaagactaagttgatggacagagcaatgtaggcagatctaggaccaatatggttagctggcttccagcccctccctgcccctcaccagaaatttaaagcatttagagggagaatggtcacttaccctgctgagaggtagtttgacaatgtgtgacctgttgctagagatgatcctgggaagaaacagaaaaaaataaaaaggatagaataattatgtatttaagctatcctttctgaacaagccagtcttcctctgcctttgggagaataaacaaggattcctgggctgtccaaattgtgtgaaatgtcaaggtcactatctggatattcctgtgggtgatagtgcttatgaataaaaaggtaaaaaggaaggtagtgaccagacacaagctaattattggggagttaaacaatggatgaaaaaaaaaaaggggtgggaggagtgctgctacaagtagggagtaaaaagggtagaacaaaaggaagagcacagaggtcacctacaaaaaaagaaaagaaaaaacagcaagaggtctgaattagaatggtgacaacttatacctgggatttagactcagattcagacctgggctcagaagccatccttccttagcttaagagaaaacatgaaagctctcaggaatggggagaaacggagagaaagttactgtctaggctggaaaaagaaacagaagaaactagaatgaacttccttaggagtcaaggacagactaagctctatacaggctgaacacagaagatagaagagaacagacataaaacactgagggctcagcaagagagcactatctcccatgtggatacagtttgctgttgtctttgttttttgtgcctcatctatgtacctgtgatgccacctcagatggtctatgcctggttattcctcaggctaagagggagaaagctgttgcactgaggaagtactgaaggctgactaggaagagggaggcaaactaaaaagggaaagctatgtcaggaaaacaatagaaattgagatcaggaatggatggcagcagggacagtcaaaatcttggctaggagaagagcacagcaatagtgcctcaaggctctggacattctatatcatcaaggaggcccagagacagggcaaggggatagcaggaggagacagacgtctctggatgcaaagaaaacttagttgaaattaacagtgttaatttctacatgcaaaggacacaaaaacctattggtggtgactatagttagtaacaatgtgtaatattcttcaaaatcactgtggtagattttaagtgttctcgccacaaaaaatacatacgcgagataatgcatatgcttattagctctactgaaccattctgcaatgtacacatatttcaaaacatcatgttgtacacaatacatgtaattttttttttttgagacggagtttcgctcttgttgcccaggctggagtgtaatggagcaatctcagctcacggcaacctccgcctcccgggttcaagcgattctcctgcctcagcctcccgagtagctgggactacaggcatgggccaccatgcccagctgattttgtatttttagtagaaatggggtttctccatgttggtcaggctggtctcgaactcccaacctcaggtgatccgcccgcctcggcctcccaaagtattgggatcacaggtgtgagccactgcacccggccctgtaatttctatctgtcaatttaaaaaataaattaacaaaccaaaaaagaaaacaaacaacaaaacctattgcgaaacatggaacacctaaagagaacttgaaaaatcatgtcagctgcacatcgtggctcacagctgtaatcccagcactttgggaagccaatcaggaggatcacttgagcccaagagttcaagactggcttgggcaacatagggagactccatctctattaaaaaaaaaaaattagctgggtgtggtggcacatgcctgtggtcccagctactggggaggctgaggtggatcacttgagcactgaagggcaaggctacagtgaaccatgatcgcaccactgcactctagccggggcaacagagtgagaccctatctcaaaaaaaaaaaaaaagaaacaattaaaataagattaaaaataatttttttgaaagaaaaatcatgtcagaatttgtgggcgttttgtaggatgtgttattttcaaggcaaggtatgccaacaaactccaagaaaaagcacccattactgcctataaccttgggaaggatgttgaaaccaccactaaaagaaggtacaggttccatgtccaataactccctccctccccataacccaagaaggatgagccattctatccataccactgcaggagaggatgggccaggggatccaacttgtccatctgtttcttgatttccaaatatgagccctgtaagacaatggccataacgttatctccttggagaggtgggagcctacctgctttctgcttttcacagagtgactattagggtccagggcaaggtaggcaccaaaggccacacagaggaaaaaggagatagggttcccaccctcaaggagccctagtcaggctgggaagactcataaataaatatgaaaatgactgaagatgcttacaaaacaacatgcaggtgggtctccctcattttatgcaattcctacagccctaaaaagttgattataaatcaaaaaataaataaaatcaatgtcccaagaagattaggctaaggaatcctgtggtaaatctttaaataatgcaaagcgtcctcctgacaagtaaatcattcctcctaggtgtatcttatgtgtaaatctcaactgtgatatacaggatttgctgagaagaggcccacctgtaaatgagtacaaatgaatgtctattcatgcagagattgcagacgaggggtggggaagtctggtgagggacagccttgagtcaaaggatggtcaccgctccatgtggctgccccacccctagaaggatagaagatgtaggcccctgtgtctagttccttaccttcaagcccccctcctcctcaccctcccaaccctgggcagaggtctttccttcacttcttaactccctaagaattatggcaaaacattaaatatgaacaacttgtaaaggaattaacagcaaaggtaaagattgagacacaaagactaaagagaataaagaggagtaacagagctaacaaaacagagaacaggaattgggaaggttaaagaggaaagactaaaaaaaaaatacagtgcgtagcatctctaaatcttcatcccactcccacaaattaccaacagaataggacacttgaactgggcaggcaaaggagaggggacagagagaaggcagaatacctgggtcatctcccgaatagacatcacactatccagagctttctgaagccgctcataattcttcttctgtggagaatcaatgggaagagaagaaccaaataaagaaaagtagaggaaagtaagatgtgatgaaaaggggctagatgtaccaaaaaagtctaggccctaggaaacaatagtatgtcatggaaagagcattaatgtcagacagttctaggggcacatgctagttctcttttaccagctgggagtaacagggtaagttatttggcctcttagaacctttagcatccctttatgcaagtgaagataactcctatcacccccatagagatgttctgaggattaaatatcatatataaagaactctgtatagtaatgacagtaatagtgaggtactatgctgggtacttgtgatggttaattttgtgtgtcaacttgactgggccatgaggtacccactcatctggtcaaccattatttctgggtgtgtttgtgagggtgtttctggttgagattaacatttgaatcagcagactgagtaaagcaaattgtcctccctaatgtggaagggccttatccaatcaatcgatgacctaaatagaacaaaaaggctgactcctctgccccaccccgccatgagtttgtagagtttgtaggtattcctcctgcctgattgcttgaattggattatcagtcttttccagtctttggatttgaactaaaaaaaaaattggctcttcttggatgttaagccttcaggctttcagactagaacttacaccattggctctgattttttggttttgtttttttgaggcagagtctcgctctgtcacccagcctggagtgcagtggtgcgatcctggctcactgcaacctctgcctcctgggttcaagcgattctcatgcctcagcctcccaagtagctgagattacaggtgcccaccaacatgcctggctaattttttgtattttcagtagagacagggtttcaccatgttggccaggctggtctttaactcctcactccagtcaagtgatccacccgccttggcctcccgaagtgctaggattacaggcagaagccactgcgcccagcccactctctgatttttcaagccttgggactgggactaccactgtaccactggctctcctgggtctgcagcctgctaactgtagatattgggacttctcagcctccataatcatgtgaggcaattccttataataaacctctttctccttctctctccatatatatctcctattggctctgtttctctggaaaaccctaaaacagtactttacatatattacttctctcttttttttttttttttttttttttttttttgagacagagtctcgctctgtcaagcaggctggagtgcagtagtacaatctcggctcactgcaagctctgcctcccaagttcatgccattctcctgcctcagcctcccgagtagctgggactacaggcgcccaccaccacacctggctaattttttgtattttttagtagagacagggtttcaccatgttagccaggatggtctcgatctcctgaccttgtgatccacctgcctcagcctcccaaagtgctgggattacaggcgtgagccaccgcgcccagcctacttctcatttgtataatgatctgcaaaataaatattatccctttttacaagataaggagattgaagtttagaaacgttaagtgacttgcctaatacccttcaaatggggagtagcagaatctcaaatggaatccaggtctgtctggctccaaaagccctttttccctatcataatgtaactaatattaattcttctcccctttctgtgtcaaacttggctatttatttactgaaacagctaaatcacagagtttaagaattctgtcccttattccaagccctgtatataccagaatgtcagcccatagtctgccactatcttttatcatttctgttccttagccctgactttctcaagtaacataccttagggttaaaggccagagtcttgggatcagtggggtccaccacagagggataaggctcaaagatgatgctctttctaggggactctaaagctgccctacacatggccaccagcagatccaccaccttaggggaaaggaaaaaaaacagggcagaagctaaatgatttcccagtactgggagtcagagtacccagtatttctctctgatgttcttttaaaaagcaaatatgtttaaggctttcaaaatagaaaatacaagctcataaaaattcaagtaataccaaagtaattaaagataaaaaaccatcttcctgcccttaaactaatctcaattctcacagctaagtactagtgagtttgatgtatatccttccagataattttcctacggaaatattttcttttctttctctctcattcttttttaaagagacaggggctcactctgttacccaggctggagtgcagtggtgtgatcatggcccactgcagcctcgacctcctgagctcaagccatcctcccatctcagcctcccaaagtactgggattacaggtgtgagccactgtgctcggccctttattttcttacatggacaattttactacatatgctgttgtatttgcttttttatatgactatgttaaaattttgtctataaataatacctatatagtacatctactctaacgatatcccataatttctttaactggagcccctacagatggggttgtatccattttttattttacaaacaatactacagtggttatcttatatacaaaagcatttttggaagttaaattccaagaatgaaattgctgggttcctctgtctttcttgatcccaattccccagccacgtttccctcccccatacctctgctccagtggccacctcctctgcagctccagacatgacgcccagtgtgtagaaggagaaaacgcatagttcacgagtacagacagctggctgaaaggatatattaaacagatggtggtgggatggggtgtgcaataaggtgtaggcagagagggacagtcctaacctcagacaactctaaaacagggtaggaatttgaggccctctatatcaggagaaaactaccaataaagtcttaattaaaatgccttactgataagtttgggagttaacactgtctcccctatgaagccttccctgatcttcctatgaagtcagatgttctctcacctgatttttaacaatgctaatatctcttctataaacttaccatacattgtgatttgtctgtctcccatctggacttagagtccttgaggacagcatcatatccaatcatcttggtcaatatctgatccccatttttaaatgtcaggtggactctatcctaaataaatattctcatatcctcatctctctaaacagtactgctgagacttgttttctgagaaaaatcaacaatttctagagtatcagggtgtacagacagaattttaccttgaccacagaccaaggaagaaggaaataaaggagaggagtgaaggggacctggttaaggaagagggtcatagagtacggtcctataccttcagcatagatccattttggaagacatgctgctcatcacacaccacacagtactcattcaatgttggaatcctctgttctgcatacttcatgatctgagaaaacaacagattctaagtcttttggaagtactggcacacacagatatgggaaataatttcagcttttttttccaactaccctccatcctcccagccccgtgcctaaggtaggatatattcttaggctgtgtacttaaactgatggcctgactgcagagctaagactgtatggtatagtaaaaataagaacatgatgtttgattgagaagacctgggttaacactgtacttctaatacttaatggcatatataactttaagcaagtcagttaacctgagccttggtttctttgtttatatagcacagcattattcacctcataggggtattgcaagaaatgagatgatgtccatgaaggcattttaaaaatataaaatggatgctaatcaaactattaaaagtacttgtaattataggctgtccctctgggataggagagcattcaatcaattagatggcagaaggtcctgagaagccatttcaactacctagaacaattagccagaccactggtcaaaactacagacaattctgtgctaggaagataggaaaatccagagctaatgcagcaatatcctacagcgttttttttgttgttgttgtttgtttgtttttaatgacaccctgtcttaacatagcttttgtgcatcaatcaagttgttcccctttcacatgattttaggctggtaatgggacatgcaagagactttattcatttaatgcagatttactgaatgcccattatgtacccagctctgtgaaaggtcttcttgattatgaaataaaattaaaggttgttttctcagaagctgaacttcaataggagagatgtggcatgtttataaattaataacaattcaaggcagcccatagtatgtgacacacaggtgccatatgaaacaaaaacaaatcgtaacagttcagtgaggggagacatcacatctagttaatgcattggagtaatggcaattttatggaaaaggtgccatctgactcttgatagcaagaggaagataggaagaattacatgaacaaaggttaacagagatgcaaaagtgaaagcatgcccagggaataaagagattttaaaaagcaaatgaccagtagtagctgagcagtgaaagggggtctgtgaagaatactaaagatcatttgagcaagggctattgggaatcattaaggaaattagtgtcaatctcattctcatctcatgtcatatgagtctcgacactcatacacttaaaattggcggtgcctcattggcacttgatcataagtggtaagtattgtctttctagtaatgctgtcagtttcttgaagatgggaacaatgccttctttccttctaccattagttctggaagcaaagcaattcagaaagtatttgattgaggagctgggaggtgttaggagaccaaatgggtcagacaacagggaagggcttcggagtgacaattttgacttgattacctgaacgaggaatccatactccagagtgggaatgttcttgcagtgaccactgacctggtgagagtaaaaagacagaccccgtgaacctcctatgaagctggggcctagacagacctgactcttgcctatcacctaggactctcctaaagcagctaaaccctagctcagaatcccgaagctagaaaggagacttttagacatttttgccaaaggttctggaaaggggctcacctgtccttaaccctccttcaaagtagatggaataggttagtacagcagctacagttaactacagtcctactcacaaactaataaaatcatacatgacttctccttgagattcccatctccagactctgtgcttcatggcctatcagagaagctcgctagacaatttagacataagttttctactgttaaaaaatgttttccagctgggagtggtggctcgtgcctgtaatcccagcactttgggaggtgaaggaaggcggatcacttgagctcaggagttcaagactaccctggccaacatggcaaaagcccgtctctacaaaaatatgaaaaattagccagtcgtggcatgtgcctatagtcccagctacttgacaggctgaggtaggaggatcatgagcctgggaggcagcaactgcaatgagcagagatcgccactgccctccagcctggatgacagagtgagaccctgtctcaaaaaaaaagaagtgttccattctactcactcatggtacatacctaggtttgatttatgatgcctagacaaccatatccccaccccattttgagaaactacactcccacagttccactcccaccctcctgatagccaagtcaaaccctccccagcccatgtaccaaaggagaggtccgtgctgggggagggaggcccacgtgctgagggcacaggagacctgcctgggggctgggagggtagccaaacacttccactttggggttcttcatggtacaggagatggaacggttcatgaggcgcccaacccgaagctctggtacacctagtttgcctttcagcatggagtcctgtatgatagggaaactgggagacctgcagagagagagcaaagagaagtgataaaactggggatttcataggatccctggaggggactggagataagtgagccctaagccaaaagttctaaactaaagaaagacaaactcatatctgaggaaagttgcattgtatcttaaacactattaaaacaagtagatcacacatctgaattaaaatttttatgtcatcatctgtgggttcttcacattgggacactgagggtgggcagaggcagaggataggttattatgtttctaagccaagtatggaataatcccttggaaaggctgcctgtttttctgagagagagaaaaaaaaatagagagagagattgttaaacactgcgctaggcaagaagtagttgcatcccaaagggcgtaatattgactatctgactgtcaacaatgattcctgggaagctacaaatctgggtttgtgtctgcctttgggaatatcagaagacaccacagggggaaaatgtagacctggggtcaaagaatggagcaatatttatttccagaacctagcaaggaattactgcctgttctctgacactttcttcttaggatggggaaacggatcaggacaaaagaacagaaagatggaagattcagcatacatttctccaaatacatatcacgagctaggtattctgttttacataaaggattaggtattaaccttggataaggagtagaaaggtaaggacacatagggaacaggaccatgtgagtggtgtcagtagttaaagagacagaattcagggaagagaggggatagaaacatttatgtaatcaagaaggtgggggtgggggctatcacaaggtgtttacagatgatcagctttagggagcacttacttggggatgggtgaaaagatgctgaggccagctcggaacttcttgatggtaccacttgccttgaaccaactgtgcctcttctcctgctgggtcttcaagaaatcattgctcagatgtttccattgttgggatgtaaacatacccaggatcctgagggatcaaaaagaatgagcttaggcaagatgaggcagggtcaagaaataaggactaaagagagacaaataatctaaaattcagacccaaggactgcaaagctagttgtggtaggggaatgtgtatctgaagacccctttaaatgaccttagtaaataaaaaaatcaccatcccagagcaccccttcaccctagagggcacctagcctaatggccagaaaaattcagagatgcgttgcctttagagtgagatttcaaaggtgagccttcaaaggctgcaaactttgaaatctattgccaagaatgactatactgttgacagggaaacagaagtggtaggatggaggtgagtaccactttgttccttgtgagtcatgaagaaagggagtagggacataaggggtactgacattgttaggagaaaaattatattctcaaatttatggtttccaatttgagctgcgcccttagctagatttgtcaatcctttcacttgtccttgatcagttctctctagcattactctaaggtattgttctaaatccttattaccttctttaagttactaacttcatctacaaccaaaaacctctcttccttcttaagccatcaggtatcagttcccttaattttccaaccctactataaaatctacttacatttccaccctaccttgatccctccattctctggaggtaaggtgacccttctacctaagatcaatcctttgattgcctttttagggaccatgatgtgtcaatcattcccctttcctgtcagttcctttcccaaagtcaacaaaagatgtcaactttctgcaccttagtctagttaacctctccctgttgccttcccatccccatacaaatttctcaacccatactcattgtttctatgttgttgccaaccactcacctccaaactttctgtattctggttcctaccttcaccactataattgttctcatcctgatgctaaatccgatggaaactcccaggttcttctcttatcttctctggcatctggccctccttgcagaacctgccctcctttgtcttctgtgccaccattatcttcctattctactctgacctacctgcagtgtttcttcttcctctgcctaccctgctggtttctttgggatttcatctgagtgtttaagggtattttgtccttgatcctatcttcttttcccactatcatgccttcctttggcaatctcatattcactgactgtaacttcttcccacacacattgatgcatatcttcaaccctaacctctcctttaagtagcaaattgacatatactctggtaagtagcaaattgacatttcggataagcatctctacctgcatatctgaaagttacctttaaataacatgtcaaaaatggaactaattacctatcatcatcctacaaacctgctcccctctcatatccctatttacattggtggtatcacaatttacccagacatctaggctggaaacctaaatgtattttccactactctttggcccttatggctatattcaatatatctaaatcagtcttcaagtcttattgattttatatctcacaaatctttctaatctgtctctcatctccattctcacctataatcacactttagctctggcctttagcatctcttgtcttgacttttacaaaagcaccctactacactagttctggtctcttgtctcatcccctcctacccattttgtataatgctaccagaatggtttttaaaaataaatctgaccacgtcatttctttccctaaacccttcaatgttcacactgcctaaaggataaaagtccaagatcctctctaacttgaacccttccctattctctggctttggctcctacacccccagcttgtattttaccagcaatatttaactacctgaagctccctacacatatactgctttatgtgactaagcccctgcaaatgttattcaccctcagaatctgtctacatggacaactcttatccatccttgaaaattactaatcattggctgggtgcggtggctcacacctgtaatctcagcactttgggaggctgaggcaggtggatcacttgaggccaggagtttgggaccaacctggccaacatggagaaacccccatctctactaaaaatacaaaaattagccgggcatggtggtgggtgactgtaatcccagctacttaggaggctgaggcacaggaatcacttgaactcaggaggcagaagttgcagtgagccaagatcatgccactgcactccagcctgggtgagagcaagactctgtctccaaaaaaaaaaaaaaaaggaaattattaatcatcaccctttcaacagactgagtcactcttcagtgtcctttctaaaccttacatattcacctgtattagaatatgtatccagtggactctatttgaaacttcactgagagtggaaaatatgcttcatttctttgcataccaaatacctagcttaatgctcaacacattcaataaactagagttcctagagacttactctgaagaaaccactagagaaatatgaatagcatgactctgatttcagggtagtaaaaatgctaagtagtgatgagcctcttttatctctagaaagtctcagcttctgacacccaagaaccacatactctctctccacaagcttaaatctggctccctaaatttattttagcttttcctgggcatatttcagaaagacatttttggaagggggcattccatccaaggctctgcctgtccatccatatatttccacctctctctccttccttcacatgtccatgaccagaaaagaccaaagttcttactttttcaactgaagacccagcccaaatccttccttatttgatggctggaaaacctcaatggatggttctgcaaagagaagagaaggctactagtaagtacatatctcttgtcttcctggagtccaaagctcagtggaatagcttccatacattctaaagatcatagctgctgggtactctaaacagtaacggtggaagaaaaaaaacatctgagggagagggcagattctcgaagctgtcatatgaatctgaaatatcctcaggaggatgttgagaaaaggaggagaaagaaattttatcttggaaccagagaaaacaatgtcattaggcaagaaggcctttagggaatggttattaggtgacaggggatgaagataccaattacaggggactaaaaagcccctaccaatagcctgcagattgagcccaaggaccttgttcctaatttttttctacctcagttaacttagggctttggattagaccacactcagaccacccacttgcccaaagtcactgcctttacctggtccatctaggtactgggagagagaaaatcgcagcctcaacacaataggttctgtccggaggaccttccaggctgtagagacttcctcctaaaagaagaagggaaatagtttccagtttagcaacatagacgaatggacctgaaatttcccctatatgacacacacatgcacatgacagtacacaccactgtctgctgatggtctaggaaagacagagatgaagaatatgtgctccaaatacagcactcgggaacaagactcctggcctacatgacaaattccacaagtccagctagacatgttgttggcaggtactagccccacttacatcgaggaagctgatgttgatgtggaggtcaatgtccacgtcatcgatagttccatattctctatagagatacaggtgacaacaggtgagactcattaagggagaaagaagggaatagaaactgagttggaaagagaactgagcctggggacaggggaaagggaagagtggatgacagttttgtacctagggtcttagctatagccttacaccacttacctgatcaggatctacttccaggccaaaagcatttcttacctgaaaggtgaaactactggcccagaggggtctaggataagagggaattcctaagaaaagtggccttactctctactctcagccaagctcatttattctgagcattttctatcattaagttcataatttatcccactatcataccataaaaagaaaaacctctagccttttaacaactcagaaagaagtgacttgctcccctgccacccctgaagtagagtcccacctgatggatacagagttctcactgtagatctccttcacggcttcaatgtctgcatcaagctgtgggtgtcgatacaggtcagctgcacagctcccctgagatagcagcaaaaatggtggtggagagaggtggaaaaagacgagggaaagagagagataataaaaagaatatgaaaagacaccaggaacaggagaaatcagacagcagtataggggaagtaaaagccacttatgtgaaggggttctcagtggtgaccctagcaagggatttcattaacagaggtctccatctcatcatgactttaaaaaggttcagcagaccaaatgtaggcttttgcttggagttcacttccttaaatctccagcttttctctcagaccttgaccaggataccttctatgacaactcagaacaggctgaagagttacaggtttcctaagattggttctaagtgaagagcattctgagagtctgggtacttctgctcaggactgtgccctgggtagtgatggcattaagcaaacgctggcagagtaatcttttaagatgtgaccctaatgaatgaaactacccccactggctagtgttataaaagtcagaaaataattatgtctaattaagatatgggtagtctccacatacagaggatgtagtttactctggaacaggtatgactccaaagaaagagcaagggcacgggatcagctctgacaagaccatgctcagaccacatcaacattataacctcatctcatctgtgctccagaacctctttcactcctgatgtatccaaaaagcagcacatatctagaccatccaacacgggggtcttgggagatgtaacctcacctgaacgccatagagaaattcctctgattcattatctccctccgagtcgtcatcattccagaactggcctttgatgtcctagtggtgagaaataaggatatcatgctttgttaggtccctattatcccatggaaaggcgtgggatgatatggtgaggaacagattcccacaaagattgggaaatatagaataactgaagccctgatccctttacacctttcatgtcaccctttgtgagagtctcagtctcttcctgatatgatcatatccataaactagctcttagtgggacagaggaaaacatctagggaattttggccttctgaagtctcagtatgatgactgagaggctctggtagccagtaggaaagaaatgcaaatgacttcaatgtcaaggttgactcctaagcatatctgggttccagtacaagctggcctcttccaggatcattacctaagacagttcccaagcacacctaaactctcttgtctcattattttctttctatcctttaaagtacttaactctcctctccctccccaagaaaacccactacacaaacacaccaagtaatactgtttctgtgccccttccctttcctttaacttcaaatagccactctatcttccaaaagggtagaagggaaaataccaagaaagggtgagatctgcactttgtctcctctaccctttgaacaatcagttggagaggtgggcagtcagttctcaccattgggtcagtgggtcacacacactctcaggtcagtgctaggcagcacccctccataccactagccgaaccaaggccaacgagatgggcatttaggagaccacaaagggagacaaggtagggcacgatgtcagggacaactggtgatctgttggggatggcaggctctgctgttgcggtggtaacaagtcactgtcctgtggaaagtagataataatgggtttcatcaccacttaatagctgggtggtgtatatatacaggcacacgtatttatcaatacactttttttttttgagacagagtttcgctcttgtcgcccaggctggagtgcaatggcgcgatcttggctcactgcaacctccgcctcctgggttcaagtaattctcatgcctcagcctcccaagtagctggaattacaggtgcctgctgccacgcccagctaattttaatattttcagtagagatggggtttcaccacattggccaggctggtctcgaactcccgacttcaggtgacctaccggcctcggcctcccaaattgctgggaatacaggcgtgagccattgcacctggctattaatacacttttattatacatacagatacttgcatataaaaagacatgcttgcgtgcatatacatgcacacttgcacatgcagttctttatagataatgaaacacaaaagcactatatgcaagatactgctgttctacttaaactggagagctgggattagagcaagatcctgctctagctcataatgttacaactcctaaagccaaaagtgatggtggcaggacaagatgcttatgtttactctgtcagttaattcttcagagtaccaactcacaccagagttaagattcagaatcggattatttctggactctttattcttagttatttctccatattagccagtatctctctttaaacatcagtattactagctattatacggcaacaatagctaacttaaaaagtcctcaacggccagatcacctgaggtcaggagttcaagaccagcctgaccaatggggtgaaaccccgtctctaccaaaaatacaaacttagctgggtgtggtggcgtgcgcttacgatcccagctactcaggaggctgaggcaggagaatcgcttgaatccgggaggcggagattgcagtgagcctagatcacgccactgcactccagcctggacagtaagagcaaaaactccatctcaaaataaaaagtcctcaacaacactgaacatcttttggcagttatggtctcagttgtcattgccaaaataatgccctaaagtcatcttggaacctgcttcccaaagaaaaatgcaataattatcccaaaaattgcttagaaaaacttttacttaacccagagccctttcatacacaattccctgctcgcttctaatcccacagactcctaatcctataccagcaacttttagctccattaaaacctccacatatagcagaaaaacaaaacaaaacaaaaaactcatctgtgaaattatgaaggctttaatggctgaagatggcaaatctaccctaaaagcaggctaaaaaagctttctgttgctctctagaccagcaagtcactggctttgcacacatcgcagctgaagctactccaacctcaaacagaggtgttcttggtctctaacacagttcttcttcttcttctttttttgttttctgacagagtttcgctgtgtcgcccaggctggagtgcaatggtgcgatctcggctcactgcaacctctgcctcccgggttcaagcaattctcctgtctcagcctcccacgtagctgggattataggcgcccgccaccatgcccagctaatttttgtatttttagtagagacggggtttcaccaggttggccaggctggtctcgaactcctgacctcaggtgatccacccgcctcggcctcccaaagtgttgggattacagatgtgagccactgtgcctggcaggtctctaatacagttctactgaatgtcaggtttccagattagtgattctctgactggggttggtggacctacagcatcagtatcatctaggaacttgttagaaatgcaaattctcagactcctcctaagacctactgaattagaaactccagaaatggccaggcactgaggctcatgcctgtaatcctagcactttgtgaggcccaggtgggcaggacacctgaggtcaggagttcgagaccagcatggccaacatggtgaaactccttctccactaaaataaaaacattagcaaggcatggtggtgcacgcctgtaatcccagctactcaggaggctgaggcaggagaatcacttgacctacggaggcagaggttgcagtgagccaagactgcgccattgcactccagcctggggggcaacagcaaaactctgtctcaaaaaaaaaaaaaaaaaaagaaaaagaaaaaaagaaattccagaaattggacccagtaatctgtgttttaacacacgctccaagttgttctgatgcataaaatttgagaaccactgttctagttctagatccttgtgtgttctaaggacctgtggttcattccttagataccaacttaagtctggtaactaagccaggatggggacaaaagacaccatgccagagcagagccagcataggagtcttccagctcatagtgttgcctgatccttcagaaacaacatgcaaacggaaagtataactaaagttcttagagatggaatgacccgattactgagatttgtttaaaatactaccctggcacacacataaaaaaaggagggaggataacagatgaaataaatacagcaaatagcaaaatgttgattactggtgaagctatgtgacgtacatgatggttttctggtaatccctacctccctacttttgtgtaaagttgaaaagtttcaaaataaaaagtttaaaaaaaaaatcagaagctactctaatgggctgtcctcaaagtcaagtctaaatgttaacaggaagattaaccaacactccacaattgcctcattactgttcttcaaactcatcaagcatattcccactatagggccttcatcttcccaccatattcccaagcatattcccgccatagagcctttgtccctgctgttcccctttcttggaatgctttccacccagatatccacatggcttgttccttcactcttccagatctctgctcaaaggccaccttgaccatcctatttattaaaacagaaacaactcaacacccacacactagcactctctatctcccttcccagctttatttttttccacttaccatgttctaacatataaaatgtttatcagaatgtaacctctggtggcagaggctttgactgctttcagtctacattcttagtcccttaacacatttcttgaatgagagaataaatgaatgaaccctctgctggatacttaagtcaaatgggagatatatacaataacctgcatgtttctacacatagacaaaaatcacacaaaaaaatgattttaaaaagcaaaacttcaccttcaagagcagctgagatccagaatgtgaagatcttggggtgaggttcgtgagatttgaaaataaacagtcaagtgctgatctggatgatcacagaggaataaagagggaggcactaaatgtccagcctgggttgccctggggtgaggggtaggatgacggcagcgttaggccagaagtgccaacttttcacggtctttgttgctgcagaagtcaagaaaaatttagcctctttccaagggctgttgctgcttggtttctgttgctatcacaaggagaaaaaggtatttcagagggagtttttcttgttcaagcaagagacagttcagagattaccggctttttcaaaccaggctgctttagtgaaagggacttgcttcctctactctcaatgccctttcctctggagagatggaaagtggatttaaaaggtgaagagttggaaaaggaaggtggtgggttatggaattcacaggatcacaaacactttttaaaaaattagccggaaacgtggcctaattcaaagctttcatgttacacacagaatacttagacctacagaggtcgaccaatttgcttaaggttaggagtacagaaggactgggatgtaaagacattggacaggtcctaattacatctaatcttcatgtgatgtggttataattaattgagttgttaatgaagtaagcaagaaagacctatctgatttatctaaatgaggtaaagaatgggccctttcaaaagaagttgggccaaaaatagactatatgatgagtgtccagagaaggtgttaaaactcagcggctaatatagaacgctttatgagtttccacgagaataagtcaaatgtaaatgagcctcaagtctggatcacaaaggtctttccctaggtccatgggcgcttctctaggtgtgacaacttcacgtctagtcaaagcagcttcagagctcaatgtttaaattgtgggttgggctcccggctttgtggtcctggaggaggttactccactccatcccgtgtgctcccttctcaggagtaggccactaaacaaagactactaggaagaatcactgaggggcgactcccgcaggttagcgctatctcgggcaccccgcagggagagaggacacggctgccccgcgaaaacactctctggcacccgtgcttccaggacaggccctgaggcctctcccggggaagcagttacacctgttctccggggctcccctgaagaccccaaaaacacccaacacctgcctccccaggaaagacgctctgggcccgatctatgccgcccggccgccgggcctgagtgaagcctgtccagcctaggaggggccctcagaacctcccggtccaagcctctcacttcgtccacccctgcggagacggggcgagccccgcacccttcccgtggcccggccgcaccgccctgtgcccgtggtggcggccacacaggccagcctggcgagtactcacggcgaccccgggccgcgcgcggccgcagccgacgggacgagcggcccgggacgccccgcgggggcggagcggcaggccaaggggcgggggccgggcctggcgggcgaggtcgcgcaccccacgcctcgtcgttccgtcacgggcgcgctcagccactctgcgcacgctcgcgcggtgacacgatggcacgtggcccgctcctgaccaacagcctgacggcctgctcctgggcgcgcctcagcagccgacgccagccttgagacgcctgcgcggcggtcgctagtcgggaaagggtgcggagtggggggtggcgcctgcgccgtgggtaggggaggcagtggagaaggaagagggactctgggggagtgcggggagccttccaaaggagaatacttgcatttagcgccccgagtggttgggaggaacaagcaggaagggcaacccaggttgcctgtaggccgggagggagtcccctcgccggaggttggggccggcaggtagagactgagggaagtcctgaggccttgctgactgcaggattctctggttcgacaatggaagtcgaacacctcgggcttttaaaaattctggcatttaactcatttgttccccggtagctgcagcgtgatggagagcaccctggccttctagtcaatctgggtctgaagcttgggttcggcacttattgatggtgcagccttaagcgatgactttcactttgtgaatctgatttctcctctttgaggtggagacagtaatatgtgtttcacggagccgttgtggtgaggatgaactgagatagtgttaggttgaaccgtaggaaattgctatttttgcagtttataaacagtcagataccttcaatttcatacgattccaactaatccatgtaaagtaaccagcagagtacttgggactaggaagtagttcatacatggaagctgtaattgtggttattgtggttattaaccctagacatggccagatctccttcatccttattagtcttggggcttccacgtgaccctcttttccatcaacactaatgggaaaaggcttatcttagacctactctgtttcctcactccctctttgtagctggacacagtacacacaaagaaggctttggccctgaatgatataaacacgtcatgtctatccctcctaagctggcctcagaagtttcccagttaactttttgttgttggttgatttacatttgcacattctcagcctctcctttctaactccttccccttttgatgtccccctctgctcaccttgccactcagcctgggccacaacaccgtctcggtgtgagtttgttacatctactgcttatagtaactgaaaaaagtgagggatcaatataacctcggtttcagagtgcggaagttcagagtggtaggggaaggagtcaggcctgctctctaaaacaactcaccatcaagggccccgtaatagcttttgagaaccaagtatgtatgggagtgtttgaacataagcactgtgcccatgagtgacaagtccaactccagtattcaataacctttaggattccccctttccagcataccaccactagctcttctattcatcatgaatctcagccacctcatagtttaccagtatcttccaggcttcacctcttttcctacccagtccacatccttggtcagtcattttaatcacatctttgttaatatgcttgcacttactctgtaaaaatcacactcctgggtcatgccagctatctaccttctctactctcccatcctaaaccaggataaaggaagtcatccaatcctgcacacttaagcttgtgagtggacaccatttaggttagtctagcccatgaaccctattctgtgggaattatcgtttccacacccacactatggatccacaggccccagggccatgttcgtcttgtgtgacctctagcactttagctgcagtttattgaactgtgagtggattcctggtctaagctgtgttaaacagatgttctcctgaaaatctgggattagagctgacagattatgattctaactggactggtttcttaagcaaaagagacatagacttaggagctatggtacatctacctcccacctactatgatgaatgagaaaaggaaaaagaccatctggggacacagaatgaagcatggagaggcagagaccagaaatggtgagactactctctgctttctggcagcttcccaggcacccctcccttccttccttcttttttttttttttttttttttgagacagggtctcactgtgttactcaggctggagtacagtggtgtgatcatagcttactgcagcctccaaggcttaagcatgcactaacatatctggctaattaatttttttttgcagagatggggtctccctatgttgcccaggctgatcttgaactcctgggcccaagcagtcctccatcttgtcctcccaaagtactgggattacaggtgtgagccactataccctgcccaaggcactttctgaggccctctgatcttgagggactaggagtcagtttttatctaaaataaatggcttaagctaacttaatgtgcactcagtacagagctcctacaaattcattgtctcctcagcagagtcctcagtgtacccagcaacccttcccatgtcagcctctcccaccatcccccattctgcttcacagaaaaaataaaggctctgggtgccaggtacttgggtggctgaggcaggaggatctctggagcccaggagttcaaggctacagtgaactgtggttatgccactgcactccagcctcagcaatggagcgagactccccatctctttaaaaataaataaataaataaaaggccacgggggaactgcctcaattttctgtcccctccaaacatttgaatctctcccatcctttctgtttcagaagtggagagggctctcttcaaatacaaagttagtcctttcactgtgatctgtatttcattcctttttgcctccttgggaaatttgctccttacctctctctttcatttatattcaactttttcctctcccctactcgttgatctcagtatataagcttgatcaactagcccaaccgtaaaaagaaaatccaatttgaatcctatatgccatgctactgatttttcttgcctttaaccaaacttctaggagtagcctatactccccctctccactttcttgtcttcagttgttccttaaatctggtgtcatctgacctctccccaaaatttctactgaaaatactttcaccaaagtgacacatgacttacaaatggacaaatccattgggaattttcaggcttcatttatatgaccacacagtgtcatttggcattgtcaatcatcttgcccctgcagttgactgcatggtgtcatttggcattgtcaatcatcttgcccctgcagttgactgcatggtgtcatttggcattgtcaatcatcttgcccctgcagttgactgcatggtgtcatttggcattgtcaatcatcttgcccctgcagttgactgcatggtgtcatttggcattgtcaatcatcttgcccctgcagttgactgcatggtgtcatttggcattgttgatcatcctgcccctgcaaccctttcctctgttggctcttatgggctacactcttccagtttcttgctacacctcatatgactccttcacagtatccttattatactccctttccttcattccctacttaagtagaaaagcagttcagcccacatccatttctcctattactcttccctgtggcctccatggccacttgaaggagatcttgataatttggggttgcccagaaacagaatctccttcttatgttacaagttttagaagtaagcagagcctatctttcatgacagacactaaaaaggttgaatctttgctttcccagctctctagctaagacagaggcatgtgaccttggcctggccaagcatcttccagaaatgtagtttctggagtgactcagagaaatagaatcatagagaattcatgccagtggcaatggtgacaggagagcagggtcagctttaccccatgcccagggactttcatggtgtgggtactggtagtggtgacatcccatgtccaataatgatgacagcagcagtggtcttgtggagctggttctggcatctgaatttggcctgtgctgtggtggactggcctctcattgttcctgcctattttccaagcttgggtcttttgcctggcaatcccgtgacccacctagtgccctttcaacaaaagtctcatttaaatccacctgagtgacacacagttatagactggaactcccaaatctatatttccatcctgtacttcttcttcttttttttttttttttgacggagtctcgctctgttgccaggctggagtgtggtggcgtgatcttggctcactgcaacctctgcctcccaggttcaagcgattctcctgcctcagcctcctgagtagctgagactacagatgcacgccaccacgcctggctaatttttgtatttttagtagagacggggtttcaccacattggccaggatggtctcaatctcttgaccttgtgatccacccacctcggcctcccaaagtgctgggattacaggcgtgagccaccgcgcctggcttccatcctgtacttcttgagtttcaagttaactttggtcaagttgtcttttggacagctccacttggatgtcacataggcaaacatcttctcactgtatttctttcatgttcctaacttagtaaatctcacctatgacttattcagactgaaccctgagaagaaagcatcttagacttctcccatccttatttaaatggaaccaattttacctcataaactctaaattttacatcttaatacatcttcttcttctttttctttctttccaaactctggcctcctgccctctagctgcctaaaagcacagagactcagaaggcagaacaggccacacgcctgggtctggcttttcccaagggatatcttaggtgctgagcagaaaatgcaagaaactaaaaagcctgtggaatgagcctcagcctcctggggagtagtagacagggtctcaatatgtggcccaggctggtctcaaactcctggcctaaagttatcctcccacctcgacctcccaaagtgctaggattacaagtgcgagcaaattaatacatcttaaatcaatccctcctttatattcctattcctccctaccagaactatcgcattcgcctcctaatagactccttatccagtatctactcctgcaatctattctccacttagctgcttaggggatctttctaaaactcaaatctgatcatgtcactcctctattaaaacccttcaataggctgggcccagtggctcatgcttgtaatcctaacactttgggaggccaaggcgggtggatcacttgaggttaggcttcgagaccagcctggccaacatggtgaaaccccgtctctactaaaaatacaaaaattagccgggcatggtggcagacacctgtaatcccagctactcaggaggctaaggcaggagaaccacttgaacctgggaggtggaggttgcagtgagctgagatcgcaccattgcactccagcctgggtgaaagagcaagactccatctcaaaaaataaaataagataaaaataaaacccttgaatgtctctctactactctcaggataaatacaccctttctatagatataaccctatttgactctcaccagcccctcacatgcatcctacactccagcctggccagattatacattcttataggccatgcaggacatactttgtttttgtttgagatggagtttcgctcttgctgcccaggctggagtgcaatggctcgatctcggctcactgcaccctccgcctcctgggttcaggtgattctcctgcctcagcctcccaagtagctgggcattacaggcatgtgacaccatgcccagctaactttgtatttttattagagacagagtttctccatgttggtcaggctggtctcgaactcccaacctcaggtgatccacctgcctcaacctcccaaagtgctgggattacaggcatgagccaccgagcccggctgcatacttttatactttgtaagtattagtacttagtggagctgacaatcacaatgctacctcctgcccccttctaccccacacaaatggatgcatgacccatcaggccaggcaaaggactccatcatcctgaccaaagtgattagttcaggtgtgggtttgtgacctaagcaaagccaatcataatcttctgctcaaagctctcttgcttttgaggttaatgtgctaagaggatatgagattgaagctgctggcacccagctctccctgccacagggcagagaatggggccaaggcataaagagaagcagagctctgagaaatggaatgagagagacctgatgacattgtttgagcccctgagatgagccttgcctgaggtcagtaataccaccgcatttctcagttctcatcttgcttaagctggtttgtcttggttcctataacttgctactaaatcagacctaatacagaaatggaatgaggtatggaattgatggcactgaagtgaagttgaggcagtggagatccccacttggctggggaactggaaacccctgctatttggtatcaaaccagctggttaaatgatcatctattttatcttgagattcaagtcatgtatccatcaaagtggagatttctgggatgcactggaaaaaaaaaagtttggatgttggagtatgttgacctcttcttgagattttcaataaggtcctccagtttgactttcctccatgctggcagaatcagaacagtatacagctttgtttagagttgacttttctgcttttttttttttttttttttttttgagacagagtctccctctgtcacccaggctggaggctggagtgcaatggcgcaatcttggctcactgcaacctccgcctcccgggttcaagcgattctcctgcctcagcctcctgagtagctgggattacaggcacacaccaccacgcctggctaatttttgtatttttactagagacgggttttcactatgttggtcaggctggtctggaactcctgacctcaggtgatctgcccgccttggcctcccaaactgatgggattacaggcatgagccacctcgcccggccgccttttctgcttttgaccagcaatccagggtgctaaaggtcagataatcatgcatcttgtcgactataaaggccaaatcctttcccccaaactaaagtgaataagaacaaaggcctagaggtagaaaatccagtaggagatattggagtgagtttagggtctgggaagttccagagaaaaaagggagaatcctgatccttcaagctatacctgaatgcttcccttttcacccctccaaattaagtaagatgtatttggcttggaattcagacagtgttgggggttctggtgcctggggactttggctgtgaatcctgtgggagagaattggatgtcttgggcacgaacttcatgcactttcttggattccctagccacctccttctttctgtctcttggttggcaccctgcctgtgctaagtagcccttctacttccatgtctatagtagaaatgccatacagcagaccatgggagctgacttcccaacagccatccagggagcaaatgatgcaactgagaagtgcaggggagttagctccttgtggggtggaatcttggccaacagaaaacaggagaagagagtggaacagaagcattaattccctctcatatctccccttggtgaactgctccaaggtgccatttctcctttcaaacaccatgtgcttggcaaacaagcctgacaagggacgtgctctctcctaatagctcatatgaagtggcggccggcacagtactgcgtcatcttgcattgccttcgtctcttctccctttcaccatcctggacttccacctccctgcaaaatgtcagcacttgcctcagggtctgctttctagagacttgggttaagatatggagataaaatcaaagcccccatctctacattaagtccccatataacataaaggtcctgaggacacagctgagttttcccactcaaatgcagggaatccagcccagactgctggcttcctctcgggaatccagtgtcaggtcactgggtcaggccatctcgggactactccccaggaggctgaggctcattccacaggctttctctttactctcttgcattttttgctggtcacctaagatatcccttgggaaaagccagacccaggcttgtggcctgttctgccttctgagtttctgtgcttttaggtaactagagggcaggaggccagagtctggaagttcaaagtcccctctacagatggccagctaaaggctttggtcagcccaggcttctagagggcagaggttgccataatagctgtgtctggagttggggctagggagacaaagagtggccctctgccccttcttagtttgtacttggcacagacttggccacctctttgcagatcccagctggctcgggctgcaggctagaagggcagctgaatggcccacattgcctcttagctccctgaactcatgcagtttcttccaaataatacagggctgtgtaacataattgtgcaaatatactggccatgaatgaggctcagaggccagaaacagcctgtgagtccctgctgggtttggctatgtcatgatggaggcaagtgcaatcaggacagtggctgctcaaagattacagcccaagctggaaaggatcaagtgagattctgtgatctccacatcatagcaccctcttttggaaggtattacatgcatgttctgctccactgaggccagggtgagcccccaggtctggtcagaggacatagcagaaccagagctgcttcaaggtcagaggtcaccagtcctatctcagaccagaggacttttctccctacatccaagacacccagattgcatccagcgagagaaattcattctaggggatctgctggaggctgaagactctgcccagagcccctaagttctagaggttgtaagagggcccccaaaattcagtgtcaactgagagactcccctgaggagtctttcgattgtgtggcctcaatgtaataatgggccatggccagagttggaggagtagagcaagctgcaggttgctggtccaagagtgcttgactggttgcttccatcctgtcctatgcatctccttggggcttgaggcctaggagccagtactgctcaggtattttgaatatctggtcaagaccaaggtcactggagcgtgagtcagccaagtgttgaatgagtaatctctctttgggggtagtgagcagattaaggttgacttaccactatagacagaccattatggaagccacaaagctgagaggtaggggaatggctaaagtgtgacctcttgctaagacgaagaaatcacatgagctaggattgaaactcatggagcaggacattatcaaggattcctcatgatggttaccagctcaaagaaagcccacgaatcagagaatcctcacaactgacaaacaaagatctgggaatgcttaatctctacgtcaatctttaaatccaaaactggctgggcacggtggctcacacctgtaatcccagcactttgggaggtcaagggagatgtaccacttgaggccaggagttcaagaccagcccgaccaacatggcgaaaccctgtctctactaaaaatataaaaattagccaggtgtggtggtgggcatttgtaatcccagctactcaggaggctgaggcatgagaatcacttgaacccaggaggcagaggttgtagtgagctgagatcacgccactgcactccagcctgggcaacagaggaagactgtctcaataaataactcaaaaccatgtcaaaagggaagtgggatgcttcagttccaaaggtccatcctctcagggatgtccataaacaacaatggacaaaggagatatgtcccagtggaaaggaccaaaaacaataggttttgttggccaagaaattcactccactgtccagaaggatgtgttatatgctgtagattagtgaccattgtattctcttctccctattccaaatggaaggtttttaaataactgttatagcgaggtgcagtgacatgcacctgtagtcccagctagtcaggaggctgaggtgagaggatcagttgagcctaggagttcaaatctagcctgggcaacatagcaagaccccatcttaatttaaaaaaaaagaattaaaaattattcagtggtgtgtatttgtattcccagcttctcaggaggctgaggcaggagaattgcttgagcccagcagttcaggtccagcctggacagcattagcaaggccccatctctttaaaacaaattgtgatcttctttttctccttatttcacattggttatagggcaagtatggggtagctaagtttatcttttacctatagatggcaaaatcttaagaagtcatatccagacctgagcaagaattgcccatcaccaagggaccctggactgaggactcaataaagcaactggatgtaattctgttttatctccccttgggaaataggtgaatgtggtttttgttgggtctatgattattgcattgtcaggcaggcacatttttgaaattgtatgtttgtcaagaaaagtataggtggatgcaataaagggtgggatatagtgggtgcatttcatttatctgcccatcatctcttccttagggacccatttctccccttccacacagtcctgatgaagttgtcaattatggtggcctactcttctatcctagtggtgggcatgtgtccaaagctggccaaagtcctccctgggattttagaactagaactaatgaggccaacatatggaaggaagcagagccaagagatggagacatcatcctttgaacccctagatccagccatgcttcaaggcagatacatgctttgatttatcagttatgtaaatcaattaatttccaattggcctaaacatgtttgagttgggtttttgacacttgcaactgaaaaggtccagactaatacatgcacacagagagacacaaacaccatattgttcaagctcatcagacattatataagtcttccatgatcttaccaggggtcagcaaactttttgtctaaaggacaagatagatagatattttaggctgtgtgggccatatgtggtctccgtttcactttcttgttttgttttgacgacccttcaaaaatgtaaaaaaaattattagtttggtagttcatacaaaaataggccacaggccagatttggcccacaagccatagtttgccaacccctgatctagaccatgtcaaaccctgaagctttggaatcacacagtctgccagtccttagcccatactctaaagtatgaagccagatattttaaatgtcattttggttcaagtgtcttgacatgacttggtaatggtaaggttcagggtagagttaggaacgggaaaagggtcttatcttgtgcccattatctgccatataacaggtactgaataaatggtaattattattatttcttggtaataaagataatttttcaaaatgatgcagctgtctaaatggctttgtccaaatgtcccagttcatccttgaagacttttccccttcttaatctccttcagaaagtatttcacagacctcccccaccaataaagtctgaactaggtactctcattcttgctagcacagaccttctatggccctccattgtaactggattatttgtctctctttccccttaactctgagtactttgaacatacctgagccccgacacgtagcacagtgcttagcacctagcctgaggggactctctgcttccatgtgaatattagtttgagggtgcgggtactgtgtgtctctatttgtgtctagggtggtcactctaggtgtcagcattgtgctggtgcacatacaccctctggttcttccctcggttggaaaatatttgtggatgtccatcacaccttacctggtaatattactgccagatctatgtttcattcccattccctccaaaaatgagtcgaagacagaagaacaggtgggaacaagttttcttagaaactgttatgaaggaggagccctccacccccacccccacatcttttactatctgacatgttatcagatcagaggccttcagcctcagcaacatctggggattagagggaccccacacagctggggcctcagaccaagctgatccatgcctgtggggtggaggggaaatcctcctgggaaaaatatgtgcaaggccctacaggcccaggaaaggctgaccaaggcaaggtgagtcatggtgttctaagctgaatcttttgcccatctcacagaagcaggcaggaagcaccaccattgatcagctttatatggcacccactgtatacaacagacagacaaagacagacagacagagcacacaccacttctaagctcaacactgctcaccaactagaagcacctcggttaagcacatgtgagacactcttgcataggaaagatgtagtttttaaaggaatgaagaagtattttggcaaaacatctacttccctcccaggtctggggtaaagagggacctctaattctgaagcttctacatattgaaaaatttccccttctcaatggcagtatatacagtagcaaaccttccaagtctgttgtcacagccctctacagatatcctgaatctactttacaggtgggcaaacttagactaagagacagaaggtagcctggagcaaggggacactgggactggttcaaggggaagggaaacaggaggtgtctcagctcagccaaaggcagggcctctgtctacctggattggcaagggaaaggctcaggtggccagaactccctctttcttcccgcctggggaagcagtggttccacaggaaaggcaatcccactcttgctggctagggggcctcccgggatggcaaaggccagggccaacctgagctctgcctggggcctcttctgggatgcactctgagtttggggattgtggattgtgggttcactgcttccataacgttctcattacctgcatgtgagcctagacctcaaatccttaattatttttaaaagggcagggtgggggagtggcttaagagggaatgagacacagaacaatctttccacagcccccatctgcctaggctggggctgtcaagggtctccttcaccctgtctcctagggatatttaaaggcagcttttatgagactctatactgtctttttttgtagttgtttgtcttgttttttgtttgtttgtttctttgttttaatttatatagatatatatattcttaaaaaagcaatagtcctttggtccctaaactctaaggaatgatatgattttgaaagaagtaaatctgggcttcccttgcggagaagcccttggcacccccaacgccctctgctggttcccctggacagtcactcctcaccagccctatttgctctgccagcctgcgctctatgctgcaggcacagaacaacccacttgataaaaacaatccttagagtggccttagccccaggcaccagccttgggtccgatccacctccgtccgcagctgctccttcgggaagggctgctcaagcgtttctgtgcttttcctctcctttcttctcactcttctgtttctgttgttgtgtattaattgataaggagagataggggggaaaaggcaagaatcaccttggagggcaagaccagaagagcagcttgcccccatgagtgacgtctcaggtgagtggctggacctctcttcctgaggagtagggctgcagcaggacccaggcagcagccccgtccactgaagccagacttgagtcctgagcaaaagaccccaaccccacatcccctctagaaggttcctggggtagctcaaagtgaggcagggccatgtgggccttctgagacagaaaatctctaaaagttgcaggcagcatcctatggacccatgaccttgccaaaaatgtagaagaacttggcccatctttctccccatcacccaccaggccctgcagattctacctctgaagcatgtttgcttctcttcctccatctccatgttcactgccactatctcagcccttacttctagtcctttctctgcttaagctcctcaacagttcattctcatcttcaggataaagtccaaactcatggcctgaagacccttgaaaactggcccaaagctacttttctagtctcattttccagtctcctggaccctccccgcatacaggttctctactctcattggctgtctctggagtagaactgcttctccaggcagaaagactctgattgtctctcctagactgcggggcaggaatgttgtccaattgatctccttggattgaaggaaaagcaaagtctccatctgaggtttcctcctagctcctggctcttctctctatcccagactttctcagaggtgggtgcctccaaggtcccaaaaggaggaccatcaaagctgggagggcctcatcactcaggcctcatctacctggggtccatcagggactcacctttctgtggctggtcagtgaaagcaggtcagtaaggccggttggcatccttgggccgctttagctggaccttgagcctcttcatgccaatttgaaagccattcatcgcctgaatagcagtctgggcactagttggattgtcaaaactaacaaaccctggagggtgtgggcaaagagattagctggggactctgcctagcagggcctcctttctctctgaccagccccctcctcttccagccccgtcaggccagttccatcaaacacatacccctccactgtttgtgtggatacagagtcataggcagatggcctgagattcctaaaggtgtgattcttggaaggataggaagcaactctgagtgtgtgtgcagggtcagtgtgttgatttggatgtttccgtgtttttcctggcatgggttggctttctccctccacagctcccattctggtcctcagaaccatagttggagttggaggggatctttggtctcagaaccagactcctcctgccctggccagactccaaagctctgacctagctggccacattcctggtggacacatgatcatcccaggtaaacctgaaataaagctcgttctttttttttttttttgagatggagtcttgctctggggcccaggctggagtgtgcagtggtgccatcacaattcactgcaaactttccctctcggattcaagaaattctcctgcctcagcctcctgagtagctgggattacaggcacccatcaccacgcccagctaatttttgtatttttagtggagacgggatttcgccatgttggccaggctagtcccaaactcctgacctcaagtgattcacctgccctggcctcccaaagtgctaggattacaggcgtgagccaccatgcccggccaaggcttgttgttggcctaaacttaggcccatcactggtttgtgaccctgttttgtgccatacattcaatctcaggaaatcactgcattatggaagggcaatcgtagggtctgtaggaaatcctttatagtcagaggtgggagaggcctaggggtaggttctcagctcaccaaaacacttgctctggttggtggctcgatccacaaagactttagcagagacaacggctccaaagggcaggaatgtctgtatgagttccgcatcaccaaactcctgaggcaggtgatagatgaagaggttacagccttcggggcctggaggaacagtagcaagctggttcaggggaaggaccctgagtccagccccaccaggttctgctgtccagcccccagtccctcaccttctctctgctgctggggcagggctgaaggctgctggggaaaagctgtgctcactggggcataggccgacggataggctgctggagacagaggtgggagtggacagtgatccccaggagcccttccccaagcagggccccaactgcctggccgcttttgaccaattcagcccagtccaccataaccctcaccccaagagaggtcgttctgggggtaggaggggatgggaggatcaactccttggaacagagcctaaatcccccacaactctccctatttctttctagggcccttcaacctcccccaggccgcgtagcgccaagtgaaacctgcgtagtggtgcatcccagcgtaggcctgctgcagggggtcagccacgccggggctctgggctggggagagaggggcgcgaggcccacagtgaaggcaagcgggcgagcagagtgggtgagaagctcagggagtgtgggaggtggacggcggctgtgagagacagcagggaaggagggggatctcttcccagggaagccaggccctaaccccccaccccccgctccccactccatttcggggggatttgggcggagcggggggcccacctggataaggggagagcccgttattgtagagcgtgtcggagcccggctggccattggtctggggggtcagagggccgaatccattgaccccgatgggcgccggaagacctgggagggtgccagggccgctgccaggcggggagttggctgctgatggcggaaaaggtctgagagtcaggccgccaccccgccccgcccggcccctcccaggcgcgccccagtccctgggggccgtacctgccgcgggcaacagaggcgcagctaccaggctaaaggccgccacgtgttgcatctgggccgccactgccgccaccgggcctaggcctgggccctgtgccgccgccagcagggccgcctggtgctgcaggatctttgagaggaaagatgggcgagagtggagggccaaggggcaggcagctgcccgtgctctcagccccaggcctggcccacccacctgcgcgccctcgcacgcaggtgcccggtacctaccgccgtggtgtaggcgccgcaggcccctagcggcagtggcgcggggtggaaggcgcccaggtggccggccatctgctgcatccgccgcagcgcgcgctcccggtcggtgtccgccagcttgaccacgaggctggacgaggcgccctgggcagggcaggggaggccgtggtgaccggtcctgaccctggccccggcccggggccgagcgcctttcccatcaggtcctttcgcggggcaccgagcacactcggggaggagaagcccgtccccaccccactggcctcaccctcagcccagggaacccgccctcaccgccatggtccggctgccgtgcagaccccggatggccgcctgagcttccccttgactcccgaacttcacaaaggcacagcctggggcaggacagagggagcgggtggctcaggccacaggggccaaagagttatgtggcccagagtgaggaagggtcaccaggaaatcccggggtcagctcaggtcacctttactggtgccgtcaggactccgcaggaccgtgcactcctcgatgtggccaaagggctggaacaggcgtctgacgtcctcctcaccctgctgcttgcccagcatccccacaaacagctttcggtcctctggggacaaagccaggaatgacctggggaccccaagtcttcctagacccccgagagtagcctgaggaacttaggaaggcagctcaccagtctcactctgggaagcagagggagtgagaaggccctgggcttccagggttggttttcattgaggggcaggatctggggaagggatctggagaagggagctcagctcagctttccatcaggaaaacctgggtcctggggaaacccagagaggctcagggctgctcttgtggggagtaatgcagtcttgatatctctggctgggtagagccctatatgcattgttttacatgtttgacctttctgttcttagaggttgggaaacgctgttttggaccatttctgtactattaaggaagcgggtgctcagagaaagcctttctattcagactgggtccagagaagagaagtacatccttgctggtcagcctgatagtgctggctagaatcaatgccccttcctgctaatatcaaggagggttctggatttagaaacagcacagaaaacagtcctgtcatcctactgcctcatctttaggcactgagcactggcatgatgaatccttaccctctgcaccacatccaacctggatgcccctcccaaaggcctacagagagcaggaccttggtttcctgagcctccaacattagcatttttcctactacagttgctgaacccctgacccctttccttaactcccacctccaccaccctgtcccttcagcaagcttctagtgccctgtctgtatccttccctctgattcccctgtcctcttgccctgatgcctcccaaaatgttcatgctatgagagaacaagttctgcctatagacctggattgccaccagagaaccagtctgattcctccctgtgtccaccctttctatgggagtggcagaaatgcaggaaaggggctgcaagctgggcctgtgtccctcgaagaaagctggagagctggggctggaaactagggttttgccgcacatccagcaagttaggcctcaggaacactctgggagcgtggggtagaggggtccagcctgctgttaaagtctggggctcttctctgcaccaaggtaaatctctgaatttgggatggggcttgaccatgtaggggacaatacaagttgggagagaaggagtgggtaggaaactggtttcaggcttcatcttcaagaccttggagtgcaggaaaacccatcctaaatggttctactccttgaccagcttggctaggcagatgggggtccttggattctgagtgcagggaaaacaaggctagtggggggtcatagactgaagcctgggtgacagcgaaggaagaacagactgttcaaaactgaacgaagttagcaggggagaaatctccaacaagactatgtgtgtgtccatatgtcacccgggtggtgtggggtttggcctaggctgccttggggatcctgaagtgtctgtctgtctgacgatgctatgtctgtgtggagggcaggggctgcagttcataaggggcaggcaaaatgtgttttagcaaaattctgccgtctgtccagagaggtaccatccgatgatccttggagaggggatggataatggacttgtggctggaattctgatggaggaaagaaggtctcaccagtgaccttctgtggtgagagtacaacctggtgggtgtactttgcttctgggggtgtcagccacagaatagtgcccttggaacagatcactggtttcccaaccttttgaaaaatcagtggaatacattgttctaacataaatattaggatgaagctcaaaatgtaagagaaaaatagaactgctgtgactgaagccagaaaaggaggggtggagttcatcttgcttgatcctcccctaatactccctagaggggctccaaggaaagccctttgaaattactgacctagaagatagagaacagagttccagctgttgtttgaggggggatctgagatcatcctgttcaggagcctgagaagacaggaaaggtctttcatgagtctctcaaccaatctgatggctttgccttgacattggagaatgggctcatttggccagagaatcaaaccccgaaagaccatgccattgttctaagttattctgggctgcagaaggcctgggagaggctggagaagagtctagggcctccatagtcccaaggggggcttcacaatgccctaatttgtagtggagctgtgtcattgggcagggtctgaaaaatggtgatggcaccccaataagatatcataccacatggaccagaatccaggtagccttgtgtaggaagagagacatcacaggctgagatagagcccataagacagaaaagaggtttgtactgacagtggtgatctgatccttcatctgctctgcctcttgttgctttttctgctgatggtgaaattttccgatcctcttttccagtgagaatctcacaagttaagaattttcagcagggcgcagtggctcacgcctataatcccagtgctttgggaggccaaggtgggctgatcacttgaggtcgggggtttgagaccagcctggccaacatggtaaaaccccatctctactaaaaatataaaaatagccaggcgtggtggcacatgcctataatcccagctattcaggagactgaggtgggaaaatggcttggacctaggaggcggaggttacagtgagccgagattgtaccactgcactccagcctgggcgacagagtgagactccaactaaaaaaatttttttttccatttccctgtcagggcactgaccctatggatctggactactgggatgtacagagtttggaatggaaatgagtatctaccatggggtgggctctaggctcctgtttcccaggtatcaccttaaatcctggtatcctctttgccactttacagggaccttgattgtgtttgacaggaggataagctggatcacagtggtcatgagcctcaggtgacccagaaatggtgggataagtttcttaagagacccggccaaagagaagtacatgctggacccctaacagtagccccgcaaacccacagatctgaacattctgatggctgatcattgattgcctccaaagagagatgatgatgggatgtagcccagataattcagtttcctctagatcaaattctatcatttggataaaaagcggacgctacaagaggcaagtcagaaatgtctgaataaaagtatcccatgagtggtgggtagtatcctagaaagatgggaatatcaaacatggacgctcaaccttcctggagtggaaagtattagaaggcagcatcagcgcagagttgagacatagttggaatgccatatggttgaatggtataactgcattttcctgttggcaaccgatgtatacttcttaatcttctatcaaatgcttttttttttttttttgacactgagtcttgctctgtcacccaagctggagagcaatggcacgatctcggctcactgcaatctcctcctcccaggttcaagtgattctcctgcctcagcctcctgagtagctggattataggtgcacgccaccatgcccagctaatttttgtattttttagtagagacagggtttcaccgtgttggccatgctggtctcaaactcctgacctcaggtgatccgcccgcccaggcctcccacagtgcttgggatttcatgtgtgagccaccacacccagtctcaaatgctttttgagtccaaaacaagtggcttaggctcccagaggcccatctccatgaagctgccttgtgcagctggtcatataggtcagggattcgaatgcagcaaatgatggggttgacatcccagtaatcatagcagaatcaatccagactacttcttcagaaagggcaccaggatgctgttcaaggaaggagcgtctgcctcatgttgctccaaagaaattcctaagttgttcaagtttcttgttttctaggccactcacaccaaatcacctccatgttggtgaaatgtaatgattgtagggacagtgtaaggaaaggtccagccttcgggtaccaactaccagacacatcctaaaaatactggtccatttttcaatgtaaatgccaacccagaaagtcttgctggtggcagtaattgtattacagcaaagcaactctctcctgatactcttagtgacgactgcagcataagaagccacggggaaagtgacagaaggaagtagccaggacgagaagagtctcctggccagatgtgacaggcatcaggagggacttaaattccacacacaaaaaaactgttagaacaaataacccaattcagcaaagttgcaagaaataaaattgacacacaaaaaatcagttgtgtttctacacactagcaatgaacaatctgaaaatgaaatgaagtgaaagcaaaagccagcacggtggctcacgcctataatcccagcactttgggaggccaacgtgggtggatcacatgaggtcaggagttcaagaccaggctggccaacatagtgaaaccctgtctctactaaaaatgcaaaaattagccaggcatggtggcatgtgtctgtagtcccagctactcgcaaggctgaggcaggagaatctcttgaacctgggaggtggaggttgcagtgagctgagattgtgccgctgcactcctgcctgggagacagagtgagactgtgtctcaaaaaaaaaaaaaaaaagagatgaaagcaaacaattctatttgcaatagcatcgaaaagaataaaacacttggaggccgggcatggtggctcacgcctgtaaacccagcactttgggaggccgaggtgggtggatcacctgaggtcaggagtttgagaccagcttggccaacagggcaaaatcctgtctccactaaaaatacaaaaattagccgtgtgtaggtggcaagcacctgtaatcccagctacttggggggctgaggcaggagaatcgcttgaacctgggaggtggaggtttgcagtgagccgagattgagccactgcactccagcctgggtgacagagtaagactgtttcaaaatacataaataaataataagataaaataaaatacttgggaataaacttaacccaggaggtgaaagactcatacactgaaaactacaaaatgttgctaaaagaaattaagaggccaggcgtggtggctcacgcttgtaatcccagcactttgggaggccgaggcgggcagatcatgaggtcaggagtttgagaccagcctggccaacatagtgaaaccccatctctactaaaaatacaaagaaattagctgggcgtggtggtgggtgcctgtaatcccagctactcaggaggctgaggcagaattgcttgaacccaggatgcagaggttgcagtgagccgagatcacgccactgcactccagcctgggtgatagtgcaagactctgtctcaaaaaaaaaaaaaaaaaaattaagaagacacaaataaatgaaaagacaatctgtgttcatggattcgaagacttaatattgctaagatgtcaatactactccaagtgatctacagatttaatgtaatctctataaactcccaatggcattttttgcagaaatagaaaaatccatcctaaaattcatatggaatctcaagggactccaaatacccagcaatcttgaagaagaagaagaactccctgttttcaaaacatattacacagctatagtaatcggcactatggtactggcataaagataaatatatagaccaatggaatagaacagaaatcccagaaataaactctcttacatatggtcaaatgattttcaacaagggaggcaaggtcattcaataaggaaaggacagtcttttcaacaaatggggttgggaaaaatggatatctacaaaagaatgaagttagactcttacctttcaccatatacacaagattaactgaaaatggatgagtcctaaatgtaagagctaaaacaatagatgtcttagaaaactgaggggaaaaagatttcctgacaggatttggcaatgatttcttggatatgacaccaaaagcacaggcaacaaaagtaaaaataaataaattggactgactacatcaaaattaaaaactttaacaaggatctattggagggcaaaaataaaaaactagaaaacttctgtccatcaaaagacacaactcacagaatgaaaaagcaacctctggaatgggagaacacatttgcaaacaatatatcaagataagaggttaacatccagaatatataaagaactcgtacaactaaatggtaacaacaacaataccaacaacagaaaacaccaaaccttctatttaataatgggcaaaggatttgtatagatgtttctgcaaagaagaaatacaaatgggcaacaagcataagaaaagatgctcaaaatgactaattgttaaggaaatgcaaatcaaaactacaatgagatatcacccacctcacaccgattaggatgactgctatcaaagaaacagaaaatcacagcgttggcgaggatgtggagaaattggaactcttgcacactgttgataggaatgtaaaatagtgtcgctgctacagaaagcagtatggcagttcttcaaaaaattaaaaatagaattaccatatgatctagcaataccttttctgggaatatatccaaaaacattgaaagcagggtcttttcaaaaattaatctataattttatttcaattgaccaataataattttatatatttatggggtacaatgtgatgctttgatatatgtagacattgtgaaatgattaaatggagctaattaacatattcttcaccttgcctacttatcacttttttatggtgaagatgattgaactctattagcaattttgaagtgcatattgcattattattaactacagtctccatgctatgcaatagatcactaaaacttcatccttctgtttaactacaactttgtatcctttgactaacatctcccctttctccatactgtaacccccctgccgcccctaacttctgccaaccaccatcctactctctgcttctatgagctccacttttttaggttccacacgtaagtgagataatgcaatgtttgtctttctgtgcctgggaaaacaagatcttgaagaaatcttttgtacacccatattcataacaacattagttacaatagccaaaaggttgaaggtacccaaatatccaacagatgaacggataaacaaaatgtggtatatacaaacaaagaactattattctgtcttaaaaaggaaggaaattctgacacatcctacaacgtgaatgaaacttgaagataggctaagtgaaataagccagtcacaaaaggacaaatactgtatgattccacttacataaggtatctagagtagtcaaactcacagaaataaatagaatgatggttgccatgctgacggaaattgggaaatggagaatcatttaatggatacagagttactgtttctgcaagaagaaaaagttctgaggattggttatacaatgtgaatgtacttagctctagtaactgtacccctaaaagtgttatgacaatcagctttgggtgatctgctctgagccaagcctaaggaaagcacctctcattacctttgtgggtagaatgcatttcaggaagtgaagagttaatgtgaggaaagggtcaagtagtacaggtgaaatctatccaatcttagttggaaaatactttttagaattaaattcatctaaggaccaataacaggtatgactgtcaactgactgtgacagaacagttgttgctaaggtctatttctgatttaggccacggaatatgtcccagtactatgaaattctgaaaattctacctcaaaattcaattttaactcaaagattagttgttaaacactgaataaagtggaatcctagaaagaacttggaaaagatggctctgctagtgagatagtcatatatgcattatgtttatactcaaaatccaggctgacatctaatcaaacccttgcaaattcaggcagaaattacttacgcaattataggatagtgataggagggttaattggataacagataattggcttttgagttgaaccaaattgcaagactgaaaaacgagatgcctcaaaatatattttaaaatcctcagagaatgttttaagtttgaacgttaaaagaaaataactgaagtggaaagagtgcatggattgattacctaacctatttctgtaccttaggcatcttggatacatgaatatttgctgagtaaaggacacagccaagttgagaagtggaacaagcagagcaatcaccattgtgatttatgtattgattctatgctatgaaatttgaaagaggaaagaatatacaattcaataatttttaatattttgctttaggactaaaaactacttttcctataagatcggtacttatagtttaacttattggtgtttccaaagtagagaaaatataagtgaggaaaaatcaactacagtccctatgccgaacagcaaataaaacagacttatttagttaccattgtctgagggatttggggatccttatttctgacctcatataatttgtggttaacattttaaaaatacgtgaacctaggccaggcacagtggatcatgcctgtaatcccagtactttgggaggctgaggccggtaaatcacttgaggtcaggagttcaagaccagcctgggcaacatggtgaaaccccatttctactaaaaatgcaaaaattggcagggtgcggtagcaggcgcctctagttccagctactcgggagggtgaggcaggagaatctcttgaacccaggaagtggagttgtaccttgcagtgagccgagttgtaccttgcagtgagccgagatcatgccaccgcactccagcctgggcaacagagcgagactccatttcaaaaacaaaacaaaacaacacaacaacaacaaaaatacatgaaccttgaatttttacccatacaaacattttaatgttcatgttcaaatgcacacaaatgctgagggaaaaggttttttgttttttctttttttttttttttgaaatggaatctcgctctgttgttcaggctggagtgcagtggcatgatctcggctcactgcaacctccgcctcctgggttcaagtgattctcctgccttagcctcccaagtagctgggattacaggcacacaccaccaagcccggctaatttttttgtattttagtagagacagggtttcactgtgttgcccaggctggtcttgaactcctgagctcagccaatccacccgcctcggcctcccaaaatgctaggattacaggcgtgagccaccacgcccagtcctgaggaaaaggtttttgacactatgtgtatttaatgtatgttaggagatagtttcattttagaaagttagatgcattttcctttaatagtgtactgctcaatgtgtagctgccacaggatgtaaaatataggcctggagtgtggagtataggaacagcgtggaacttagctacagaatttatgcaaactcactggaatacattaaaaggctgctataatatatccacaaagacccagatgcacctctggtactctgagaaaagtgttgccaaggctgcgggagatggccatgacagaaaaggaccttgacatcttccatcaggcagatcctggtgtattgctaatattaattgtattgcaggcatcgaattaacaagtgttaccaataactattaaaagtaatacaacaggggccgggcacggtggttcttgcctgtaatcccaacgttttgggaaggcaacgtgggaggatcatttgaagccaagagtttgagaccagccagggcaacaaagtgagactctgtccctacaaaaaataaaaatacaaaaattagctgggcatagtggcatgcacctgtagtcctagctactcagggggctgaggcagggggatcacttgagcccaggagttcaaggctgcagtgagctatgatggtgccactgcattctagcctgggcaacagagtgaaacactgtctctaaaaaaaaaaaaaaaagtaaataaacagacaaatcagtaaataaataaaaatcataaaatatacaatatgtatgttggttatttcaaccacaaacctcatgtttattgattaaaagtaagactactagtacactgttacatcaaaagtcaagtgacagaagacaaagtagctatttttgtaaaaaagctaggttgggcgtggtggctcacacctgtaatcccagcactttgggaggccgaggcagacagatcatttgtggtcagcagttcaagaccagcctggccaacatggcgaaacctcgtctctactaaaaatacaaaaattagctgggcgtgctagtgggcacctgttatcacagctactcaggaggctgaggcaggagaattgcttgaacccaggaggcagaggttgcgttgagtggagatggcgccactgtactccagcctgggcgacagagtgaaactccatctcaaaaagaaaaaaaaaaaaactcatgtgtgcacaatgtaatcctgctttatggcagatggaaaaagaagcaattatgataggtttggtaggctctcacagtgctggtctatttttaaaaattgaattagttgccaacatttaatacagctaaaatgattttttttttttaagacagggtctcattcattcacctaggctggagtgcagtagcgccatcttagctcactgcagcctcgaactcctgggctcaagtgatcctcctgcctcagcctcccgagtagctgggtagctgggactaaagatgtatgccaccacacccagctaatttttgcatattttttgcagagacagggcttcaccatgttgcccaggctggtctcaaacttgtgagctcaagtcatcctcccgccttggcctcctaaagtgctgggattacaggcaccagcccacatgcccagctgtaaattattttattaaaacatgggagtctcatccatttaaggttacctacctgggctcctgtagtatttgagctgatgatccctacttgatgggaagaaaaatcatgcataatcccttccagaagaaactggaaggttttggaagaatatgttggccttgatatcccttagattgttttcattgacatcagtactcttatcggataaagaaaccattattaaccaatggtaaactaagggatttaatttcaggaataattttagaagacacaggcttactggcgtaaatatatctggtcaggtgtgtgtgaccattgactctgacagtttatagaatgtttgaggtcacagatataagacttaaatgggacacgctgttccacgttgttgccaaatgttacattttaaaagcaaaatccaataccattttaaaaagttgattttttttttttttttttttgagacagagtctcactctgtcacccaggctggagtgcagtggtgcgatcttggctcactgcaagctccgcctgctgggttcacgccgttctcccgtctcagcctcctgagtagatgggactacatgcgcccgccaccacacctggctaattattgtatttttagtagagatggggtttcaccgtgttaaccaagatggtcttgatctcctgacctcgtgatccgcccgcctcggcctcccaaagtgctgggattacaggcgtgagccactgctcccagccaaaaagttgactttctaaagcattaggttgtgttaaaattcagcagagggttgaactcactttagaagagatatatgatagcactgaagaaaatacattttgattagtaatgattatctaacacagatctgttagtattaaaatacttataaattgtaaaggcccaactgttctgcaagactggatacataggccttttctctcctgaatatatagtagggagcagggaggaattgagagatctggtcatccaaacctgcaagaaggattattcatggatgcatttggagtgtatgcttcttgagagccaccacttgtccagaaatatctgtgtaacacaactgctaaattatgagttctgctgccaggcaatactctttttcagctagatttgcttttcctgctcttttaaacaggtgtataggtggaaatgccatatgtacagaattttttaatgatgtgacacctgcaaagtttatacaaaaatgtggaaagaaaattctacaactcaagctgatgtcattgcttagagcccagaccaccagaacacatcaaccaggccaagcaaaagcactatcagcatggaggccccctttgtgcggctgcccaaacactgacaagatgtagtggactccatacagcaggagtgccctagcattgtggacttagttcctgagcaagactccaaattgcaccacgttcttctgagctctggggcctgcggacatgctcttcctctgcccaacatgcttgctccctctctcctcttttctctgactacttcctattcatccttgaggtctcagcttaaatattactcctctgggaacccactttgatcttccagactgggttaggtgccccttgtttgtgtccccacaattcccctggacttccccttgaaagcagtgatcacactgaattgtgttcccttgtttacttgtccatatcctctcatagcatccgtgcttcatgaggccaggtaccaggtctgctttgctcacatctgtattcctgctgtggagtaagttgctcagaagatgttggttgtgtggttgaacctgtctgcttcacagctcactcacatactcttagttggcttctcagctgtgggactggctcatggttgtgggcagggcttagtagttggccaacaatggccttgatgcataaaagagtttcccaagaggcagaaattcttgggttacatgaacatgaagttttgcatgcagcctggaacatctcaaaaacctgactggaaagaataaaaagggaaaggagaatgtgtgtgtggatggaggaggaaacttggaaatatctctccaagacaaggtgaaggtgataacattttgaccagaaatcaagaatcagagaccagaggtcagagaatctaaaaggataatggaagtatttcttggaggaacgaacttcacagtggaaccacaaagtcaccagaactctgtgtgtgggttctcagactgagcatgaagtctgagaggggtacagaattagtaggactcaatacatgtttatatcaattgggttccattctgttcctgaactcgggcagcttctttcagctagcaaagccatggctgatcttgggttagacaggaagagagtcttacccaagataaagagtcagcagacatcagggagggctataggctgatacactggaaggatctaagatgcaagggtgagaaaaacaccaagaactgacaccagaatccagccttgcctttacagcttggaagctggccagaacccagctggttagaagaaagcacaggctctctaaccgtcctatgtggttttgtttttgtttttgtttttgttttgatacagagtcatgctctgttgcccaggctggagtgcaatggcgtgatctcggctcactacaacctccgcctcccaggtttaagcgattctcctgcctcagcctccctgcctcagcctccgagtagctgggattacaggcatccactaccacacccggctaatttatctatttgtagtagagacgaggtttcaccatgttgcccaggctggtctcgaactcttggcctcaaatgatccacccacctcagcctcccaaagtgctgggattataggtatgagccaccgtgctcagcccacctcctgttcttaaggagctctgttttttctctaccaggaaacagtgtagctatcagagctttccatggtcctcagcatagaggacttactatggcccataaagtctgtcgtaccagccttatcttttaccatgagcagctaggcaattacaatgaaggaatggcctcaatccgaaacggactgtgttttctgatatcagaaggatatggagaaggagaataacccccacctgattcttaaaaacaacaacaacaacgaaaccctgaaagttccatgtggcaaaacaggaatgatctctctccaagggtaagtggcaagaaccccctttctctatcactggcatctgtttaggcccttcttgcctcttctgggcctgggctccccagaaccccagccctgctcagtctgagcagggaaggctgagctatttctggggctcagcaactctgagccccacctgtccccttgacccagggaggctctcatactaaatgggtaggacagactccaggtgtgggcccaccctcccttacacgggttgcagcctgaggttggtcagacagggaagttacctcctcggccctcactggcagctggcttcacttggatcggacgattcatctgaaagacatcggaccaacacacccattcagcgtgactgcctggtcctggagcccccagcttctcgaaccctggactcctcaggatctgagccctagcccctttgaactctgcactctaccacttccaaactgggattacagattttctccaagattccttccttaaacccaggaatttagaaggtgctgaaactggcagggatgggtgacaggaacttagtggcaagcacaaggtggaatgaagcggctaaagagacttttctgcctggggctctgggcaggggctatgtgaggcctgtccctttggcttctggacttacttaaaggctttgcatgagaggattgggaaggagggtagaattgatactgcagatttgtgttttatgtctaaaatggagaatatcacgctatgtgtcatttagatgagagtctgggaatcagactcagtgctatctgccctcaactctagtcatttaatggttgtatgactttaagtaagccaccttttctcagattcaatttttctttttctcctgtgtagctgaaattacaggcacgtgccaccaggcccggctgatttttgtatttttagtagagacagggtttctccatgttggctaagttattcttgaactcctgacctcaaatgattcacccgcctcagcctcccaaagtgctgggattacaggcgtgagccactgcgcccggccagattcaatttttcaaatgaggaaaacatttcccaagctgctgtatcactagagtctccacgctcacctgctccatcccctccctagggtccccttccctgaggatgctggagttttccaaggtgccgttctcagccctttttgtctggctcttcctacttttcttggatagtctcatccacactcagcctcagctcctctccacacagggatgacttagagctctgtgtctccagcctgcattctcctctgagcttcagagccatgttaccagctgcctgctggacatccccactagaaagtcccacgggcgccttcactcaacacacccaaacgagagctcatttgtttttttttttttttgccccaacctgatcctcccagtcacccaagctataagcctggaaagcagcttgacttctccttccatcccttccccgctcccaccaacttcatcttttaattcaggggttcctgaggaagtgtagataaaaatcacccaggaaccagatgaggctcttaagttggggtattgcataatttgaaaacgctcctaggtgatttcaatatatcgcccccacatccccatcccccaaccaccctgagtgaattcatgattgaatccccatctcaccttcctctcatgggtgttgtggggatcacatgaggtaatggggacgcaaaaggtctttgtaaactgccaagagctgggtgcgtgggaggtgaggaattattgttggggggcaggcagctgagtgccaggagggaaaaacagcggccttcccgttcatggaggaaggggtactgatgcccatctggcctgagaaggtgatgatctgaccccctcccctcaagaaatgctctgcttctgcaccaatcaggggccactccatcccttaccaatttgctcgttgccgagacaacaggcagcttcctgttaccatagccacaagtgctacccagtaaccatggtaacgccctggcagtcacagttgagcaatttcctttggatcaaatttgggggtgggaggggcagggagggcttactaaaaaaaaaaaaaaaaaaggaaaagagaacaggccaagtctgaaccagcgcaactcccctcccacccagggctctgacacacccacccgctggtggtggagcacctgcagtgtaccaggctgtgggtgggggcggagacaccaacaggactcaggttgcagtctagaggggatgacagatcaatccaagcagatcagggcgagcttgacaggtctggactggcctggaccagggaccaggaggacaggacccgtccctgggcatggccacctgtgattgtggaggaaagaccaagagacagagccatggagagcagagacacagggagagatgaagaaacactggcagacagaaatgatgtgagagaaagacagttctagaaaggggcaaggaaagagagttactggtggagaggggaaggaaatgaggagaggaagggtaaggaagcgggtgcaggagaggcagggaggagcctggtagggaagaaggccaaaagagtagaagcctggggtggggggcagtgagggtgagcaagaccatcattattttattagttcttaaatagatcctgagaatttctctctggagcctagagtgacgagcacacgtgacagcagcagtttccatggcagctgcctccctggctgggtttcctgggagatggtgctctgggggacgccaccttctctcctcccacccacttccccacccttcaacagagagtgggcatcgggtggtacatacatgttcccccctggacctgacctaggcctcccaccacccaggcatgctgccagcatttcctgaactctgtgatgagccccaggcagcctttcgtgggagacagtgatgatctgtatggggatcctctcttcataggctcgcagaggggaagataatgttaccatttcctgagagcccactctgtgccaggcccttcctgggacactttacatacattgtctctaaatccttccaaccactcttcaagggaatacaagtgtccccatatcatagatgagaaagctgaggctgagggaggtgaaatcacttgtctaagatcccatggtgggtaagtggttgagctgggatttacccccagatctgtctgaggctgaagcccatgatttttgcactggagtgctgctcaaatccattcttaaggcatgaacacaaatagtgaggcacagagggaccagggcctcgggggagtgcaaggtcaagagctgtggaagaggcagactccagctgaagaggttgactgaggaaagctgcatagaagaggcaatgtttgacctgagccttgcaggactggggtcattggccatgtagagataataggagaggtaggagtggtggctgagcacgctgaatggctagggtacggacagggagctgcaatggctagggtacggacagggagctgcaagcctgaaggagcaaagtttctagtgagcacttggcatgggagtagccatggtagagcaaattgcttcctagcagatagatgtggatttcaatcctggctctaccacttgcttctctaaggtctctgagcctcaatatccacactagtgaagagggaatcatgatcttaacttgcagcgttgtgatgaaaatgacaactgctagatcttagtagatacctcagatataaaaagttattgtttttttttgtttgtttgttttttgagtcagagttttgctcttgttgcccaggctggagtgcaatggcgtaatctcgcctcaccgaaacctctgcctcccaattcaagcaagtctcctgcctcagcctcccgagtagctgggattacaggcatgcgccaccatgcccggctaattttgtatttttagtaaagacggggtttctccatgttggtcaggttggtcttgaactcccgacctcaggtgatctgcctgcctcggcctcccaaagtgctgggattacaggtgtgagccaccgcacctggccggtttttgttgttgttattgttgttaaggatatgaaactgaaaggtaggcaagggccagattagggaaggctgtgaaaaccgcatcaaggaattttgacttttgactttgttgtatttcaaaggcaatgaggatccaggggagggaaggatttttaaatgtttttttttaaacatttttatttatttatttattttggagactgagtctcactctatcacccaggttggagtgcagtggcgcgatctcagctcactgcaatctccgcctcccaggttcaagcaattctcctgcctctgcctcctgagtagctgggattacagacacccaccaccatgcccagctaatttttgtatttttagtagagacggtttcaccatgttggccagactggtctcaaactcctgacctgtggtcttactctgctacccaggctggagtacagtggcgccatcatagctcactgcaaactccaaatcttgggctaagcgattattctacttcagcctctcaaatagctaggaatacaggtacatgccaccatgcccagctaatttttaaattttttgtagagactgggtctcactatgttgcccaggatggtctcaaacttctgggctcaagcgatccttggacttcatcctttcaaagtgctgggattacaggtgtgagccgctatgcccagacaggaaagggttttaagtagaggaatcatctagtcagttttgtcttatgaaggatcccataagctgtcactatgtggagaaaggattggaaaaggagtgattagaggcaagaagatcagtggcacaggtgagaggtgaatgtgacctggatagaaagaaatgaacagatttaacagatgtgtaggaagaattaactgggctatagttctattggatatgtggacccgggaagaggagggcatattggctgagcctcaggttcatcgcttgggagttggggaaggtgggagtttgggagtttgggggtacaaggaagtccccaggggaggaacccaagagagtaagaacagagttggggagagcagggctctgagccttcagtccccacagagcagtggtgatggaggacacctgggatttaggcatgttatgtgtggctggaggagaaagagagctgcccccatgagcttcctgggcaacctattatatatatcttgttcctgccatgggcagaggagggacatggcagtgggataatcaggacgtaatcaggagtcccccttgaggaaaagaggacattgcctcccaggccaaaaacttgtcctgggacttcaggtgagctcttgccctggctgagcacctgttcccttaagaatttcccaggtggagtccaggcccatgtctgcttcagagcccagccctggaggggaattcaagggatagaatgtcagagagaacaacctattccaggcaatggagtgggaaaggtcagaggccgcacagacacgcacagggccctggaccttctgccccagtgagcagaagggagagcaaaaccctacctaactctctgccctgatttgtctaaaattcctccctttgggctcagcattgcccttttcagattcttctgccctgatgccaactattcttttcactgagcactcacaccctcagcactccccattccatgggaagagtttatcagaaccttcttgaggaagggaacactggtaggtctgggaaaggtgtcaggaggtgcagggcagagtgggacagaaaaaaaccaaactttctaatttttagtactttgttttacctcacccccctcctctaattcaacccactgtcaagtcccattggttctagaatctatatggatatcctaaacagctctgaaatctaacctcttatctcctttcctggcctatctccagctctaggccagcatcaccattcatccacactcaagcaacactgcactaaagggtcatccagcctgcagtgttgcttcctttccaacccaaccttcttcacaccatagccagagtaatcttttttttttttttttgagacagcgtcgacctccagggctcaagcaaccctcccacctcagcctcccaagtagctgggactacaggggcacaccaccacacctggctaatttttaaaaaacttttgtagagacggggtctcactatgttgtccaggctggtctcaaacttctgggctcagcgatcctccagtctcagcctcccaaagtgctgggattacaggcatgagccactatgtctggcccagagtaatcttttgaacctagtctcttactcttctctgcttaaaatccacctctgttcccccattgcaagcctcctgttaaagcccaagattctaagactagctgtcaaaacttgtgagtctttcttccactgctgcccaacatgcacgattctctctactcatgtggagccttagctatctttgctagacaccttccctgccagtgttcacactgtccccaaattttcttgtcttttaggtttctagatcctcaaatatgataaaatatgatcatgattcagctcagataacatctctgcaaagcatctactccctccccatttctttttattcttttctttattcctttatttatttatttatttttattttgtatttttgtatttttagtagagacggggtttcaccatgttggccaggctggtctcaaactcctgacctcaagtgatccgcccgcctcagcctcccaaagcgctgggattacaagtgtgaaccaccgcacccggccttttcctttacggtttgactctgggactccctccccaattctggtctctcttttacttgcccagatgtatgcctgagtgagatgcaatgaggctcaccttttttctttttttttttttttgagacagagtctcgctctgtcacccaggctggagtgcagcgatgcgatcttggctcactgcaagctccgcctcccaggttcacgcctttctcctgcctcagcctcccgagtagctgggactacaggcgctcgccatcacgccctgctaattttttgtatttttagtagagacggggtttcactgtgttagccaggatggtctcaatctcctgacctcgtgatccgcccgcctcagcctcccaaagtgctgggattacaggcgtgagccactgcacccggccaatgagactcatttttaagaagcatcttgagggcaaagactcagactcattcatgaagtggttgctagcacatacagtgcctttctgtaaattataaaaaggcactccccaaccctgggatgaatgagaaaaaatgtgccctttcctctgggctgacaaagccttgaaataatgtgcatgacttagtcaatagagcatggctggatttttgcccccatctgccctctctacccaagctgttttgtgcagggcacaacttgcaaaagcaaatgtactcccctactcagtaacatctgccttcttcacagcgtttgaagggatggcttcccaaagaaagggaagtcaggaacagggagataaacaaatagggaggcaccttatgcatctcgtaagtggggctgaggctaggcctcaccctcttcaggtggattctggagcataaagtgaggctaaaagaaggaattctggcttcatcaggaagaggctgcaggaggtgggagccaggtgggacagaccaaccaaggtttgaaggagttctcgaatagggaggcaagctttcataggggacagaaattggcaggggacaaatggagaggagccaagcaaaagaaggtcttagtcaatcagaatccatgaaattcttggccaggagtggtggctcacgcctgtaatcctagcactttgagaggctgaagcgggcagatcacttgaagtcaggagttcaaaaccagcctgaccaacatggtgaaaccctgtctctactaaaaatacaaaaaaattagcttggcgcggtgatgggtgcctgtaatcccagctacttgggaggctgaggcaggagaatcacttgaaccctggaggtggaggttgcagtgagctgagatggcaccactgcactccagcctgggtgacagaatgaggctgtgtctcaaaaaaacacaaaaaacaaaaaacaaaccatgaaattccccctagggtttcagacttttctctctgggggctgacctagccttttctggtcccatggtgacagtcctgcctgatgccagcaggaattcagattaaagtcttgtccctgcttctccagcaggtggcagctgtgctcaggacccaatggcagcagagagctgggcactcctcctccatgctggtgggcctaaggccaggcgactaaagttgctgctgtccctggcaggcccagaggaaagattgatggcacaggcattgctggggctggccaacacagccattgattttcatttaggagaataattaaatattaattttcactttgttaagctggagagggtgaataaagccaatcctgacagtatcagaggaagccaggccatgttggagacctgcagatgaaacagtgagagggggaagatgtccccagtcaccattctctctagaacctaagacccctgtctgctacctggttgtctcaggtcacagtacagtggttaagtgaatgagttctagggccagattagctgggcccaaagtccagatcttcccattattaactatatgaccttgggcaagtcacttgattcttatgacttagttttctcacctgtaaaatgggaatgccaataacaataccttatttaggcctggtgcggtggctcatgcctgtaatcccagcattttgggaagccaaggtgggtggatcacttgaggccagaagttcaagactagcctggccaacatggtgaaacctcatctctactaaaattacaaaaattagttgggcagagccctgtgtcttgtggaggagagatttttttcctcccaaagtttatcttaatttttttgggggggacctcccatttcctttcagggtaaagcctggcattcaaagtttcatcttcaactgctgccctctgtagatcttccctccagcttccctccatgctcacgtgggcctcccccacagtgccagccgcatttcacacccacctgttccttctgtgtctgcacctttaccatgctgtttcccacatggaatgttacagcttgtctcattgactctcagttctagaagcagaagtcatttgctcccatgattagatgaatgatgagttctactcctactcctactaatgctgctgttactattactgttactatcactactaccaccagctaactcatatcgagtgcttattttctgccaagaacagcattgagtactttagttcacttaatgacttagctcatttaaccacgacaacaaccctatgagtttaactttacaggtgaggaaacttaggcttagcagtaaagacttgcccaaagtcacaaagctagtgagtggtgggcctggatccacacccaggtctctctgactcaggagcttgcatacagaggaccagtgatggtgacaaattggtgttacttggcacttagtccccaaaagtgaggctaaaggtgcttcagttactgtgcttggttctaggagctgtcaccccattaacagcttgattagctcttggcgaagcttgctccattgcttggtagctccaattcagagaagtgacttctttatactgagctgaaatcagtgcctatttcttattatattaactgatccgaatcttgccttctgggatcactcatagaaaaccaaacccctcttctagaatctgaaggtagttaccccaaccccaacagtagtacttattgagatcttactctgtgccaggcacttgctaagcctcaagtaatcctcactacagccaagcgagctaggtgttagtataacccactcctcatatctaaagagactgaagctcaggagtccaagtaacgtgcccagagacacagaactgataaatggcagagctgggattcaaatccaggtctgtgagactcaaaacccagtgtttttttttttttttttttttttgagactgagtctcactttgttgcccaagctggagtgcagtggcatgatcttggctcactgcaacctctgcctcccaggttcaagtgattctcttgcctcagccttccaagtagctgggactacaggcatctgccaccatgtctagctaatttttgtatttttagtagagacagggtttcaccatgttggccaggctggtctcgaactcctgacctcaggtgatctgcccgccttgtcctcccaaagtgctaggattacaggcgtgagccaccgcactcggcctcaaaaaccagtatttttaattattagcttatgatgcctccctattaaagtccctctaagccctatctcctccagttaaatcatcccaactcttccaaactattattccaaatatatcttgtgtctttacttcatcctcgtctctttcttgtagacaaacgactctcttaaatttgagaggcctagaactggacatagtcccaagtttggcctgtgaatggcatttaaacagtgctctgttctagacacaccgcttcttggacaagagaaaacaaggctgtatagtatgacttgctcttggtaaacccatgctagttactaacgatcacccctttattctgccatatggtcagtaggtcccaccttgccttttgttgactgattatccattagccaagaccagaccaggtaccattggtgcctacaagccaagctgcctgtagaatcaggtctcccctaactttagccaagtgtttgcagtgtggagggaagacaatcttagtgagtcaaggcaccaaaaataaccattacaggaaaaggactagagagaagttccagcaaggaccttaggactagagaaaatgggctaccagtccagcagaacctctaccccatgtatctgcatacatgctcacaccagtgacaagagacacccaaagccataattttaccaaggtgaataaattctagcttagccctcaacactgatgcctctcctaaaagatgggtggaacgcctggcccaaggatcttgagccccttttttgagccagaagattggatgtaacaaagaatttgttgctgttcagggtacaggaagccctctcctagaaagatgactctgcttctagttctcggtcccaacccagcccccacatgctgctttggcatgcacacagggcactgtccccagcctgaggtgattcccaccccccaacctggaggacttacccctggcagggtcttctgctcgtgcagtgcactctgggccttgagagcagagtcccgggcgcagtaggtgaggaaggcacagcctgaggaggaagaggctggctcagggggtttcctgaaacccccaactattcttcttcgaaataccccactaagttgacaaacttaaggccactctcctttaagcaaggactctgctttctgagaagccctctctgcctcccacctctggagggaggggcttcatgtgcctggggaccagtgtcccaggctctggctccctttcatttgctcctggcatcctgcccagagaacatatgtgcccacacccagtcacatgtgcatacaatcccacatctcccctccccactccagtcacaagtcctgttggggttaaacctccctaagcagctttatcatcatctttaacccagacttccccttcctttttggattcagactcatggagtctcccaggatcagcctcaattccttcccaactcagtttcggatgggaggaggcaaaagagtaaaagaaggattgggagccaaccccaggagcccccagctcttgtccatgtctccctcccctaagtttgaagctggggaatggattgatttgagacttagaagatgggattggtttaagggcttcccataggtgggagtttccagggaccccctaatcctgttcaaggatcttgatctgtcaaccctcctagggctttgaggtagggcctcttaaagagttattgtgcctcaaatctggctcctctaaaagggccagcatatatgggtcagcgaagaggtctaggttgagccaaagggtcaagtttagccctctgtttgttcagcctcaggacctgtagcctgctaggaagcactgaagcagcactctcctcctttccaacagccactgagcactcattcattcagaaaatatttattgaacacttacttattatggtggggcattttgatgaccttggagatagagtggcaacaagacacacattccctgccctcatggggattagacaaatcatgagggacccctaaacaagtccaaagggttgagtaatgtctcaaagaaggcactgagtcctcgagaacaagaacactgagtccttaacaatcaggtgatgaaaaggacagtgattatttcagacagagggaaaagcatatatgaagactgaatcaagaatttggtgtgttggggaaatggataggttagtgtggctggaggctggtgtatgggggcagagtggctagtgagatatgcaggaatcaagtcatatgtagccttgtgggcctcagttggattttgaactttttcctaagagcaatagagagccactttaaagggttttaagcagatctgtgagatgataagatctgttttcaaaaggagcattctgagtgtaggagggagaaggactgaaggaggagaaagtggatatggtgagccattaggaacttggggcagatttccacttagacctcagcagattagaaaggcaaatgggaacatttttttctggcctcttctacagggctgccccattaagatgggtttattgccggacattcattgagttaaagggaacttagagaactgagcaaaactcttatcacatcaacagggaaactgaagcccagagagtgggtcagtggcagggcaggatttggaatgtcttaactcccaagctggggttgttttcaaagcactgtggctgcctgcctcggtacccagacatcaaaaggaaaatgagtcactgtttctggggagaggatgaggaagatgttgacttggagaccctctacaatcatcttggaaggcaacacttgccttggagagttgtgatttagtttggaaataaatcaccaaacacctgattccacttacatccctgctctgtgttttgctaccaacccatatcacctgacgtccaaaccgggcaggttgcctgtctgaaaggctcaggggcccagttgctgcctaaagaagccccatgtggactagccgggatagagggtggaagaatgaagggaagaaaagacagagaagcatggtttgagagacagatgaatgaaaataacaggcagaattagagctaaatgaaaagagagaggatgagggaacagttcagagactgatagtgagaagagtgagatttaagggtattctatacacttcccttattgtacggatggcctacaaagattagctttgtatgtacatcctgaaatcaatgtctaaaaataagaaaatgagttactacagagggatggacagacaggcaggtagtgggagtgcattagaaggactctagatggtgaggtattgtcctttcatacacccattaacacaatcccagcccaaagggtggaagctgtactcctagccagatggtcctagctcttctattggcattttctcgaagtgcctacattagtgtgccaaggaaccctacgaggcctccaagttgaagaggtggcagtctgattccagctctcagtccttaggaatgtacctttagctgttacccaaggcccaccactcctctcttaggaagatcatggaggatagttggtgactctttcccagcaaaaacttgaaagcacagcatggtggtggtggtgggggaggagataagagtgttccttctcaaatcatctccccttctcctgcccatgtatgacatgtgactctggctctcttactccagccctgcctggacagacttttctgcatgtaaacaagcctcctccctctctctacaggaagaaaggggtgtggccgaacaggaccgtgtatctctctagaaagggcagggagaagatctccttctgtctcttcagcctgactcaccctgagaatgggcctggactgggaccagcctgtgaggggagggaaagaaagaggccataaagaggactggggaggagcaaagaagaggcacaggagtgaggggattagagaaggaaagaagtgtggatttagctgagagaaatccaagaagaaagggacacagggtggcaggagttcccagctgaggtcagggttctgaactgaaatcaaaagaggtagagtgcattgggattctggcgaagggcaggagagattggggctgttgttgaacatgagggggtgtctggaactgagagcctcctgggaattgaattggattttgtgttagacaggtctgggttctgaagaaggggagggtttgggtctgcggtgttttaggttggcagtctgagagtcaaaagaaggctcttgagggggatggccggactaggaggccagaggaggggtgcaagtccaagatatgcatgtgggtggttaggcctgagtgaggtgccaccagatggaggattcaggagtgtttgggctcagggtttgggaaattgagggtattcgagatctagaaggtggaataagttttcaaattccagaattttaggtctgatgggagaggtggtggaaaggtccaattgaaaggcagggactgctgggatgtgagaggtggaggccaggaatttggaggttagagtggagaacatgttaggggaccacagtgataatcagagggaggatgtcagagagaaaattctgtgatctgggaagggggctgggctgaggtggggctgatattggactggtgttggactggctctcggcagggctagggctggggctgggctggggtcgggccacactctaatcggattggggctgggctgggctgggctgaccccgcgcacctttgtggaggccggtgagccggtccttcagcaccgtcagctcgtagatgcggccgaactcctcgaacagcggcttgaggtcctgctcgtccaagccccgcgggatctgccccacgaagagcttgatggcgtcgtggtccttcatgggtacggcgggaccggggtttagcccgctcatgccgacgccgctgtccgcggtgctgaaacccaggcgcgggccggggccagcgggctgcgctgaccctcccggcgccgcggccatgtccccgccctgtcagccctcccgccggtcccactggtcccgcctgtcccgccgtcccctccctggaccggtggcgagggccagggggagggggcggagcccgggcggagagggcggggggctgcccagggggcggggtccgggtggaggggcgtagagggggtggggcgggcaggaaaggggcggggccggggcggggcgggcccgggccgaggtggcggctgaacgctggggtctggcttgaggtccccgtgcggctctctctgggctcccgcccgagctctcccagagccgagccccgagccccagcccccgtgcttggtgacgtcaggcagctggccgccgagtctacgcaaatgatttgcataatgaggaagcagccgccaatcagagtgggagttgactgggctcgccgggggcggggggggcggctgggctcacgcgctcctgctcgccatggcaaccggaccctcgaatgccctgtgtgtgtcgagtgtgtgcgggcgtggccgtggatcgcgcgtgtgcgccttgggccgcgtgaggggaagcagcttcgtcatgcgtgatggtgtctgccggagtcggggctaatccccaccgcacacacaggcacacacaggcaaacgcaggcacacgcaggcacacacacctccaaacgctggtgcgtttcctgcgggggtggatggggattcctcttctctattcccactatcgagccagtccctcggagccaatcccaccccgccccatcacacatctctgtcttcggtgtctttaaccactttcttacccctgagcctcagacacattcgtctcccttgcagccttaaaaagaaaggaagaataaaataaaaaccccttaaacactccttgaacacggattcctccttaggagagtgagggaacttagccgtatttactcagaacccattatgcaccaggtgcccagttcatcccagttctgtgaactcaggagtgttctctttttccggaaaaggaagctgaggttctgagggtcgaggatgttagggccaggcccaccccaacatttgttgggcccagcgcaaaataagaaatggaaatcgacatactgtgcatctaaacatttaaaagatacaaatcaaattacaatttgttaaatatgttcccctcttattttcacaaatacaggttcagaattacgaaaatgaaagacatatgtacagctacgctttctatatgactgaaagttggcaaaatatcagagctgatggaattttattactcctgcacatgtctaggtattctcttgatggatcagtgatgtttgcacaaagtagtaatacaatgtttggacaaagacacatacttcataaattatatatttattccataatatatttttcatgcctctttcagtaaaattgctaattattttaatagagatttcctttttttttttttgataggttatcattctgtcacccaggctgtagtgcagtggtgcgatctaagatcactgcagcctcaacctcctgggttcaagcgatcctcccacctaagcctcccaagtagctgggatgacaggtgcacgctaccatgcctggataattttttttctttttttttttttgtagagatggtggtttcaccattctgcccaggcttgtctagaacactcctgagctcaagtgatccacccacctcggtgccccagagtgctgggattacaggagtgtgccactgcacctggcctaatagagattttaacataacttgtgtccattgactattctaagaaactgctggagaccagcagtagcaactggaatcatcaaaaagttcttaaaacaatattcaattcagaagcaaatcatgatttttaaatgatttatttttctggctgagcatggtgactcacacctgtaatcccagcactttgggaggccaaggcgggcagatcacttgaggtcaggagttcaagaccagcctggccaacatgacaatatcccgtctctactaaaaatacaaaaattagccaggcatggtggcgggctcctcctactctggaggctgaagcaggagaatcgtttgaacccacgaggtggaggttgcaatgagccaagatcgtgtcactgcactccagcctgggtgacagagtgagattccatctcaaaaaaaaaaaaaaaatgcagcagcaaattatgattttcaaaaatcatttttctggcgggatgcggtggctcacaccagtaatcccagcacttcaggaggccgaggtgggtggattgcttgagatcaggagtttgagaccagcctggccaatatggcaaaaccccatttttactaaatgaataaataaataaaataaattatttttctcctttaacagaaagttactccttgtaataagttgaccacgaaatgggttactggaatttcattttcattcagtcctatgtagttttttttttttttttttttttgagatggagtcttgctctgtcgcccaggttggagtgcactggcccgatctcagctcactgcaagctccgcttcccgggttcacgccattctcctgcctcagcctcccgagtagctgggactacggttgcccgccactacgcccagctaattttttttgtatttttagtagagatggcgtttcaccatgttagccaggatggtctcgatctcccgagctcgtgatctgcttgcctaggcctcccaaagtgctgggattacaggtgtgagccaccatgcctggcccagtcctatgtattttttaaaattttcaccccaaaagtagtaaaacaattcaaaaatcagaacaaagttctctgcagaaaaagaaaaatacagtaaaaaatttccttgaggcttcctctttgatccatatattatttataaatgtattgtttagtttctaagtgtttggaggtttgcctattatttttctgttattgatttctagtttgagtccattgtggtcagaacacactgtgtataatttcaatttttttttttttgagatggagtctcgcttttgtcacccaggctggagtgcagtggcgtgatcttggctcactgcaacctctgcttcccgggttcaagcaattctcctgcctcagcctcctgagtagctgggattgcaggcacccgccaccatgcccggctaatttttgtacttttagtagagatggggtttcaccatgtagtccagtctggtctccaactcctgacctcaggtgatccgcctgcctcagcctcccaaagtgctgggattacaggtgtgagccactgagcctggcctcaattcttttgcatttgttgaggtttgttttgctaccctcagtcccaagcctgggactacaggcgcctgccaccacactcagctattttttttgtatttttagtagagatggggtctcaccatgttggccaggctggtctcaaactcctgacctcaagtgatccgctccccttggcctcccaaagtgctgggattaaaggtgtgagccactgtgcccaaccttgtatttttagtagagaagcggtttcaccatgttggccaggctggtcttgacctcctgacctcaagtgatctgcccacctcagcctcccaaagtgctgggattacaagtgagagccacagtgcctggccctatatgcttgctgattttgtctagttgttttatcaattgttgagagaaaggtgttgaagacttcaattgtaattgtggatttgtctatttctcctttcagttccattagtttttgcttcacatattctgtagctctgtcatttggggcataaacattaaaaactgtgatgccttgatgaattgatacttttattattatgcaatgtcactctgttcttggtaagctttttgtgtggagagctactttgatattaatatagccatttatgttttcttttgattaatctttgcaaaatatacctttttctatccttttactttcaagctacgtatatagctgtatttaagtgagtttattttagacagcatataattgggtcatttttttaaagtccactctactaatctttgtcttagttgacatatttagaccatttacatttaatgtaattattggtattacaggtgtgagcctgtaatttacatttacatttaatgtaattattggtatgttagggcttaagtctgtcacttaattttttgttttctttttgttgcctatgttcttcatttctcttttctttatctttcttcttgtttttttgttttgttttgttttgtttttttagagatggggtcttgctatgttgcccagaatggtctcaaactcctggcctcaagcaatccttccactttagcctcccaagtagctattattacaggcatgagccactacacctggttcatttctgttttatttttcctgtgctcttgttgataaagtgtttcttattctatacatacatagcttatcacagtgtaccggtattgacattttgccagtttgagtgaagtgtagaaaccttacctactattaagtccctttatcctccctcatttataattaccttaagtatttcctctatatatttcagaaccactttagacaatgatatacaatcagcatttataaaaaacttcagaagcattaaagtctatcgcatttacccacattttccttctttcagttgttttttctccctttctgacagtccaagattccttattttatcatttcctttacattttaagaacttcctttagccattcttttagagtagttatgttggtgacagattctctaagtgttccttcatctgagaatgtcttgatctcccctccatttctgaagtatacttttgctggatattgaattttggtttgacagttcttttctttcagctcttgaaaaatgtgccacttctttctggcctttgtagtatctgatgagagatcctgtttttctcttatacataagagattgtcatctctttctcaattctatgtttgtctttaactttcagaagtttgattattatgtgtcctgatatggatttctttggctttatcctgtttggcgctcactttctttaatctggagatttatgtctttcgctaaatttgaatagttttcagccattatttcttcaagtactttttaagcccatctcccctctcctctctctccatgacaggagtgttagatcttttgtaataatcctataggtccctgagactctatctattttctttctttctttctttcttttctttctttctttcttttctttctttctttctttctttctttctttctttctttctttctttctttttctttctttctttttctttttctttttttttttttgcagctctgaggtaaacttttattttttggctgacaggacttccacccccatgctcctcctggcaccttttactctgcccaagcagtggcagcccagtccaaaaggtgcctgccatggccaaaggggttgaggagtcagattctatctattttttttaagtctgttttctcttggttgttcagattgggtaagttctattgttctatcttcaagttcactgatgctttcctctatcttctctattctgacattgaatccattgagtttttcattttggttgtattttttaattctaaaatttccttgtgggccaggtgtggtggctcacacctgtaatcccagcactttgggaggctgaggcagggagatcacgtgaggtcaggagtttgagaccagcctggccaacatggtgaaaccctgtctctattaaaaatataaaaattagctgggtgtggcagcatgtgcctgtagtcccagctacttgggggactgaggcaggagaatcgcttgaaccaggaggtggaggttgcaacgagccaagatcataccactgcactcccatctaggcaacagagcgagactctgtctgaaaaaaacaaatttccatgtggtcttcatttatattttctatttttttctaagactttctatttttccatttgtttcaagtgtgtttgcaagtacttatgatgcatttcatgatggctgcttaaaaattattgacaggtaattctaatatgtgtgttatctcagtgttagtgcctattgattcttttctcattaaagttgagatattctcgattcttagtataatgagagattttcaattgattcctgaacattttgggtattttattatgagattctggatctcatttaaacgttatatctaatttaaacatgtttagcaggcctcctttgacccccagctagtgaggaaacaaggacactgccttggttattgtgagataaggatggaagttaaggtttcctactaggtctctgctgaaaccacctcaaatgaaagggaaggtggcctcactgctgggcaggagtggaagcttccaactagagactcctatgatactgctctatcaagaagggagaggagtcccatgcggtctccactgaacccataagaggtgtatctgttaatgctgggtgggtatacaagtcctagctcctcatttgacattctctgatgacaccttaatagcaggtgggagaagggtctatgtatggagttgttacatccatagcctagactagttgaatcagaattgctggggtgggactcaggcatcagcatgttttaaaactcccttgttgaatccaatgtgtgtggaagcaaggttaagaattagtgctttagaagttcctttagtcaagagactgttggcgataagctctgctttgcttatctggaaatgcttttatttcgaatcacttcttgaataataacttagtaaatatataattattttctcttacttcactttgaagatattatttcaccatactttggtttccatttttgcttatgagacatcaactggcagtcaatttgcaggtagctggtgtttccctgactgctcttaagatcttttgatttcttttggcaatcttcacttttacaaggatgtgtttagttgcttaaaatttcttgtgctttctaaatctgcacatttatgttttccctcaattaaagaggactgtcagtcattgtttcctcagttattttctttctcccatgtggtgtgatgtgctgccattgtgatgtgatggtcaagacctcccttcccccaacccttcagtgaagaatgtgttgttatagtttaggggagtgctgtccccttcagagtttgcctcaaggtcatgccccttcccagggcagcccaaatccaatgactaattaatacaggattataaaggtctagctatctcagcctaaatcagaacaatggtgaaggccattctatttgggctaaatttaaaatagttggatatgtaaaaatttgagtttggtgccaatgggcttttgagctaatgagtcccagcctgctctgaagaagtaaacaacatagggccaatatacagaggtcatctttggttcatttgcataacatggccccagcactggcactgaacatatcattatctcttcaggcattggccattccgggtttgttcaccccaggtacatgtgtgtctattcaacctgtagtttgaagcttttttatttcagaaaaacaaagaacaaaaaactgttaggccaggcacggtggctctcacctgtaatcccagcactttgggaggccgaggcaggtagatcacttgaggtcagaagttcgagaacagcttggccaatacgatgaaaccccgtctccattaaaaatacaaaaattagccaggcgtggtggtgggctcctgtaatcctagctacttgggaggctgaggcaggagaatcacttgtacccggaaggcagaggttgcagtgagccaagattatccattgccctccagcctgtgcgacagatcaagactccctctcaaaaaaaaaaaaaaaaaaaaggtatgaaagtatagttttagtgtatgttctgttctgttgctttccctttcctcttcaggaaatcctgtcatacatatgttagatcttctgcctatcttgttttttgttttgttttttgatcactttctcccaaatccttttttatctctttcttctttaaaaatatatttttttaaaatcctccatggctggtgcggtggctcacacctgcaatcccaacattttgggaggccaaagagggcagatcacctccatttaatcttctatttgtctgaagatattatccattgtcatttttgctagtgaaacttctagaatagacttcatttctgaaataacttttcatttattctaattccctcctgagttctgtaacctcacttttaaacatcttattttttccaatcatcacatttttgaatttttctcactcttatattgatttttcatagtcccttttcttttcttaatggttttcttttgttttaagggtaaatctttctgtcatgctttcactgtcaacagggacattatggtattattccctatcctcctcttttatgtatggacttcaattgagtagttttaattgcttttttttttgagatggaatttcgctcttgttacccaggctggagtgcagtggcatgatctcggctcattgcaacctccacctcctaggttcaagcgattctcctgcctcagcctcccaagtagctgggattacaggcgcacgccactacacctggctaactttatatttttagtggcgaagggattttgccatgttggccaagctggtcttgaactcctgacctcaggtgacctacctgcctcagcctcccgaagcgctgggattacaggggtgagccaccgcacctggcctaattgttcatttttaagggcaatgagtttttctgtttagaaagagcaataggaagaatagcctttttctttttttgtgtgatggagtctcgctctgtcacccaggctggagtgcagtggcacgatctcggctcactgtaacctccatctcccaggttccagagattctcctgcctcagcctgccgagtagctgggattacaggcgcccgccaccacacttggctaatttttctttttttaaccatgttggccaggctggtctcgaactcctgaccttaagtgatctgcccactttggcctcccaacgtgttgggattacaggcatgagccaccacgcccggccaagaatagcttttctagcttcaaagctttagagttttctttaccttaaaataggtgatacaaatgtgatctttgactcccgagacaggcatcctctactacgccacctacttctatctggaccttctctctctctctctctctctctctttttttttttttttgtccttattgtctctgctaagttctatttggattctactgccagcagtttctcctctatttgggctttgtcttggaaggaagtgttgatttgttagtctcaagatctcataaagttcagaccactccaatatctccagaactttaaaaattagaacagaaatcaatgaaattgaaaacagaaaataaagagaaaaaaatcaacaaaatcaaaagatgattctttgaaaagataataaaattaacaaacctctagccaggctaaccaagaaaaaaacaagacacaaattattaatgtcaaaaattagagatggggctcactcctgtaaccccagcactttgggaggctgaggcgggcaattgcttgagtccaggagttcaagaccagcctaggcaacatggggaaaccctgtctctacaaaatataaaaattggctgggcttggtggcgcatgcctgtagtgccagctacttgggaggcttcggtgggaagatcatctgagtttgggtcggtcaaggctgcagtgagccgtgattgtgccactacactccagcctggacagaatgagccccagtctcaaaacaaaacaacaacaacaacaacaacaacaaacagagataggccatcactactgattccatgagcatcaacaagataataacgcaggctgggtgtagtggctcatgcctgtaatctcaccactttgggaggacgaagcagccagatcactttaggtcaggcgttcgagaccagcctggccaacacggagaaaccccatctctactaaaaatacaaaaattaggctgggcgcggtggctcacgcctgtaatcccagcactttgggaggctgaggcgggcggatcatgaggtcaggagatcgagaccatcctggctaacgcggtgaaaccccgtctctactaaaaatacaaaaaaaattagccaggcttggtggcgggcacctttagtcccagctactcgggaggctgaggcaggagaatggcgtgaacctgggaggcggagcttgcagtgagccgaggtagtgccaccggactccagcctgggtgacagagcgagactccatctcaaaacaaaacaaaacaaaacaaaaaaaattagtggggcgtggcgacaggtgcctgtaatcccagctactcgggaggctgaggcaggaggagaatcacttgaacctgggaggcagaggttcagtgaaccgagatcgtgccactgtactccagcctgggcaacagaggtagtgactccatttcaaaaaaaaaaaaaaaaaaaaggataataaaggaatattatgaagaattctatgcccacaaatttgtcacacaggctaaagtgcagtggtgcaatcacagctcactgcagcctccacctcctgggctcaagtgatcctcttgcctcagtttcctgagaagctaggatttacaagcatgtaccaccacacctgggtaagttttttttattttttgtagagacggggtcttgctatgtaggctagggtgactaatttgtattatttcttttctctccttatttgaaatttaattttctatgtctagtttccagaagtggaagccgattattgattttatatctttctccctttggaatatatacattcaatgctacaggtttctcttgcagcattgcttttactacatcccacaaattttgataagttgtatttttcgttttcatttagtttaaaatattttcaaaatttctcgagtctttttttcttttttgaggtggggtctcactctgtcacccagcctggagtacagtggcatgatcatagctgtattagtcagggttctctagaaggccaggactaataggacagatgtacatatgaaagggagtttattaaggagtatcgactcaaacaatcacaaggtgaagtcctacaataggccatctgcaagctaaggagcaagaagccagtctgagtcccaaaacttcaaaagagggaagctgacagtgcagtcttcagtctgtggccaaaggccagagtccctggcaaatcacttaagtccaagagtccaatagctgaaaaacttggagtccgatgtttgaaggcaggaagcatccagcacaggagaaagatgaagaccagaagactcagccagtctgtccttccacgttcttctgcctgctttattccagctgcactggcagctgattagattgtgaccactggattgaggatgggtctgacttgttaatctcctttggcaacatcctcacagacatacatatggaggaacaatactttgcatccttcaatccaatcaaattgacacttgatattaaccatcacaatagctcactgcagccttgactgcctgggactcaagtgatcctcccacctcagcctcccgagtagctgggaccacaagtgtgtgccacgcccagctaatttattattattgtttattttattttttttagaaatggggtatcactatgtttcctaggctggttttgagtgtttttctttggcctatgtattattcagaagtgtattggttaataagctactccggagactgaggcaggagaatcgcttaaacctgggaggtggaggttgcagtgagctgagatcgcaccactgcactccagcctgggcgacagagtgagactctatctccaaaaaaaaaataataataataaaagaaaagaagtatattggttaatctttaaatatttgactattttctagctatatttctgttattgaattctgtttaatttttttgtgatttgggggcatacaatgtatgatttcaagctctttaaatatgttaaggagtgttttatgcccaaaaatgtggtctatcgtggtgaatattccgtgtgaacttgaaatgaatatatagaccaagttgactcatgttgctgttcacttcaactatgtcactaccaatcttcctcctggatctgttaactcctaatacagggctgtcaaaaactccaactataatagcagattgtttatttctttttgcagttctatcagttttttttctctcttatgtattttgatactagggcatacccataaaggattatgtcttcttgaagaactgatctctttatcattgtgtaatggccctctctttatcctttttttctttttttttttttgtttgtttttgagacagggtcttgctctgtcaccaaggctgaagtgcagtgttgttgcaatcatggctcactgcagcctcaaactcccaggctcaaatgatcctctagcctcacccttctgagtagctgggactacaggcacataccaccacgcctggctaacttttgtattttttgtagagatggcatttcaccatgttgcccaggctggtctcaagtgatcctcctgcctcggcctcccaaagtacaggggttacaggcatgaaccatcacacctggccctctttatccttcataattttccttgctctgaagctgactccatctgaaactaatacagctttattttttctttcatagagatgggggggtctcattatattgcccaggctagtctcaaactcctggccttaagtgatcctcccgcctcgacctcccaaagtgctgggccaccatgcccagcctccagccttcttttgattagtgttagcatgatgcatctttctccattcctttacttttaacccatctgtgtctatatttaaagttgatttcttacagacaacaccagttgggtcttttttttaaattattattattattagagtcagggtctctctgtcacccaggctggagttcagtggcacaatcacaactcactgcaggctcgacctcctggggtcaggtgatcttcctgcctctgcctcagcctccagagtagctgggactacatgcacgcaccaccacaccggctttttgtactttttatagagatgcagttttgtcacgttgcccaggctggtcttgaactcctgggctcaagcagtctccccaacttggcctcccaaagtgctggaattacaggcacaagccactgagcctggccctttttaaaaaattcatgtatttagaccattgataaaattgccattgctatttcttttttctttctttttttgtcttctttggttttaactgatcatttaatataattccattttctcttttctgttaatatagcagttatacttttttgggggcatagggtctgactctgtccctcaggctggagtacagtggcacaaccatggctcactgtagcctcaacctcccaggctcaagagattctcctgccttagcctcttaagtagctgggactacaagcctgcaacaccatgcctggctaattttcaaaatttttttgtagagacagggtctcactatgttgtcccagttgctctcaaactcctggattcaagtgatcctcctgtcttggcttcccaaagtgctgggattacaggtgtgagccactgcactcaatccttctctttaaaaaaatttttagttgctgccctaaatttcacaatatacatttataagtaatccaagtctccttttctcttgttttctttctctctctctttcattcctttttctttcgagacagggtctttctctgtcacccaggctaaagcacagtggtgcaatcatagctcactgcagccttacctcccaggctcaagcaatcctcctgcctcagcctcctgagtagctgggctaatttttattttctgtagagaatacaggtcttgctatgttgcccaggctggtcttgaactcttggcctcaagcaatcctccccatcttgttcttcgaaagcattgagattaccaattcctctctcccattctttttttttttgtttttgtttttgacaagaggtcacccaggctggagtgcaatggtgtgattttggctcactgcaacctctgcttcctgggttcaagcgattctcctgcctcagcctcctgagtagctgggattacaggcgcatgccaccatgtccagctaatttttgtatttttagtagagacggggtttcaccatgttggccaggatggttttgaactcttgaccttatgatctgcccacctcagcctcccaaagtgctgggattataggcataagccaccacgcccagcctcattctttataacattgttgtcatgtatttcacttattcataaggtaatcactgaatacattgctggtattattatttcgaacaaactgctatttgttacatcacttcagattaagaaaaataaaatgttttgttttatcttcatttactccttctctaatgctcctcctttcttcctatagccccaagtttttttcatatagcccctagatcattttctctctcttcaaagaacctctttaattttcttgcaaggcagatctactggtgataaattttctcaagtcttctttgtctgagaaaatctatttcttcttcacttctgatggataattttgctagaaacagaattctaggctggtgggtttatcccccctttttttctttcttacatatttcacttcactctcttcttgcttgcatgttttctgaagagaaggccaatgtaatccttatccttgttcccctataggcaggtgttatttttctctggctcctttcaagattttgtcttcgattttctgcagtttgaatataataatctatagatatagattattacttggcatttatcctgcttggtgctatctgagactcttggatctgtggtttgttgcctgttattaattttgtaaaattcttgattgttattactcccttattattctcttcatgtgcctggttatttctgattatatgataggcattgtgtttgaaaaatatttttagaaataattggaggtctaggggtacgttttccttctacagaatggatatacatttgtttctggaaggcatctaggggctctagcaatctgagataatcaaactaattttagtgattgagatgactcatatctgagcagtttctgagcaatgaatggtctgttttcaatttatcttgtagagtttggtcttttgaggtctcaacccaaaaagtggagagttttccagggtcctttttgtgggcccgggattaaaactttatttctcattttatttacttattttttcctacctcctggaattataaggaatggactacaacttttaatccccaaccctgtgaggttgtcaaaagtgcttcagagcattttatcagccttatttggaattggcaattgcacccagaagagacatgcccccaaatgctaggcttactgttcagggttttagtctttcttacatctcatccaagtaatgtttcataatattttactattccaatgccttcaagcttttctaattgtctccagtggtaagattgttccaaattacctagtctaccactatgagaaagtagccttcatatatatatatatacacacacacacacacatacatatacatatatatatacacatatatatacacacacatatatacacacatatatatatacacacacacacacacatatatacatatatatatatttttttttttgagatggagtctcgctctgttgcccaggctggagtgcagtgatgcaatctcagctcacttcaagctccacctcccaggttcatgccattcttctgcctcagcctcctggggagctgggactacaggcgcccgccaccacgcccagctaatttttgtatttctagtagagacggggtttcaccttgttagctgggatgttctcctgacctcaggatctgcctgcctcggcctcccaaagtgctgggattacaggcgtgagccaccgtgcctggcctatattttttattttattttttgagacagagtctcactctgttgcccaggctggagtgcagtggtgcatcttggctcactgcaacctccacctcctgagttcaagtgattctcttgcctcagcctcccgagtagctgggattacaggcgtgcaccaccatgcccacctaattttcgtatatttagtagagatggggtttcactatgttggccaggttggtctcaaactcctgacctcaggtgatccacccaccttggcctcccaaagtgctgggtttacaggcgtgagccaccgcacctggcctgccttaatttttgaaacggtttttatctttttcttgtatgtatatctgtagtatttttactcatatttgaataaatgtaagaaaatttgaataaaatgaattttcctgaaccagcgattagcattaaattcaggtagtttggagtctttaggctctttcttgtttcactagtttgtgcctttttgtttttaaattcaccttgttgctctgtatggtttttacagaagttggaagattaaaaaccaggtttctaccatgttcctataagaatctgaagtctcccaatttgttacataacctctgtatattttcaggttgctgtatatgaataagcctctttttgggttctgcattctgttttatggggctttttgtctatttctgcaccaataccaactgtcttgataattacacttttataatgacttatttttattttttaatttttaagagatagggtctcactctgttggccaggctccagtgcaatgctgcaatcatagatcactgcagccctgaactcaggctgtagtgatcctactgccttggcctcccaaagtgctggaaatacaggtgtgagtctgtgacttcatatgagggtagctgaagatacactgagtgtgaatgagatcactcaaagtgtatactggctggatatcaactctattccatgttgtacatgtttttctttttttctttttttgagacggagtctcactctgtctcccaagccagagtgcagtggtgcaatctcggctcactgcaacctccgcctcccgggttcaagcaattctcctgcctcagcctcctgagtagctgggattacaggcatgcgccaccacgcttggctaatttttgtatttttagtagagaaagggtttcgccatgttggccaggttggtctcgaactcctggcctcaagtgatctgcccgcctcggcctcccaaagtgctgggataacaggcgtgagccactgcgcccagcttatttttctcttcttaaaaattgactttttcattattcttaggaattcttgcacttactttaaaatcaatttcaagtttcccccaccctaaaaaagatttgcacttactttaaaatcagcttcaagttccaaaataaaaagaaattgaattttaataggaaccatattgaacctgcagataaatttaaaatccttatgaatattgagtcttctctttcatgaacatgttctgtctctacatctctatctcctgtgtctctccaaaatttagtaattttctccacaaagtccttaggtcttttaatagatttatccctaggatcatataattatgtactgttgatgtttatctaggctgacataagtcagaattttgaatgtgtatgtgaagatgtataacatgacacaatgttttacctttttttgcacaatccagtttgagctatttccttgtaactaatataggtagagtgtcagaaaatgattatggagtggtcaaaggcatcatcttgaagaggaagactggcgtatacttctgagtgaactggacaatggggcaaagcaggaaacacgtaatctgacttgcagtttaaaaagatgactggaagaactgaggcagatgcattcattaggatcctaaacaaagatggtggcagtgtagatagagaggagtacatgaatctaagagttatttatacagagtagggatgttgtggtgacaattatgacaggaaggaaggagttaaagatgattcccagacttcggctctaatgaccagcagaatagtcatacaggaggaatagagtggggagctatgaaaagatgaattctgcctgggacatgagctttaagtacgtaatggacattcagatgatatgaagatgttggctacctgagcttggaccccagaggaaatacacatacatatattatatatatgtttgtcggtcagtctatcatctatctatctatctatctatctatctatctatctatctatctgtctaatctatctgtctatctacctacctacctacctatctatctatggctgtccaggtgtaagactgcacactaagactgtctaaatgagatcactaggaagaaagtataagaggaaaggtaaggtgctgtggctcatgcttgtaatcccagcactttgggaggctgaggtgtgtggatcacctgagttcaggagctcaagaccagcctggccaacatggcgaaatcctgtctctacaaaaatgcgaaaaaattagccgagtgtggtggtgcacacctgtagttccagctacccaggaggctgaggcaggagaatcgcctgagactgggagacggaggttgaagtgagctgagattgcaccactgcactagggcctgggcaatagagcaagagagcgagactctgtctcaaagaagaaaaaaaaaaagaagacaaaaccttggttatgggctgagagtttactgaaggagtcagtgatagacattgagaaactcaggaaagaatggtgtcacaaaagcctgcgaagaaagaatttcaaagagggagggatcaaaatctcaaaaatatgcgaaaagatcaagtaatttttttccttattattgagcaatgtcccttgatttggcaacatgtaggttattgttggccttagtggaagcggcccttatgaggattacagcccaactgtggggtcatgagggctgaatgcaaagtggtgaaatagacaaacttgcaactgtttcaggcagcttgactaataaaagtggactgagaggttttaattttatttgtttaaacataggagaagaaatggattcgagcccagaaatagctgagttgctagctttatctgtatgtctgtatttggtgtccgagaggaggaagatgtctgacgtggggcagcccaggacagtggctgaaggcagtaggggctagagttaggtagctgagttaggagtcatatgccctgcaactccccagtgctaatcgggactcagcgtagctgtgtaaccatatagatgtcacttaaccttcctatgtttgtttccttatctgtcaaatgaggataatattgatagcacattggttgggatgaggattaaatacattaacatccagtaaagtgcttataatagtgcctgacaggtcgggcttggtggctcagcctgtaatcccagcactttgggaggccaaggtgggcagatcacctgaggtcaggagtttgagaccagcctggccaacatggtaaaaccccgtctctactaaaaatacaaaaattagcagggtgtggtggcacatgcctgtagtcccagctacttgggaggctgaggcaggagaattgcttgaactcgggaggtggaggttgcagtgagcccagattgcaccactgtattccagcctgggtgacaagagcaaaactccatctcaaaaagaaaagaaaaaaaaaaaaaaaacaacaaaagtgcctgacacagcaagcacataaaaatgacgaagcacttttgttctcctagctggatctccacatctatcttcattcagatttctgactcatgtgagtctagataaacaccagcagttgagttcctatgttcaaatatcctctttcataatagatcatccagacactcagacacacgctctcactcacacactctgcagcacaccagcgagcatggcaccccttcccatctgtgtctgcctgccagctgctcttcctcctttcccacacacactcccttttttgagtggcttccaaaacatctctttctaatttgctataaagagtgagccataaagaatttattaagtgatgaaaaaaatcacagctaagtatcagattctccagaggaaataagattaaaaagaaattctggaaaacagttgtttttggagaagggaatagcattgggaagggggatattaataatgtttcatcttttttgtttaaaaaaaacaaatctgaagcaaatatgactactgagatgcaacaaagctgggtggttacactgtttactattttctagacttttctgttgtttgaaacatttgaaatcactaaaaaataggagtatttactgggatagtttagactaaacatgggtgtggttagagtacagtaattactgtgaaaaaagcaaggttcctggacatttaaatttttttcttttttttgaaacatggtctcaccctgttgctgaggctggagttcagtggtgtgatcatgactcattgcagcctcaatcttccaggctgaagtgatccttctttctcagcctcctgagtagctgggactacaaccacacaccaccattcttagctaatctttttaatttttagtagaaatcaggtctcaccatgttgcccagggtggtctttaactcctgagctcaggcaatcctcccacatcggcctcccaaagtgctggaattagaggcatgagccactgcacctgaccctgacatttcgatttttaaaaattttgttgaaaaacgtcacacacacacacacacacacacacacacacacctgcttcaaagaggatttttaaaaacaatggtggctcggctagaaaagatactaattttcaacctttatttcaaagtttatttataaaggaaatacaaattttgataaacaaagcacccaattcctacttattttttttcttcgtggaaaaaaaagtatgtgacacatacttgtcatgccctgtattgattaagcttacaaaagatattgacagaaactatacaaatctagaatttagagtgctaggaatgttgccataaggtatgtgtacctacattaatactaaataaattccacctacatcctttctttcaccctttcccagtatcatttcagctttcctcacagtctcactgtcccagaagtctaggggcaatgactctccatcactagtgctgtggtggcacctgtgctcccacatcctgatatcctacccctacggcaatcctttgagaagcacctgaaaacaccagtgacctagctttattagattcctcgaagggaaggtacctggcatgcagcctcagctcctaccaaggagaggagaggttgaagactctcccagtctccattcactcctttgctttgatacccgttaggcctgctttgcctccttaatagactcctggaatgggaaggggtgggggtggggagcgactggagaactcttttcctaggatgactggagccaggaagtcagtctggaaacttccccaccccctggtggtgcacagcacacaagatggcctgtgttccgctcaggggtgggactttcaatttacagcctaggtgaagggagatgagttggggcaacagcgattctgttcattggaacagactgggtggtaactgcaggccactgcagttgacctgttggcattcgaggtctgacgaccttcaggtaaatgctcttatgatcagtggaccaaaggagcaacggtggagggtgaggaacagcacactttaccaatgaaagtcgtgaccaggccacgttagtttagtggtaaaaataataacattaaagaaaatgtttacaacaggaatagaaaatgacagaaccctactgctttaactcaagtgtatcacgatctctgccttcatccacttgagacttaaaactcagtgtctgctatttttacttaacattatcccaagcaatagtaacatgaaagttatgaccaggagggaagcagggtcgcacctgtgcagggtccttgtctgcggaccacccctcctacaagcttctgggtaatagaggtaagggggctcctgtggtgggtgccagtgctgggaccttaacttgtgtatctgggctatagccctggacttggctaggctgggctgtgtgaaaattccaagaattctgttggtagaaaatgcccaccctgtccttacaggaacagcacaaggctaggcttgtctacctcccaccaggacctcgaaggaacatgacccaggggctgaaggatggtgttgaaggaccgagttttactcagatccttctcagccctgccttcctgaagtttctgtatccactacactggaagctttctgaaaaaaatgcctggaacctgtccattgttaccccagcccagggcccagccaaagaacttaacaaataaccgccaaggaaatcctcacctaaaatggctgcgatgcattactgcccccgcctctggcttacagtatcacttctgcatctgaaaccaggagggggcagtctgggtccacgacgagacatttccttctagagaaaatcacacctgcaaagaccctctccagagccaccgcccacctccgcgcagccatccattccctgcgaagatgctttgggctgaaaatggttgggaggagggggatggaagtcgcctacgttattttggaattgaccagggcctctgagtccttcaaattcaacaatttaccacaggcccgcgtgcggtggctcacgcctctaatcccagcactttgggaggccaagacaagtgaacatctgaggtcatgagttcaagaccagcctggccaatatagtgaaaccccatctctactaaaaatagatgaattcggccgggcgcggtggctcacgcctgtaatcccagcactttgggaggccaaggcgggcggatcacgaggtcaggagatcgagaccatcctggctaacacggagaaaccccatctctactaaaaatacaaaaaattagccgggcgtggtggcgggcgcctgtagtcccagctactggggaggctgaggcaggagaatggcgtgaacccaggaggtggagcttgcagtgagtcgagatcgtgccactgcactccagcctgtgtgacagtgagactccgtctcagaaaaaaaaaatatatatatatgaattagatggacatggtggcacgtgcctattaattccagttactcaggaggctgatgcacgagaatcgcttgaacccaggaggcagaggctgcagtgagccaagattgtgccactgcactgtcagcctgggcgacagagtttttgagacagtctcaaaaacaaaaacaacaaaaaaacccactaccacagtgcctagagaacaatatgtgtttaataatatttaaataatggttgtataaaattgaagcagcaagaaacccaaaggagaatagctctaggggagggaggtggatgagtatgcatgggggagaggctcttctgtgaccaggttgggtctggagccctccccactgtccagaacacctccaagcccctacatctttttccatataccaacgccttggagatataatgcagaagtgaagtgagcaggctgaggattagggcaggtgtctggaatatggtcaggagtgggaggggagtgacatagctcacaggcaaggcagaacagcacaaaggctataggtttcattcccagccctcaacttaaaagacctcaggggcagacactgactccagcctggctgtgcccttaccctaacgccattcacacttttttttttaaacacaggtaatccatgtttattatagaaaaatgccacattactctttattgaatgcgagcgccagcaccggcccctttctctccaagcacaggggcacgcaggcaaggggcacgaaggcaaggggctccgtcccctggccaggatgcagtggaagcctggctccactaccattcacctacagccagcaccctcctcggtgcctggggctcaggtctgttcaaactcctgctcacagaagcctacattgaggggttgggcctggacacctcgcctgcaagaggacatgaagaaatggcaagataagcccctcagaaggggccccagcaacacttttcacaccagtcaacagtctctccttccccatttcggtgactctcaaactgtcactgtacaccaaatgcacctgggaatctcaattccagagattctcacctggggtggggcaaagtattggcaagaatctgcaagctgaacaggtgcctcaggtgattctgatacaggtcttggagatccagaaacgttggcgacatctatttatatcctgcccatctctgtaccctaaccccaaataactcaatccctttagaatatagatggatgtctgaaaggcagccaatgctcttggtctacttagccctctgttcctgactctaaaatgctgtaaatatggtggcactgggggacttaggtgctgtcctgtccatgaacatggatgcgaaatcctgtccttgggtctcagtctataacctgaccaatctccttaggggacctctaggcatgcttcccttatcatccaagtaagcaacatgcttagagaaccagctggaagttacccagtgaatgacataattgaggcttagacaccatcatgcttgactctcagcccaggactctgctctgcactaggctatgtcccccaagtactcaagacctagccaacgaaggaatcagggaaatgactatcttacacaggcacatccctgacagaggcaaaggtgtcatgacatcctgtaagtcagcctggttcaaatcctgcttcttagtgactttgggcaaggtcctgaactctgtgcttcagtgtctatctctaaaatgcacctgtctcatggggctgtggtgaagactaaatgagacaatatttgtaacaaacttagcacagtgtttgccacaaaatacagttgtccctcagtatccacaggggatttgtttcaggacccccgtggataccaaaatccaaggatgctcaagtcccttatataaaaatgacatagtatttgcatataaccaatgtacaacttcccatatacttgaaatgatcttagattacttatacctaatacaatataaatgctatgtaaatagttgttatacagtattttttatttgtaccattttttgttgtattttttttttcctgaatactttttatcgcagttggttgaatccgtggatgagggctgactataagcctctgtaagtgttagctattgttaattattgtcttcctctctctaaggggttccccagccctggatctggcctgctccgccttgcgaaggccccacagcttgcttacctcagcaattcacagcggaagtgtgacaaacgttcataggcaaatgtcaggtcagatgtcaacttgttgctccacagcctttcggcaacagcccctgctctgggcctggaggaaaaggggcatgtgccagattgggccctgtattccctgcaaaggtgctggacatccacaggctgctacctcttgtctaggcaccctggactcactcaggccaaaggaagtgatcaataccttgttatgagccacagccaggttggatggctcccagagagttctacggctcagctccaccttcattaaaatgtgggtagcaatcccactctcttcctctctcaaagatatgggaataagaataaaccttaaagccatcattaaccacaatgacagtggcagcagcagaggtccttaaaatgtaaactttgcacacccaaccatacttggtaaggctgcagtgaaaacagcagagggaagccttattacaggaatcatggatgcttgtgctgggtcttgagcaactcacctatgttctccaggcctcattatctctctgggaagtaaggttaacaatccctatcccacataccaaagggcagctggagggatatagacggaagtcatgtggagagtgaatattgcacacaaatcttcagaaggctcgttgcacggcctgctctctctcaggcctgaaagaagggtactagtccagaggtggctagatgggattgggtctctaagggagaactcctgctctcaggcccaaccctccacctcccccccgaaaacccttaccagagcctggggaccaggtttgtgttgtccacatattctccccacatacaagcctctccaccaatcaccagagccttctgctcaggggtacctgagggaaaacaagcaacaacagtctggtgatggtggggtaactccagggtccctctcaaccaccttcccaatgtggccctcaccccagctaagttgtttcatttactaactggaaatgtctggcccagaccttcctgcctcccatcctgtgccccaacccagcctcctttggttagcaaggagagctctctgctttcaccttcaaatgccaggggttccactatgtagaaatccttccagtcagggccataggatatacggttcaggtaccagggggcagagagaagggcccggaagccggccttggtgaccagttccagctccttcatatagttcactggaatatcctctcgccacacctgtatgattgtgtctggctgaatctgttataaaaggtcaaatggcagtaaggacacaaagctgaggagattcctgggccttattcatacacaggcaacatgggacaacaggtatgtgctccctctgttccccagcagcaaagtatgtctctgtgactcctgaccattgagctcacacctcaggacagaggccaaggaatccagggccctaagaggcctccctgcagctctcctccccgtccctctgcagcctccctgtccacacagagctagtaataccagctgtgagctgagggaggcaagcagtgggacccaggagctgccatgtccaaaagtctccagatgtttctggggacgggacaaggttcctgaagagtccttgcatgtgacaggagactgggatcttactgatcaacaataaaggagaaggtaaccttggtcccacagacccagaagaccctcatctatgatttaggaagaaaaatccagcctatccaagtaacctaacagcagaaatagttcttaattaagtttgtagtgagggaagatagaaactctgacacataaacccagggctcataccacagcggcctttggtttttttgaggcagggtctcactctgttgcccagggttgagtgcagaggcacatcttggctcacagcaacctctgcctcctgggctcaagcagtaccccaacctcagcctcctgatttttgtattttttgtagagatgagggttttgctatgttggccaggctggtcttgaactcctaggctcaagcaatccccctgccttggcctaccaaagtgcttggattacaggcgtgagccactgcacccagcactctgtggcctttctagagagaaaaggagagtgctccgaccattaaagcccaatccaaaccaggaggatcagtctctgtagaggcagggaggagctggggagaccagagggaggcactgctggtggcttcttctcttctctgccccggctcacctttactttattatcaaacacctcctgccacaccacatagcccttgccataagaagagacgatgtccagcagcctggagaggagaggagtgtctagtaagtgtctgcttagctcagatgggttctagactgtttgtgccagtgctctaggggttgagcctggccaggggcctattcctcattaagcagtgtctttcccctgggctgaaaaccaaccactccaaatctgaaaggatgggacaaaggacaagggaaccctgcagggaccagacagtggccaagcagggcctgactcggtatggaaagggaggaccccacaggaggacccccaagggaccccacccaccctccttccttcctcacgtctggatgtagaaggactccagctgcttgaagtcctcaccgaagcctttcttcctcataaagtcctggatctctgggttggacttcctgaatcccaagagaaaatgaagattaatctttcaacatcctgaaagcctaatgcctggggattagtcacctggccccctataacttcctcttttcacctgaaaaatcaaataagcaaggatctcagaagccctacatgtggaaagtgtggccaagcaaagttatgtgaagcaggtgggctgttgacacaggctgagaaaggctgagtctggacctgaagagttttaagttcaaactcccaaagagaaaacatattaatcctctctggactgcaacatgagaatccaaggtcttaacttgaagctccagcacactggatttcggctttcctatctgctcttccagttggatgacaagccttgctgtctaacacctgctgcagatcccttgcgttatgacgtccacattttgctcacattgttctccttctggaatattttcccctgctcacatctccaaaaagccaaattgatttccccagattcagctctagcgccctcttctcaaagaagcccctcagcctcttttgagcttactagaaccaagggtttggactttacaactgaatactaattagacattgtcacctattagtcttgaattctgtgtcttgactcttcaactagacaattttaagccttcataaacagggattatttttctctatcccgaacttttccaagacaattctgtgcccagggctgttttttctatcaatacctcaaggatatgagagtaggaaggaagaggttcacagtgaaagccttgccaaaatcaggtaggatctctacgtagatgggcagaggaaggcctaagacctgagcaatgtgagcccatacagacccctgagagcagcagctgagctaagcagcccctcgggtgctaacttctattctgagtaagcaactgatcaggccacagtgggaagatcaaagggctcataccagcaggtgaaatcaacctcatctcctccaagatgaagataaaaatctgggaagacagagctgacttctaagaagaatgtgctcatgaactcataggtattattgagactgggattcactggtccaaaggtgccagagggctcagacccagagtagcaaggagtcagtaatccagggatacctaagccaagagaaaaccccatatgagtgtcacaaatacataaacccccacgcacagtcctacacgtaaggacacgagtcacacaaagcaagacaagtgtattcataaacatcacacacatttaggtaggcacacttaggcactcacagacactggtagtcaccaccatttagtcacagtaaaaagatacaaatatatccacaatcataggcagaggctaagttccagccagacaactgtcagtgcgcacactcttgcctggacacactgcttctagcaggtgctacccttgctcccaaggctgctctcctcacaggccttgaggcagagagagagcctaatccagccaaactggcaaaatctttcttctctatctcctcctgtaggtggggtcaaccatcacccagaatctttttacatttgctaagggatatctcccttggcccagagactacttcctgacgctgaggtcacaagatatcttcagggtttttttttggttgttgttgtttgtttgtttttgagacagagtcttgctctgtcgcccaggctggagtacagtggcatgatcttggctcactgcaacctctgcctcctgggttcaagcgattctcctgcctcagcctcccgagtagctgggattacaggcgcctgccaccacgcctggctaatttttgtatttttagtagagatggagtttcaccatgttggccaggctggtcttgaactcctgacctcaggtgatccacccgccttggcctccaaaagtggtgggattacagacatgagccaccacgcccggccaatatcttcagttttctatcaggccagtagcccttttcaactgtcatttaacctgtgttgggggctcacactggagggctgagggtatacagaagaaagggagcaggggtactgactgactctgacctctgcaggctgcccttgggcttctttctttcagattctaccctggtggtcagattcctcagcatccactctaggcacaactacctgcaacggcatctgagaaaaatgtgcccttacatagtctaacagtacatattttaatagtaagaagcagcctccattgtccaaagtgagttcttcctatctaaattcccaggtggaagaagtcgatggaaaacattcttctaaggaccaaggctgggatatgccacttccatgagccagtgccctgaagcttcactctgagcataacaagcagagtccctctggtcccagacatcattcttacctggtccccaggacaaagtgtggccaggagtgtcaaactctgcaagcacacggataccccggagccgtgcgtattcaatgacctccttcacatcctgtgctgtgtagatgtgggtgacagggttgtaggacccctgaaaggcacaagacacccttcaggttcacacttcctgaaagctagcagagtagaagatactcaaaatgcccacaagactccccagatatcagaaaacctgcccatagccctttggtgtcagggactatcttcaaaaaacttgatcataatttcccagaagttatcacatctgttttatctgagtatcataatgccagtgagataatcatggtaggtattaatactatgtccatttaacagaatataaatacataaaaagggaataaggccagaagagattctctcctgaaggtcacaaggcaaattatcggcaaagttttggacttgaactcaagtctcctgactccaaatccagtgtccttcccctatattggtctaaaactggctggttaggatgagagaccctgttcttgccagcagggccacagccagattcagacattgacccataaacttggtctgagtgaaacgggaacatacctttctcatgagctctggaaaagtgaagctctcatatgggaaggaaggatcatctaccagatgccagtggaacacgttcaatttattgtacgccatgacatcctgtaggttaaagtgcacactgtgaacccatcacagtctctccggtttcagcctcaaacttgcgatgttgggcgagctctcaggccgctccacacacccctacaggcttgacctgcctcagctctcaattaagtatttatggggtctatcaaaccttcccatcagggagggatggcatggagggaaggcccagcacacttctacttttcccagaacacatccaaagatggatgatagaagtggtctttcctcttcttgaaataaattctggccacattaagaggagggctgcagctactgtggtagcctggaatcttccaaaagcctgaagatcaatacttcctcttgccatttgtgttcggttgtctgactgatgttaagcccaactgtgagacctcctgggaacttagtagcctcttaactcataatctcagaagcaaaggctggcagatgtgtggcctcctttggttccgtcacaggagcaaaggaaaaggcagacacaggaactggattgggaactgtcagataagactgcacattaaactcaagagagttaggaacttccccaggaaaggctttttttttttttttttttttttttgagacagagtcttgctgtgtcacccaggctggagtgcagtggcacaatctcagctcactgcaacctccacctcccaggttcaagtgcttctcatgcctcagcctccttccttccttcacttatttatttatttatttatttttgagacagggtctctgttgtccaggctggagtgcagtggtgcaatcacagttcatgcatccttgatctccccaggctcaggtgattctcccatcacagactcctgagtagctgggactacaggtttgcgccatcgcgcctggctaattttttgtattttcagtagagatggggtttcaccgtcttggccaggttagtctcaaactcctgagctcgggcaatccacccgccttggcctcccagagtgctaggattacaggtgtgagccactgcacctggccccaagttaaggctttgaacgtctctctcctatgaccttgttctaactaaagttagctctgccggccaggtgtagtgactcatgcctgtaattctaccactctggcaggccaaggtgggcagattgcttgagcccaggagttcaagaccagcctgggtaacatgacgaaaccccagctctacaaaaaatacaaaaaaaaaaaaaaaaaattgagacgctgtctcaaaaacaaatatagttagctctgccaatgaagccaattcccctaaacatttgtatccctggaaacagcctgaacattgatctacagtagcctgtaaggtagatttaagtcactctgttattttttgagtcttggagcagctcatcttctacatttttcccaggagctcatagaattacatacaatttttttttttttttttgagacagcgtctcactctttcacccaggctggagtgcagtggcgtgatctccacccactgcaacctctgcctcctgggttcatgcgattctcctgcctcagcctcccaggtagctgggattacaagcatgcaccaccatgcccagctaatttttgtatttttagtagagacagagtttcaccatgttggccaggctggccttgaacttctgacttcaggtgatccgcccacctcggcctcccaaagtgttgggattacaggcatgagccaccacacccagtccatacattccctctctaactctttaagaatttggaacttggtctgtccgttgctccatcaccctagaactcttaagtgtgaagaaggccttaaggcctggttaccagagtgtccaggatgctagagagtggcaggtaatggcgagatgtatccaacagcaagccccggtgaggaaagcggggaaagtcctcaatctcagtcttgttgataaagaactgtgcagaacaaacattgaacatgtcagtttcaaaggaagcttactatgggggcacagggagatgaagacaactctcccaggattcttaaaaagccaatctgtgactgttctcagggtcgctctctccctaaatgctccccacctctataaatgaccataagcagccaccttcccagagagcaattgtccaacgccagcctaatacaactgtcccaaacaccactcagcctacaaattctggattttcctgttaacatagtttattttcttcaaagcagtgtggcctcaaggtcattactaaatgatgactcagggggaccaaattacagtgattccaaacagaccaaatctaccaaaccagttttccactcacatctcctcttccatttctactggggctatctcaagccaccaggatcctaaggcaaaacaagatttttctaggattctcaatattgggatccaaccccagagatgaaaaaggagccctttttgagggtccacacttactgtgccctcagcagatttccaaacaagctggctaaaagtctccagacctaggaagatgtagagaggcagagtaaagactcagggagtggaaaaagagatgtctctatttggaaggttctcaatgtagcagagcataacatttgggtacacagggaaaatggatgtagtgtaggcttgacgatttttaacactgatgaaaaggggatattaggaagccactatccatctttacttctgtatttcattttgggagatgtcagagtaagggttttagtgcccttccttacaacatactaaccttcaaaacccacatacctcttatctatatttcctgtgccttcacaagaatattgagaagagaggccaagacatatactcatgaggacagacacagagacaactcagcctgcaagagttggacttttcatggataacccctatcaggagctaagagagctgagaaaaggggtcccagaataaattgtgagaaagtgatcataagcttgggtttccaaggagcctgggttcatggctggacctagaagataaaaaaaatcatccactcttcctcttcagagtctaagaagagacccagctatagggagctgaggtgtggtggacagcaactgccccagaaggactcccctagtccactgacactgtctcctagagtctagcaaggcccacacacaggtatgttgaacccagagtattgtatgttctcaacagctggggcccctcttctggaaaccctgcagaagccccatgaaaattatcagagtccccagtttcaaagtgaaagaatccatgagacctcagcagtcactcagcacctgatttgagcagactgctagtgtactgttttggcttctccccactctgactctgacacccagcattctggagttccaggtcctcccttacctctagcctgactcaccatcagcacctgcatgaaaggtacaagagggcaggaaggggaggcagcatgctgttgctccaagcatagaagtggagcaagggaatgaagacaaactaaagcaaggtgtggaattccgagagagtttcccacatcattcaccagcagagggtttaccaaaagtgggagagatatttggctaagtctgtatctaggcaccaaatgccttctcagtaaacccagaagaagggcaagggccaatagtttagccagtaaactcattttctccagaaataatgtagttctaaatatttcactactatttatctttttttttgcatgtatctatttcttttgttatagttttccttttaaaaaaacctttccaattacatgtctttagcaagagctggacagacagtgtctgtggtagcatcattccccctgcccccagctacctgtcccctgctggcacctagaacatcagcccacagactctcctactgcttcccagagcccctgactagggcagcagcagttgctgatgctgcacagggtaaaacctgtcaacttccagggacaattccacagagacgggaaaacacgccaattgttcccataaaaaaagcttcctggctgggcgcggtggcacacacctgtaatcccagaactttgggaggccgagatgggtggatcacttgaactcaggagttcaagactggcctgggcaatatggtgaaatcccatctctactaaaaatacaagaattagctgggcatggtggcaggcacctgtaatcccagctacttgggaggctaaagagggaagattgcttgagcctaggaggcagaggttgcagtgagcagggactgggccactgcactccaccaacaccaaccttcccacatcatcctttctctctctcttttaatcagccccaatttgttacctcggagagctccccagacagtctcagagaggagtaaacactggtcatcatttatggtcagggtatctgaaatgacagaaatgaactcatttagttggttaaggttttctattctcagattatagaccagatattctatataaatcactggactaaaaaaaaaaaacagtaagaccatatattttaaaaaatctttcaatgaggagatgtccccagagcaagacagctgtaggatggcctggtctggggccagagtgggagggtggtcaccacagtgactctgtagaccctggatgatgatgtacagcaagagtcaggctggagtggaggtctgtacaaagcaccacctacctcatgggtcagtttccacagcagaaagatgaaagaagtcttctcctggcaaagggaacagggatgcctgcaggggtgagtgcagcacgcgatgctcccaatgcctttgtaatcaccctcctttccccttcctctatgcttcagctacttcctccaagaatgtgaggaaggagccaaactcaactgttcactttggagactgagaagtccccaaatgctgctcagggaagacaggaggcagtcactggactaatgacttaacttcatctcagtataagtgaccagaacccctgctttccccagtgtagggtctattagagaaaagtagcaaagtatacactttcctaaaatagaaatgtattcagtacaccaggtagaagtcctgtgggactcagtgaagagccagtgtgatgttccacagccaacctttagcactggttaagtttctgcataggaaaaactcatcttccatggctctcagcacttggtgaccctcggtccccagggtcaagggggactccaggccgagcatcagcagtttaggccaggccatccagagttacagcttcagacaagtgtttgctcttctaagacagggaacaggatggtacttacaattctccactgactccaaagtaggaagctggttacatccaggtgtgactacagagacaaccaacacattcttctccagtgtatgccgtttccctaggaagacagggtaagcttggtgcggccaacctgccattagaagcaacaggcaaaaccaagaccctagctctagtccctcagctcacacgcctgtggtaaaggaaagggaggacatggcatttacccttggcataggcagtgcctgatcatctgttcagctgtctcactctcgttgtgcccctcttctcctcagtagctgccctgacccatgtctgaatgctctgggtgacagctcttcttaaccagggctctatatttctgactgcccttggcctgtaccaaacaaacaactccatgacctcaacaactgcttctgaatgaaaggcagctctagagcactgctactccaagtatggtctgcagattagctgccaatttgcaaactgtgttactggctggtcactatatagaaaacttatatgaagcctgaatgtaaatcaattatgtcagagtaaacacactgtctagttctaacattttttcatacaagattttcttgatgaagagatcagtcttacattctggtacatatgcttcttatctcattgaagattggcatattaagtagtactgctcttgagggctccagatgaagggtttccagttttgcaaaagcctaggagctaatggagcagatgacagaaggatcaggcagaggaggcctgagatgatgcaactgatacctcagagaagatcagggtcacccacccatcttgcttccttccttcctcttcccaaacaggttctctatccaaggtagattttaccctaatagtggagggttgaaccaacatagtatctaatatagctttacagacccttgtctatgcagaaaaaatgccaaagccaaaatatgaatacactgtctcttctcaccctcctgctggttcttccctgtgattttcagggtggctctggtgttatagccccaagccttaacttaatgaacccctctctattctattctttcctggagccatattcatcccactggcatcacaacatccatgacttcttatggcactacaatgtcagggataggatggcctggcagaaggcaatgagagaattcagaaccaaactggaatctcaaatgttacccatctccaggcagaaggaatccaagcgctcagatcatctcacggaagcctgctcagacctcttgagcactaccacatggctgtatctcagctctttggtctgccaagaagcaagccaataagggggcctttcctaccatcatgaacaacacattctttcccttaccagtaaataccctggatccccacaccaatacctgcctacattctgcaaagaggagggaatctgaggcaactctgggccaggtcaattcacagctccatacttgaaccctaaaactacattgttacaacacaaaaggacaagcagaccttcaaggcaaagaccacactcaaggcagaatctgcagggccatccaagcagacaggctacaaacccatctccacaggagactctacagggagaccaatgaggacttaacctaggagcaagggtgaggaaaaactataccccatcctctgacttcttgcccccactcccaaccccacacatcatggagccccaatatcattgtgtggagaattcatctgcatatctacccaggcagccatccaaaagacagccgaagtcctgagctttagttctaatcctctggggctcagcctgccacataaggagaaatcacaactaatccatatgcaactaccatggctcgctgccctcatgacaaaataagagaggccacacaaacaccaggtttatctgaactattacttggaagacagaaaaatacctaatctttcgatttttaaaaaatttatttttctaaaagacacctgcactgtactccctaaatctgtagtcttttggagagtcacagactcctttgcagatctgctgaataggaaaacactttttttcccagaacaatgcccctaatttaagggctgtttctccagaattacaattcttccactccctgccatcaatctcatggtgaagaatccctgtccgaagttctctcagtgactcatctgggtttgggctgaaagaagtagatacgggggcatggctgctgtttaaacaaattatgagagggatgtttgggggaggcagcaacatgagagctggcaaaacaggagggacactaggtcattgtaaaggatgtaaatagggtatcaccactgtggttttccgcctccaagttgctactttgcctggctatgaagagggcaggaaataggcaggggacagtagtacagccgcctctacacacacccgcccacaccctgaacactgagaagcaccaacgtgtgggaagcacagtatggcaaacagcccggtcagccagcaatgtcatgagcacatgtgccatgagtctggctggaacagcaggaaattgagaagcctccagggcttaggaggtagcatgaaaaacagaccagagggctgggaaatcaggacaggttgcttctggttctggttttgctgctgccaagctgagcaagtctcagggctcccatttccttccctgtaaacaatggcagggtgggaccagattccagctactcctcttcagatctaagaccttgtgattccatagacagataatacactccagggtcccattccaggaccacagcctgctacctctgcagctcactcatctccctgctttcatgtaaacctactcttctctttgggttcactgaaaactttgtatctttttttaaaatcaaaacagttgtataggcctggtgcggtggctcaggtccatgatctcagcactttgggaggctgaggcaggcggatcacttaaggtcgggagttagtgaccagcctggccaacacggtgagaccctgtctctactaaaaatacaaacaaattagctggtcatggtggtgggccctgtaatcccagctactcaggaggctgaggcaggagaatcacttgaacccaagagacggaggctacagtgagcagagactgcaccactgcaccccagcctgggcaatagagtgaaactgtctcaaaaaaaaaaaaaaaaaaaaaaaaaagagtagtacatactggttaaaaaaaaaatcaaacagtactaccaaacagtagaaaatatttacgattaaaaaaaaaaagtatctttggtacccttccttagtcccctcagtaaagagacaaacatcactggtagttttctacccctgtagtaccttatagagtaattttgccttattcatcacagacaggtcacctctggacatggaattctaataacaaggacgctctatcaccaaagtcctactgttgaaccttctccagactccagtactatgacccctccatttcccttctgttctcagtcttctctcattcttgcttccttccctgctggcctacatgtagtgattcatcacctcaaacgcaatctagccaatactcccaacgatctgtctcttttcttctgtcacaaccaatgggcaaaactttcaaccctggatcaatctaacatctgcctgctgtgcccctgaccccggctactgtaccctactggagggaagggagaaaaatcacaaaacagcaggactggaccactgcaaaataatggtctccatcttggctgggcccttgatgctaccctgaaaatcttctatctccatcattgcttcattctattctctacaccttcctcaagtctacttgatcaccacctcccttatgctcagcagacaatcagaagagaactttcaactatccctaccctcttcccctctcctcgctgacaaaaatatctgcaacacacacctgcctgtaccctctcctggacctccaccttgatggaaggggcttccttttacctgtgctctggagctcttctcagtctcctcttgtataaattatttccccttttcccaaagccttcaaattatttctttcaactctcatcagcattaaaatgtttgcaatcttcctggcctcacttactctttcttttgccttcctgccacaaagactccctagaggaaatgtagcctgggcagctaaggacctgaactccaaaggaagacagatctggattcaaatcttggttctaacactttctagctgcaggccttctctaggcaagttatttaccctctctaagctgcagtttcctcaactgtaaaatagggatcataatacctatataattgggctgctgggaaggttaaatgagttaatacatgtaaagtgcttagctcagtgcctggtacctcctatgtgctcatgatgttggtcatacttagtattttgtagctgcttccttacaacctatctattcctcaatccactataatctggcttccttcaccaccacttctctcaaaatggcttcaccaaagtcctgtggttctgtaaccaaattcaagggactcttttcaattcattcattcattcaacagtaatttactgaatgcttactatgtgccagggtgttgtaagtgctggggatacagcagtggtcaaaacagacaaaaatcccagctgtcagagagctaatagaaaccactcactccttctgggacctcttgacagcatcagacatctctgaccttcttgaaactaaactcccttagcttaggggacattgctctcttggttttccttctaactccttgaatatgcttcttcattcaacttctcctttaccaatcccaatgtactaatgttacccagggtatccaaggttccaaacttctctttttcccttcgcttacactctccctagacaatgtcatccactcccacagcaggccaatgactcccaaatctatctttccaagccaactcttcttctggagctctagacttgtacacctccactcaaatgtctcaaaagccacttgaatcttaaacataaaactaatctaactcttcattcctcctcctggctgatcctctctctcactttgataacagccccatctattcacctataccagaaatctccttcttctacaccttccatctaactgagtagatcacaagttcatcaactcaaaataacatttacagactgtctgatatctcaaacattgtgttaagcactgagattacaacagtaaaaatactttttaaaagtcttacaattacacaatccttataatctcttaacacatcgccattttcccagccccactgggccaaagccttaattcagcctcttgtaatttctcacctggatgactataaaaaatctcccaggcagtcttcccctgcctccaggaatacccatgtcaatctactatcctcagagatattagaatatgaagataagagcatgacagtctccgcttaaaatcttccaatggctcccatagctttcagaatacagtccagaattcactgggtaatcataagaaaatgccttgtctttttctgctcctgtgcaggaactctcacaatgaacaatgaactcttaacagaaccctgaaaatgccatattttctccatatttttctttgcacatattgcttcctccaattgaaacaaactttgccttcccgccacatctcccctaattaagaaacagctctattttccttttaggaaacttttctgttattccccccctctttcctaagaaaccctcctatgtgatcatgcagcaatgtatacatacatttttcaaaacacttttcttaagatatgctgtttatttgtctatctcctcacctaggttgtgagttcctcaacaggagggaccaatctcagtgtctttgtattcccagtgcctgacacacagcagtcattcagtacatgtttgctgaaaaaatgaatgatgttggaattcaaaaaatgcatattttatgattgtgctatgtgataatcaggcataaatagcaagtagttaatgtagagattacttttatatccccaaacctagtatttctgaaatcctgagactggggtgggcgatgctaagaagacgcccagacttacacaaagtgccttttcagacactgctctgaagacctctggatccataaattctaagatttaggtctttccacttctctgagaggaagaactcgttgctgtattagggtcactaataactattagggtaacctggaaactatcaatctttacctcagtgcacaatagcctttccctctaccacccgttccctcctgaatcaaaacacttccatcgtatcaatgtgtttgattcacagaatcccagcactatggaaaaaaaacacattggtttcggttataaagtggtagctgattttgcttctggattgaaaactaagaaaggcaacccagactttgccaccttcccactctttaatgtctactctgctcccatatcccctggtaccctcctaggctggtgccaaagtttgttcccatgcccactttcttctcttccccctcccacctttatacacatcatatccaggtttcatctcccccatattctgcctaataaaagcccattatatcattcatttcccactcatttcttcattccaaccaagatatattgtgcatttaatgtgcatcaggaactgtgctaggtgctggggcagttaaaaagaaaaacaaaccctggtccctgcccttgaggagatcacagtctagcaggagagatgaacacaaacaataattacaaacattgtgataagggctatggtagatttaatagccacgtccaggaaaggtggaaggcttgacgttgaaggggacctctgagtgggatcttgaaccctgaattggtgttcaccaagctaccaagaggagaaaaggtattccaagcctgggaagtgaattggtgtagctaggagagaagtcaaggccaaccttgtcaaacttcttatcccagtaaagtgggagtctgtgaagccgactgccctgagctggggccttctccttagtgctgctgaatttagtctagatcatggtacctcctcctgtaagttccaagattcttcaccctccacagactattaatacctacttggaagtatcactctctccagcccacagatgaatcctgaatgttcttccttcctctcattcccatcccatattttttgggtaaaagttgtacccatctttttttgggaaaagctgtagttaaaaattttctattttcccctacttttaaaactgatctgtccctcccaaccctatccccactggaaagagaacatctccctaaaattctagatctcaagggataactttagttataacattttgcacaattttccaatttttttgtaaatacataaatttattaatttttaaaataaaaatgggcccaggctaggtggctcatacctgcaaccccagcactttgggaggctgaggcaggtggatcacttgagttcaagagttcgagcccagcgaacgacttcaaggttcgccagtcaacatggcgaaaccttgtctctactaaaaatacaaaaattagctgggcgtggtagcaggcgcctgtaaacccagctacttgggaggctgcggcaggagaatcacttgaacctgggaggtggcagctgcagtgagccaagcgaccacgccactgcactctagccttggtgacagagcgagactgtctcaaaaaaaccccaaaacaaaaaacaaaaacagaaaaaaaaaatgggatcctaatactattagtttgtaacatttttccccttaccaaaatgagctgtagatctgttaatgtcaatatatatagatttacatccttcttgtaaatgttgaatataattccaatgatgagatatacattaacttacctaacttctcttctgtttgtagacattcggtaatgtttataagtttttagtattataaacaacactctagtaaacaaatattcatatatatgtatataagcaattgtgaaagatatctgtaggataaattcttggaggtggaaatgctaggccacaggtaagaaaagttttggttttgatactgccaaattcctcttccaagttactgtactgacttacacccaaatccacatatatgggcccatctctccacatctttccaacactagaacatctcaattctttttcaccattgccagctggatttaaaaaaacacatacattgtttcaatttcaatttgtatttctttttaagttttaatttaattttttttttttttttttttagagacagggtcttgctctgtcacccaggctggagtgcagtggcacaatcatagctcactgcagcctcaacctcctaggctcaagtgatcctcctgcctcagcctcccaaacagctaagactacaagcgtgcaccagcatgtcaggctaatttttatttttattttttgtagagacagggtctcactatgctgcccaggctggtcttgaactcttggcctcaagcatttctttgcatttactagccaaattttttttactcttttttttgagacggagtctcgctctgtcgcccaggctggagtgcaatggcgcgatctcggctcaccgcaagctccgcctcccaggttcatgccattctcctgcctcagcctcctgagtagctgggaccacaggcgcacgccaccgtgcccggctaattttttattattattattatttttagtagagacgatgtttcaccatgttagccaggatggtctagatctcctgacctcatgatccacccgccttggcctcccaaagtgctgggactacaggcgtgagccacggcacccagccattctttttactttttaaagttacttttcttttattgacttgttgcaaatatctgcctcattttatcccttattttttaaccttatgctttcttttgctttaatttttatgtagtcaaagctatgactcttttcctttacggtctctttatttgcttacttagaaaggcctcctctacccctaaaattataataatagtttccttcatttctgtctaacacttcaatggtcttttatcttcagatctttaatctccctggaatttacttttgagtttgatatgaggtaaggatttatttttttcccaattggataaccagtcatccttaggtatttattgactaatacatcttttcacatttgatcagaaatacttctttgatcatatattaaattcccacatatatacacatgcttgcttgtctctggaatctattttcttggtaatcttattgtcagggaaatccgccatgtcatatctctaccatattttgtcactttgcccaatatataaccccctttgctcacttctggtcctgcacttctatttttatacatgttgcttcctcttctccaccagaccacctgtgtactacatatcattcaccttgtaaaccctctgagatcttgttgtgtagttacttaattactcagcctcttctacttcctccctaactgaagcctggctctccccaggaataccacacaccacttcccctacaacatgctctgagaggcagccacttcccacatcatagggttgagatatggggctgcttctgggtcatccattccaccaccaccaagtaataaaacacctttcttctgtggttcatgtcatccagctgttaaatcttcagctctccttgttacaacactctgtagcttcctgatcacttctttattcacttaatttttttttttttttgagatggagtcctcctctgttgcccaggctggggtgcagtggcgcgatctcagctcactgcaatctccgcctcccaggctcaagtgatcctcctacctcagcctcctaagtagctgggattacaggtgtgcaccaccacacctggctaatttttctatttttacaaattagacggggtttcaccacattagccaagctggtctcgaactcctgacctcaagtgatcccacagcctcagcctcccaaagtgctgggattacaggtgtgagccaccatgcccaaccttatttacttaatactttggatcctgttgcccagtattcctctccacctcaaggctggctattatcctagatgattttcacacccaagaggaagaactaacccatgttctggcttagcagtcatccaacaacatcctcctcctcctcctcaaccaccctcctgtggttgccttttggaccttcttctcctcggaagtgttcaaactcattctcccaagctctagtactacatagctaactgtttgcttgatacctcatagtcaacacgtcaaaatcaaatttacttttcatgattctcactctacctctcaacctcttaatttcactgttttttttttgttttgttttttgagatggagtttcactcctgttgcccaggctggagtgcagtggcgcactctcggctcactgcaacctccacctcctggattcaagcgattctgctgcctcagcctccagagtagctgggattacaggaatgcaccactatgcccagctaattttgtattttcagtagagatggggtttctccatgttggtcagactggtctcgaactctcgacctcaggtaatccacctgcctcagcctcccaaagtgctgggattacaggtgtgagccaccacgaccaccaatttagctctttttactccttcccttcctctcctactattttccctatctttgttaatggcagcacgagtgaatgagagccaacattcaaactgctaagtcagaaatctgggagtcatcctcagcaccctttccctccaacctaactcccacttccaagcagccacctcctaaatctctcttcagtctttctagttttctctgtccttacagccatcaacccaacttcagccactactctctcttatctagaccactgttggcagccttttaactgggtttcctgcctctaatcccactctacagcaagccccaatgtagctagagtttagtcacatcacttatcctgttgactggactttactggccttctttgaccttaggataaagctccattccttaccagggcttattaggccatttcatgacctttccatctatcacctctttagcttcagaacttgctgatccaccctagagttgtgtacttcagctagacaccttgagttccttgaatatggcatgaaggcttctcgcctgtaggccttttccacgcgcagttctttctatgcggaatactatcttcacccccactaacttctacttttagatctccttcaacagctctctaggaaagccttttcaatgtgcactttctccttttccccccatacacttaggtcaggtgttcctcttctgcactcccaaagtaccttgtgcttcagttatcatagaaaaatatcacactctgtctgtatccccacttccagaaactgtaaattctttaaggacggggaagttcaatttaatattccttggacctagtactattgacaattaaagttacttaataaatactacctgtactaagaatagatgggaggaaggaagaaatgctactggaatctggtaacaatgggccagggatcaaaatattcataacctgagtgcttatgagtaactagatgttagaagttactacctatttgaagtaattaacactaagatgtgattagagcttaatcctgccagaggccagtagttttccaaattgctaactggactgacaaagacgtgtatgagtatattacaagactgtacagtgacaaaagcaaaatttatgcatgactggaatttctgctccatccctacaagctgtgtaaccctgggcatgttacttagcctctatgtctccattctcaaagattgggataacactgacctcacagagctgtttatgaagattaaagggcaataacatacatcaagtgccagacaataaatgctagtttccttccgtgttctacttcccttttcccaataagacagttttgccccagcaaacctcgactctctcatttggccagaggagtcctggggcagggtctcctatggcaaagccacactctaggagcagcttccctgaagggtttttcatgagcctcttataggagactgaaggcttcactactgtgagatgccattctgtatatgaacaggctgacacttcaaaatacaagagggacatggccttagaactctgaatctcccccaacctaggactgcagctccaggcaaaacaacaaagccactaatgtggaatcctagttacaacaaggacaaggttgaacaaacagtaagtagttaaacttttcatgcataacagtgtacctagtaaggcatctctcttaccccctcaatcccaagagctttacaaaagaaggggaaggctgcttaatgacagctgacaaacacccatacgtcctgtatttttgagtatacgcttccacagaaaggagctctacaccacacccaagcctaaccagcctcaagatgtggacacaacaatagcatacagcagttggctggggatcagggctgagtgtgtggccaggaagcttaagcaaatgccacagcttgaaacaggaacaaaggacaagaagagagaagactcaagttcctgacccaataatgggttttattcattacagccaggaatacagaagaaaatataatccatttctgtattacaatggactgtaaacatgtaaaccttgagacagctcacaccacagaaaactcttcacacatacacctctctgacccctacagacccaacctcctttcttcagctgactttgttgtcagtggctccaaaaaggtcatggaacctcttgaggatgatgcaaattgactctattttatcacttattttcaggaccagtagaagaaatttaggaaactgcagaaacataagagtgatccctttcttttgtttttgtttctaggtttttgtttgtttgtttgtttgtttgagacaaggtctggctctgttgtccaggctggagtgcaatgacacgatctcagctaactgcaacctccacctcctgagctcaagccatcctcccacctcagcctctggagtagctgggactataggcatgagacaccatgcccagctttatttcttaaaagaagtactggtaaggctgtaaaactcctttccctctatataacaacaggaaagggattgaggcttatgccttgaacaggctaagaaacagacaacatgccctagcatgagacggttaaaaacaaacaacaacaaaacgacaaggtatccattgtcaaaaaccttccaatgctatgcttctcgctcctgtttggaggtaaggaactggggtagaaggaaatggaaggaaaggcatctctggggcttggacttttaatttttattgttttatttttaaaatcaccaagttcttcccactattataccctcccttaaagactgaaaaaacattcataactattttcttgttatcctcggaaatgtctggaaggcaggcagagttaaaaaaaaaaaaaaaaaaaaggaagtagcagcaacagcttggaaattaggcaattagtctgaaggcacagagttaaggggttaataaacactttctcagctgactcctgaatgaatcatgttccacatcctgagtcctccaatgtatactgtgttcaaacagaatatccaaagcaggggaacacctacagctcacagaaataaaactcaaatttttcataaaccaggcccaggctacccacatacaccttgatcaagtttagcttcttggactcagtactatacagggatactagaaaagtatcatgctttaggtaataaatggtggctcacacctgtaatctcagcactcggggaggccgagacaagaggatcgcttgaagccaggggttcaagaccagcctgggcaacacagtaagacccccatctctacaaaatgcaaaaaataaaaaaattagctgggtgcggtggcatgcgtctgtagtcctagctactcatcagtgaggcgggaagactgcttgagtcctggagttcgaggttgctgtaagccgtgatcacaccactgcactccagtctgaatgacagagaaagacctgtttcttaaaaaaaaaaagaaagaaaagaaaagaaaaaaacagggctgtgagaagagaggctggtggaagactgcaggccaagctaatctaggccctgggattcaaaatgaaatatgacacttattttgcccttcaactaaaaactgtgcttctgccatcaccttctttctaaagacaatttattcatcactgtatttctcctatgtatccctcgttctccagaaaccccttcatgagaaaaagtaattctactacaaaaccttcttcccgtgttgttttcttcctctttgcttttaaaacaataaacttagtggcaatcatctttggcaggaatatgccttgtctttgccgtgggaaaggttaaagtatagttagccgctagcccaattaaagtggagagaactaatcggccttattctttctccccagcccagctgcttgaccttatctgtttccctcctagatgcaatcccaatgcatctctcactgcatgctgagttaagagcagcacgagttgggatcacacaataagcagcatagtgtgattatcctttgcctggaatcacacacttacactccaaattggtaacctgaaaggaaaggtaatcctcaatgaaaacctgcaaatcatatctttttgatgatcttctcagacctgtaatcccaacactttgggtggctgaagcaggcagagtggttgagcccaggggttcgagaccagctggggcaacatggtggtactccatctctacaaaaattagctatgcacctgtagtcccagctactcaagaggctgagatgggaggacagcttgagcctcggaggtcgaggctgcagtgggctgtgtttgtgccactgcactccagactgggtgacaaaataagaccctgtctctaaaagaaaaaaaaaaaaaaaaaaaaaagaaaacaaaacccaaacccataaagccttcttacaaatgtttacacaaagtagctctttaacgttaatatattttacaaataattactacatatctacaacgttccagatacagaagaaatggccaaagaaggtattttaggagatccagattataatgaactatgccatttattaatttagtcacttctttaatatctgaggatgagcaaatcaaatactgataatggctgcagaaggacacaggctcttatataataatcttacttccattccagaataaaagggctggagaaggggggcaggattattctgttgaaggacaatggcatcctcagcaactcacagggatgtgcaggtgaacatcagaccaggatgggaaccttataatatctatgatatactatggcttctatcaaccagtttcaggaaaagcaaagaagaatgcagtcatggccaggtgcagtggctcacacctgtaatcttgaggtgggcagatcacatgaggccaggagttcgagaccagtctggccaacgtggtgaaaccccatcgctactaaaccccgtctctactaaaaaataaaaaattagccaggcatggtggtgggtgcctgaattcccagctacttgggaggctgaggcaggataatcacttgaacccaggaggtggaggttgcagtgagtcaaaatcacaccactgcattccagcctgggcaacagagcaagactccatctcaaaaaaaaaaaaaaaatgcagtctaatggcagaattagacttagccactttacttggaaaaatttggactttatcagctccatcaagcaccatgctccacaccatgcttattaaatgtctggagcaacattagatgggtgccattccaaattccaaataatcacatctttgctttgcaaacaggatgtggcttaataatcaaacagggaactagattcattcaagtatctagttcctaaaataagtctatttaacaggttcaacaacatgcaacacacaccctccaattggtagaaacacctctcaatgacaaagaaaggtggcaaatactaaacaccttcacagaccatttagcaactggtgggactaacccttgaaggtgaattcaaaatagaactgaacctcaataccagacttctttttcagaaaagggagtatgaattcttagtttcaggttcagacaaaaaccagaagttgtattgcattaggaaaaacactgggctggtcaggtggctcattccaccctgtaatcccaggactttggtaggccaaagcagggggatcacttgagctcaggaattggagaccagcttgggcaacatggcgaaaccccatctacagaaaatacaaaaattagccaggtgtggtggcatgctcctgtggtcccagctactcaggaggctgaggtgggagaattgcttgagaccgggaggcagaggttgcagtgagccaagattgtgccactgaactccagcctaggtgactaagcaagattctgtctcaaaaaaacaaaaacaaacaaacaaacaaaacctactggcccagagcctacaaataagttgtttggaggaagaggatggaaatctgttagttaagatttaacctgcatatgttgccttctttactaaaatcagactcataaagaaatgtattctggcttcagccttgttggtattgctctacctctatttgtttcccatgctattgcttcatccttgtttctgcagaactaggattttagctcaaagtcacctaaaagcctccacaggaaactacattccaaagggaagactccatgggaagagcaatagagaaagaagttacttttaagtctttggtaatgttcacccaacccagttttcattttctctcaatggacaagaaccctcaactaataaagctaatgaacttacaggaaggtaatatatggaaataaacatcttattgaatttatctggctctaaatctcttttgttagggaatttatagtattccattatcttacaatctctccatttctatctacttgattaaactatggtgctatagcaatggaggtgaaggcctaatttagaagtataggaattaggtatggcgcggtggctcatgcctgtaatctcagcactttgggaggctgaggtgggtggatcacttgaggccaggagtttgagaccagcctggccaacatggtgaaaccccatctctactaaaaatacaaaaattagctgggcgtggtggcaagcacgtgtagtcccacctactcgggaggctgaggcaggagaatcgcttgaacccaggaggcggaggctgcagtgagccaagatcgtatcactgcactcagcctcagtgtaggctgagtgataaagcgagactccgtctcaaaaaaaaaaaaaaaaaggaaaggaattattctcatgtatacaatagtaggaaacaacctataaagcttttgagaatcttataattcactgtgtacctccctctgtttcatattttcgcaattgaactatagagcctaggcctaggtcttaagacttttcttgtaaccttcagagtgcccagcactgggattgacatataccagttagacggatttttttttccataaaccaggctcaaactcttctaaaccaaaatcaacatattctgagtgccaatcttgggtaaggcactctattatttgtcatgaaggattcagaggaaaatgtgatctaccacactcaacagcaggcctcttatcctctccagcttaatgcattttaccagttaaggactaccctgatgctgagattgtgtttctttccccaaatcaaatgtcactctctaagggtcatctgtataattaaatgcttttaattctatatatcaaatgataacttttgtgaaagtaatttaaacacacttgaaacatcatataaaatattactacaagacttaaccgtaaatgtggctcccacccccataacatctatacaatataaccaaagagctagattccagattatcaagaaacttctaaattttgaacccatgcagcagaattgtattcctttacattgttggctcgacttacaaatgtgctgtggaataattatcctcaaatacaattttcagtactgattacatagctgcctaaaagaaaactgttagccccttccattttatgtgaaaccaatgtctaaagcgctcttgactcttcaaccccacattttccccaccctcatccctcctcaatccccagcccccactcatcacatccactagacctgaactttgaactcaatcataattctttgtgcctctgctcaagcccttcttcctgcctggaataccctcttttcagtcccggctaattacatctaccatcccattccaagtggccgctggaaactcacttccttatgttctatgatttctttcacaatttacactttttttgttttgttttgttttgtttgggggggggggttgtttttctgagagggagtcttgctctgttgcccaggctggagtgcagtggcgcgatctcagctcaccacaacctccacctcatgggttcaaccgattctcctgcctcagcatcccgagtagctgggactacaggcgcgcgccgccacgcctggctaattttttgtgtttttggtagagacggggtttcactatgttggccgggctggtctcgaactcctgacctcgtgatccgcccgccaaacattctatgtgccagaaacttgtatgtaactttgcatagttcttgtattatgtctccccaattttgagtgttttctctggtctctactcagcccttgctcacagtctcactaggaccctggctagcttgaacacggtcagaaggatcaccttagatttctgctggcacagtattttccataaattaatctcctgattgaaccgtagtcctatagtagttatctttggatgaaaacctaatgcagctcgaggaggaagtggagtgcctgtgatcagagggctggacaaaagcccatagggcgtctctggagccctgggggaactgtccccaggcaggcactctcagggcccaggaacagggcgggacaagtccgactcacctgtgaggtaaggacggggccaagacccggaaccgaaaagcaggtcacgatagcgctggaaggcctcgtcgaggactgagcagccgggctgcgcggccgagctgacatcgtactggaattgaaagttgttcgggtaaaggacgtagcgctggtcggaggtttggaagttctgaggccagggccagagggccgtcgcccgtcctgcgaacgctgccgccagcagcagcgaaaaccaaagcctggagcttgtcatggcccgctggtctcccctctcggagggggctggccacgtgagaccctggtcaggtgagcggcgcccccgtgacttatcggcgaatcacgtgaccagaggcggctctgcgcctgcgaccccaggaggacccacaccctgccctttcacttccggcctggacctgaggctcctgctacgtgcagcggattgtgccgggcgtcggcaactgctcggctcgccagactgttcacgggcccagtagagcagtaaataaccggccacccctgcggccgtgccggccgtgatggaactagacagctcacccgactcgagaagaacggggtggggaggcgaggacgcagggcgacctggagaagaaagtttcccagatggctctagggtgaatcttgaatgttgtgatgcagctcgccaggcctacggggaggtaaaggacttgccaggctgaagtaacttcagaagcagaaaaacggaggattaaaaccacaagtcgttgtgatgtgaaatttcgtggggcaagaaagggccggaagtaggtagtctgcacggctctgctagagagaggatcacaagatcacacaaatgtgatctacttatgactggaaaaaatgtgtactttcagagccagcttgaggcattccattgcctccaatatgagctcttcccttcaagattgactataaatctcttagttacaactcacatcccctttccccagacaaaaccccacatagcccggtgtgtatttactgaaagcagtaagatattgctggggctttgggtgcaagatggagagtgctcagagataatgacaggggcctggtcctgcagggccttacgtagaaagtcaaggaatttattctctgagcaattgaaaatcatcccgaaagatctgcattttagaaataccatgttgagtagttgcataagaaaccagttaggaggcccctttttattggaggtagagaataatgagagactgaactacagaagtggggaaggaagacagctgtagatccaagaaatagtatccggaagagaggcttgagaagtgatcaaggagaattccacagttatcagagaccctgtcttccttgttcaccactatattaccagaacataatacaaataatgctattgttattgggtggcattatttggttagtaggtactttttaaaatttttaaatttaattttagtattaaaatacatgtaaagatcaggaaaatgaacttttaaaaataaagggctttcactgggcatgataacacatccctgtagtcccagctactcccagctattcaggaggctgaggcggcaggatcacttgaaccaaggagttcaagtttagcctgggcagtatagtgaaaccctttctcaaaaacaaataaagggctactgaaataatgataatttatattcaggtcgtaggtacctaattactagttacacatacatggctttgatgggaaatcaaagaaacattctgacaatacagagattcatcaagcaatttgtctttgaaagttgattattcaaaaacagagcttgtagcaaaagaagcagaaattagatcccacagtcatcaagtttcagatcctaaggcttgcattcttacaccaatttcttctttgcttaaatcttaattttcatcagcattaattaagtgtctgggtactctgccagtcaggagagatgttaccaaaggtacaggatttgagaagtattgtcagaagagccaagttcataatcaggcccacaggatcaataatttgggggagtgtttagagcagtttcaaagatgagagcagtagatcaaagtagaatttcaggactgagcacatgccaaggcacccttttatggatattcaacctgtaccagaagggaggagtcatttacttaaaagagttacacaagatgaaagagctagatccaaataaagacgctataaaaattactaatggggctgagcatggtggattacagggattcagttatttaattattactgaaagagctcttttagacttaaccagatttttaaaccaaatattcttatgcatacataaaagtaagttacacaagataaatttgttgatcttccaaaatatccccccttactatacactagagtggggttttggcataatggcagacaaatagatggaacggaatagagggtccaggaaaagagccatttgattattactccatttcaatgaagacaccaatttaatttagtggggaaggcaagttattttcaataaaaggtgatgaagaaaatagatatccctatgtgggaaaaatgaactatgatcccctacctcacagcatacacaaacttaattaaaaatggatcacaggctggggatggtggctcacacctgcaattccagcactgtggaaggccaagatgggaggatcacttgagcccaggagttcaagatcagcatgggtaatacgaggaaatcccatctctctttatttttttcttttttgagatgggggtggttaatgggtacaaaaaaagtagcctgaataagacatactattcgagagcacaatagggtgactatagtcaataataattgtatattttaaaagagtgtaactggattgtttataactcaaaggataaatgattgagggtatggataaccccattctccatgatgtgcttatttcacattggatgcctatatcaaaacatctcaggtaccccataaatatatacacctactatataccaaaaaaacttaaaattaaaattagactgggtatggtagctcatgccttaatcccagcactttgggaggctgaggcgggtgaatcacttcaggtcaggagtttgagatcagcctggccaacacggtgaaaccccatctctactaaaaatacaaaaattagtgtggtggcaggcacctgtaatcccagctacttgggaggctgaggcaggagggtcacttgaacctgggaggcagaggttgcagtgagccaagatcacgctactgcacttcagcctgggtggaggttctgtctcaaaaaaaattaaatttaaatttaaaaatgaataaacagtttttaacaatatgaattatttaaattagtatatatacaacattgccatcaatttggacagtagatgaatataaaaaataataacatactgtatataatatttgatggtttttcttttttttctagttgtcaaatgatcctttattgaaatattttcctttgtgcttaactagctgggcattccacagcaccactgttgatgtcatctatgatgtcatgagggtgctggccatcaacattacagcccacagactgggcagtccccaggatctctttaatggttccagagagttctctggctaaggatcagtgccgcatctgttgagcaatgttgacgatctcatcaaaagtgatattcccactgtgtttaatgtttttctgtttctttctctctcggtggttctttgagggctttgatgatcagagcagaggcagaaggcaccacctcaatctgggcctgtctgttctgagtggttagtttcactgtaatcctcaggcccttccagtcacccgttgccttggcaatgtcatcaccaaccttttttggagacagacccagggggccgatcttgggggccagggcagaagtggcaccgacttcacctccagtgcacctcaggtatacaactttgatctcgttggggtcaaactttggcggcatggtggaggcagctggtgtcgaatgaacccggattcgggatgaccgaagaaagttgcaccttggcctcctccgagccaaaagctgagagctattttttctttattaaaggcagcttgttaaatgaataaaaacatgatttaattttcatatctatagcttctaataaaattaatttacatatcagaaaaataattcactgtcagacaatgtgttcaggtttttggctcataaattaagggatcagaaagaagcaggaaataaataatttgcctcaggaagtcttttacaatggaggtgaactttgaattgactcccaaagcatgagttagccaggcagggaaggggagcataggcaaagcacagagatgtgaaagagatgacatattgaacaaagggtttatggggctagcaaaagaaaatgtgccacgattacctcacttcctggtcctctaccatactctcttctctctgcaatgcctttcccactttccaatccctccacctacttgaaggtctaaacttatattttaccatcctggaaatttctgacttctcaaatctgggtaagatccccctctgtgatctcataactctctgagttaatctcatgtatctgaaagtacagttgacccttgaacaacgtgggtttgaactgcactagtccatctatacacagatattatgcagccaaaggcagatggaaaacacagtgttcttgggatgcaaaccccatggatatggaggaccatatgcaggacttgagtatgtgcggagtatatgcagattttggtatccttggaaggttggggacgtgggggaggcggttcctggaaccaatcccttgagtataccagggtatggctctattgttattgtttgtccatttgtctgtctgttccactacagtaagagcttcttaagggcaggttctgtgttcactagcccctggaacagtgtctagcacacagtaaatgctctttagcatgactttattcattttaagagtatttcttggccaggcacggtggttcacgcctgcaatcccagcaggttagggtctgaaactcgtgggctcaagtgactctcccacctcagtttctcaaagtgttgggattacaggcatgagccactgcgcctggcctagtatttcttgaatctcctactggtgtgctgagacagccagcccctcaatccttggggtggtagggcctggggcagctagacatcctggcgagtcacctgcagtcaagagcagtctcttcctgtgtgtgctgtgatgtgtggaaggggaaacatcatctcctcttgggtacttttgtatagtaccctcattatagcctctttacttgtccatgtcctccacagcccacatgctgaatgaatggtacctttttcacaattgtatccttactgcctaagccaggactctgcacacagtaagtgttcagcaagtacttgttgaatgaatgcatgaaagaggaagcatttgtgttaaattttgaaagagtttgaatttcaatgtgtaaaggaaaagagcagtctatagagggggaccacaatctagaaggataactctatgtaacttgttcactttaggatctccaggttctggaagagtgcctggcacatagcagacacttaatgaatattttctggatgcatacaatgaaatggcaaatgaacctaggcagagatctccaaagcatctggagagataccagggaagtaagcaattctgtctggctagaacaaacagtgcatgaagagaaatactaacagaaggaatgtaaggaatgttagaaagtaggttgaggccaggcgctgtggctcacacctgtaatcccagcactttgggaggctgaggcgggtggatcacgaggtcaggagatcgaaaccatcctggctaacatggtgaaaccccgtctctactaaaaatacaaaaaattagccggccatggtggcgggcgcctgtagtcccagcttttcgggaggctgaggcaggagaatgacgtgaacccgggaggcagaggttgcagtgagccgagatcgtgccactgcactccagcctgcactacagagcaagactccatctcaaaaaaaaaaaaaaaaaaaaaaaaaagaaagtaggttgaaactggattgtaaagtaaggaaagtaggaaattgagtgaggcaccagacatatgttgtcttatttatctctcacaacagctgtgtgaaaatgagtcttagctacattgtacaggtgaggtaattgactctgagaattaaaataacctgacccaagtcccatgtaattgtcagaaccaatgtttggacccaggtcttctgtcccaaagttcatttctttttatatctatcacagttccttgaaagctaggctgcagattgtattgagattttactcttgagtccatgggaagcgagagaaacttctttagttgaggaacaacaaggtcagagctaagattcactaagattaatctgttaacgtatgtaggagagattgaatgggaaagccaagtgcagggagattatctctgagactgttaactaagagtttaacctgaccatcctcatgtgctatgggactcagaaagtgtagactcaaattcacttgggactgatggtttcatttctcttctcccacactaggtggccagaccagcaagacttaagctttgtttaacttgtcaatgtttacagaagtgcaggttgccaaaattctctctgcaccctgactcccactcccttttttaattttttattttattttttgaaatggagtcttgctctgttgcccaggccggagtgcagtggctcaatcagctcactgcaaccgccgcttcctgggttcaagtgattctcctgccacagcatcctgcatagctgggattacaggcgcccaccaccacccacggctaatttttgcatttttagtagagacagggttttgccatgttggccaggctggtctcaaactcctgacctcaagtaatccacccacctcagcctcccaaagtatgaggattacagacatgagccactgcgcccggccacctttattttttattaaaaaagtttttttagagacagaatctccctctgttgcccaggctggtgttcagtggtgcagtggcacaatcagctcactgcaatctcaaactcctgggctcaagggatcctcccacatcagcctcccaagtagctgggactacaggcacatgctaccacaccaggctaatttttaaagtttttgtagagatggggtctccctatgttgcccaggctggtctcaaactccggggctcaagcgatcctcctgcctcaggcttccaaagtgctgcgattataggtgtgcgccactggcccagccatcctgacactctttaaatccattccatttcacatgcctctgcttctcctttttcctgttgcctccaagctcttcccttcctatttctagatttacaaaactctatccaatttatcactactgaacatatacaattttctgtagggtttctaaaaatgtgtccagggcccagtgtggtggctcatgcctgtaatcccagcactttgggaggctgaggcaggaggattacttgagcccagcagttcgagaccagcctgagcaacacagggagagcccatctctacctctaccaaaaagaaaatgttgtgtccagtttcccttcttttttagcccaatcccctcctgtcttctagttttataattatcctagttatcttattcaggtttactcactaagtcttagcagactttcctaaatctagacatacaccccttacaataactggctttgtcctatatccatccgatccgaggctataaatagacctttcttttcttttcttgtctgtagagacttgctgtactttttaaggatcttgctctgttgccctggctggtcttgaactcctaacctcaagcaatcctccctcttaggcctcccaaagtgctggaatgacagttgtgagccaccacacccagccagactttcatttatggcctgaattttttacaaaggtttttctgtgtgtcataaaactagaaaaactagagccccaagggaactttcaacagatctgagctaaaggagtgacagtggaaaggaggctgtgggacaaatgcatgtgggacaaatgcaataatatttcagatatggaataatggaactcagcagctaactgggtgctgtgggaatggggacaaaggaaaggggagaggaaaagatgtgagggtgtaccagcttggaaaggaaaagagcatgactttagtcattcgtttaaggattatttcttttttctttcccttctttctctcttttttttttttttgagacaggatctctgttgccctgactggagtgcagtggcaccatcacagctcactacatttccccacggaatgatggtgtactggctcagtacaaatggaagagcagatattgggaaaagaggatgagctctgagacatgctttttgagggatttttttttggagacggagtcttgctctgtcgcccaacctggagtacagtggcacaaccttggctcactgcaacctccacctctcaggttcaagcgattctcctgtctcagcctcccaagtagctgagattacaggtgcacgccaccacgcctggctaatttttgtatttttagcagagacggggtttcaccacgttggccgagctggtcttgaactcctgacctcaggtgatccacccacctcggcctcccaagatgctgggattacaggcgtgagccactgcacctggcctgttttgagggattttaacagacaattaggatgtccagcagagctgagattggtggctcaccagagagctttaagagtcacctgcccagagataacagttgaaatcatgaaaatgtatgatatagtcaagggaaaatgggaaaagggaaagttagctaaaaattagaggtaaagatgagagaggtttgtgagagacaagagaacaggggagagatggtggctagtagagtagactcagatcagaggtggtgttgatgaagggaaaggcaagaaaggaccttttcaaggtctcctcaacatcaggaggacattcagcctctacatcaggggtccccagcccccgggccatggactggtactggtctgtggtctattaggaaccgggcctcacagcaggaggtgatcagaggaccagcgggaattactgcctgagctccacctcctgtcagatcagcagcagcattagattgtcattggagtgggaatcctattgtgaactgcatatgtgagggatctaggttgcacactccttatgagaatctaatgcctgatgatcttaggtggaacagtttcatcccgaaaccatcccaactcattctccccctccccaccccccacccattccatgaaaaactgtcttccacaaaaccagttcctggtaccaagaaggttggggaccgctgctctacactactgtcggagttttatttatctaaattgtatttctgatcaagtcatcttccttctccagaacttttaatggctatggaatgctatcaggatgaaatccactgttatgatcagagccttttgcttgcaaggaatagagacttacgttatttcgggaaaacagaagtctatgaaagggatatacagagcaaacccagaaaagcacaaaaccaaatttcaaaaagagcagaagtcaagggcctggctactctctcatctccctctctctctcagtgttcttctattcctctcagaacgtccgatcagttttcctctttgcttgtcagctacttcaactgccttataacctctatttcctcctgactggagtgttgcacaagacatgtaatggccacctcagccctattccatctaatgttccagctccagggccctctcattctcccatctatgccagtggtgatcctactgtcctccaaagctctgtgcaaatcaagattgttctgattcccccagtcagagttaatccctccattgtaattccatagtctgggttccacaagtacagctcttaccacagccaaactcgtgttgtgattaattatgcatgttcagcactcccatgtatctaggaaggcacatgccatatcttagctctttttttttttttttttttgagatgaagtcttgctctgtcacccaggctggagtgcaatggcaccatatcggcttactgcaacctccacctcctgggttcaagcgattctcctgcctcagcctcctgagtagctcggattacaggcacccgctactacaccaggctaagttttgtatttttagtagagacagggtttcaccatgttagtcaggctggcctcgaactcctgacctcaggtgatccacctgcctcggcctcccaaagtgctgggattataggcatgagccactgtgcctggccataccttagctcttttaactggctttatcataccactgtaatggtatacacacacacatatatgtgtgtgtatgtatatatatatatatatatatgcagtatgtatgctaattataagctattcctatgaatttacatatcagatcccttaaaaggctgttttttaatctgtgtgatgatggtgttgattaaaacatatataaaatttcttccagatccatgattttattttgttagaaaaaattaacacaccttcagcagtcacattttaaaataacatttaaactattattttttctatagtgtactaggctgagagccttagagatctatagatataaaatgaaatagcaactgtccttcattctgtcttcaagatatttttcccccaatgaaactttagggatatttgtatccatatctccattgcaggccagtagaataagaagaacaaaactaatgacttgcatgcaactcctaacacttgagggttttagaccttttacaaataagggacaacaggattggacccattttagggacacaaagttacactcaagatagaaaatgactcaagatataccttggaaaccttgctagtgctaggccacacagggtgatgccctcagcaactttttttttttttttttgaggcagagtcttactctgttgcccaggctggagtgcagtggcacaatcttggctcactgcaacctccacctcctggactcaagcaatcctgccatctcaccctgccggtagctgggactataggtgtgcaccaccatacccagctaatttttgtatttttaatagagacagtctttcactatgttggccaggctggtctcaaacgcctggcctcaagtgatctgcctaccttgacctcctaaagcactaggattacagacatgagtcactgcaactggctgtcctcagcatctttatgaaaatgcattgagtaggcatcagttgggcacagtgctgagaaaggcactaacaataaaaataaggaattaaaagatttctctctggcgttataaagaaggaaatgctattaaaagaaggaaaatatgtgatgtgtgttttcatctgtattagcatagactatgtctcaaagcacatatatgcaaccggtgcctctggagagggatattgggtgggtaaagcataagatggcagggggacttcctgtatatccttttgtgtgtttcatattttgtactatgtaaatatgttccacctataacattttttagttttttaaaaaagtctatgtcatttcctttaattctcacaataatgcctcgaggaatgtattgttaatatcccctttaccatggcagctgtttgattagggctcttcccactttaagcttatatcaaggttggctaaactcatggaaaaacatcagaagtcccatccagggttagaccaagagtccagggccccgatattgggatttttagatcaaaattggacaaatttataggcatatgacagctctatggggtttaaggcccttttagtggggactccttctgcctagactatatcctcctgccccaggcatcctgagagctgcttcagactaggattatcttgagtctaacctggtcccttagacctcattcctagagaggtgatggtgatacattttatggcagggctgctcatgttgaccaaatccacaaaaataatctgaaatcccctgaagggaggtgggacaatgatgaaatggagtatataaatccttcacagaaagtgattcagatcttatgttattttgcactggaatttcccagtgggccttgctcactccttgccttcttcccattctcttcctgcttgagtcctctatatcttattttccttccttgactaatagccaggctacaccctccaggaaccccagagcacagatccctgtaacatttctgtcctttggccatccactaacatttggcttcataaaatgttagtgacatattactgtgatacaggtttccaaaacacacaattcactgatgctaggagtggactcttcagtggtaagagcacagtctaaatgtcttacctctgttggagtgccttttggatctttctcttagattcctttttttttttttttttttttttgagtcggagtcccactctgttgtccaggctagagtgcagtggcatgatcttgagtcactgcagcctccgcatcctgggttcaagtgattctcatgcctcagcctcccgagtagctggaattacaggcacacgccaccaagcctggctagtttttgtatttttagtagagatgggattttgccatgttgaccagactggtctcaaactcctgacctcaggtgagggaactgagaaccagtgaggtgaagtgctgttcctcaagagtaaggatagaatcctatttattgtggtacttccagcacctagcacagtgccaggtacctagtgggtgctcaataaatatttgtcaaatgaaaaaattttttccttgttgtacatagtatagtgctttgcatgccaatacatttttaaattgaaattatttgatccaggtcgaatgcagccaaagggtggcagggctggaaacagaccacagatgtgtggccatcctgacaagggctctcattaccacactggaactgtgcctctggaaatgcctacaatcatctagcccccttgagtttggagttttttgttggtttgttttgttttttttgatggagtcttgctctgtcgcccaggctggagtgcagtggtgtgatctcggctcactgcaatgctatgttgcccaggctgcagtgcagtggcacaatcatggctcactgcagcctcaacctcctggattcaagtgatcctcccatctcagcctcccaaatcactaggaccaaaggtgcacaccaccacacccagctaatttttttttaaatttttagtagaaatgaggtctcactatgttgcccaggctggcccccttgacattgaatgcagtttaatcatggagctttccgtgcctacatccttttcttagcccactgccttattccagaaaggaatgataattggatttgaaggtgcatggccaactttcaattaaccctagaactggaaagaagcagtgatgcgaataatctaagagtcactgtgtttggccagtggtgttcctccccggtagtagctgactgacttattttcctaaagaaagtttgcttaggggagtattaaaaatccattaaccttccttgagtttacattagccagacagtggcaggaggccaggggaaagataaagcattgttcagagccaataagtgaacatacaagtaactatgaagtgattatagctctaaccatgaagacaaaggtcaaagaaatagtgattcttcccattgtgataaacgatgttatgtaatataagaatgttccaaaaatgagaaagattctttgcattctaggtgcaaaagattaaatacttgatgttcttgtcagagatcttttagttgcaaggaagagaacgccaagtagctcaagagtgaggagtttatcatctttacaagcacctagaagtaaatttaactatagcaatggtcaaatgggctagaatgccttattaggaaccaaagctacctgttgatctctcaggacccacccttctctcaacccttttcctgcatctgcttcattctcctgttatttccaattcgttctcttagtgttccagtgttcccaaagagaaaatttggttggcccagctaggaagagatgtcattcttgagccaaacattaaagacgcatactgtaggctgggtgtggtgactcacgcctataatccgagcactttgggaggccgaggcaggtggatcacttgaggtcaggagtttgagaccagcctggccaacatggtgaaaccctgtctgtactaaaaaaaatacaaaaattagccaggtgtggtggtgtgtgcctgtagtcccagctactctggaggctgaggcaggagaattgcttgaaccgggaaggcagaggttgcagtgaccccagatcacaccactgcatttcagcctgggcaacagagcaaggctctgtctcaaaaaaaaaaaaaaaaagttaaagacacaaactacagataagaatggtagggtcatctaatccatagacgatcaaagctccgtctttgagcaggtgctagggaggggaacagattcacttagaaaaggatatgggacaggcaatgactgtcatttatttattgtaaaagcaacatgtatttattttgaaaaatttaaacaccacaatattgtgtgtagaaagtatgactctcagttcaccaactcagctatgtagaaattacaagtgttttctacaacaaattaatttctaacttcatgacccaagtccccaatctgctgggctacagggaaatgtcaccacagtccttcctgatgtttacgcatttcccagggcttatttcgcactcttgagccctttatggtgccaagaggccatatagaagcctgaaagataaagactaccatcactttagcacatatatctgtttatgtatgtatgacatagtatgcatggttctttcttttttttctttttttttttctttttgagatggagtcttgctctgtctcccaggcgcccatgcagtggcacaatctcagcttactgcaacctctgcctcctgggttcaagccgttctttgcctcagcctcccgaatagctgggattacaggcacccgccaccacgcttggctaatttttgtatttttagtagagatggggtttcaccatgttggccaagctggtcttgaactcctgatcttgtgatccacccaccttggccttccaaagtggtgggattacaggtgtgagccaccacgcctggctggttatttctatgtatgaccatcgttttcttttcttttcttcttttctttctttttatttgagacagggtcttgttctctcgcccaggctggagtgcagtggcgcaatcactgctcactgcagcctcgacatcccaggctcaagtgatcctcccacctcagcctcccaaatagctgagactatgcctggctaatttttgtatttttagcagagacagggtttcgccacgttgcacaggctggtcttgaacttccatgttcaagagatctgcttgccttggccccacaagctgttgggcttataggcatgagccatggcgcccagcatattttctctctttctttctgttttttttttttttttttttttttttgagatggagtttcgctcttgttgcccaggctggagtacaatggcacgatctcagctcactgcaagctccgcctcccgggttcaagtgattctcctgcctcagcctcccgagtagctgggattacaggcaagcgccaccacgcccagctaattttatatttttagtagagacggggtttctccatgttggtcaggctggtctcaaactcccgacctcaggtgatctgcccacctcggcctcccaaagtgctgggattacaagcatgagccaccgtgcccagcccagccccactattttctatatacacacatttataatccttcaaaacaaaaaatcagggcgtgatgtaaccactattttgtaaatttttcagttgataatatattaggggcgtcttttcatgtgcacctataaagagctaacagtctatttttatttcatttttattatttatctgtttgagacaggatctcactctgtcacccaggctggaatgtagtggcataaacacggctcattgaatcctcgacctccctggcccaagcaatcttcccacctcagtccccccagtagctgggacctcagacatgcgccaccacacctggctaactttttttttttttttttttttgtagagatggggtttcaccatgttgcccaggctggtcttgaacttctgggctcaagcgatttgcctccagcctcccaaagtgctggaattacaggggtgagccactgtgccaggactattttttattttaccaagtggagaaaaaactaacaagaataggaacaacctgaatattattgataattttaatgtgatagatttagaatcttatattctacacaaatatatttaaaactttatactttacacattgtttttatattttatttattttttattttttttacacattgtctttaaatgcctaaaggacgtttaggaaaactggctaaatgacaaatgttactaaattccaaaaggaaaagagttcttgtaggacatgttatttgaccataatatattaaaactaaaaaaaaaaatctaaacatgtggatatatttttaaaattctagattattcttggcttgagtatataaacaaatactcctagcagtatattaaagaataatgtactatgttcataaatacgttattagaggaatgtaaaattagataaatgttaagaaatgtatcaatgaaatttttacactaaatagattaaagaagaaaagccatattctagaggctaagagggaatttgatacagccattctaaattttaaaatcttgataaaatagaaatggaatggaacttctttaacacagaaatgaatacacaaatagacaaagaccaataaagccagttccattaaagtcaagagtaatataacgatgtccaccacccttaatacttcatgaggactattctaaagggtctaatcaatgcaatatgacttttttttttttttagatggaggcttgctctgttgcctaggctggaatgcagtggtgtggtcttggctcactacaacctctgccccccaggtgcaagcgtttctcctgcttcagcctcctgagtagctgggattgcaggtgcatgccaccacacccagctaatttttttttgtatttttagtagagacagggtttcaccatgttggccaggctggtctcgaatgcctgacctcaagtgatccacctgcctcggcctcccaaagtgttagattacaggcatgagccaccgtgcctggccagtgcaatatgacatattttgtaaagggagaaacagaatgatcatcatttgcagatgataggatgtttacctagaaaatctaagagaaattggccaatagaatgattagaatttaaataattcagtcaaatgatcagataaaaggtaaatacattgaaaaaataatttattcattagcaataacaaatcagaaaataaagtgaaaaaatgtgattcagaaagcaagtaggttaatgtatataaagcacctagcacagttcctggtagatgggaggttatagaaataagctgtaataatcttagttattgattttatagattttagggatgaaattactgagacaaaagatgcaaacatttttaagcttcttgattcatatattcaaattattctttttttttcttttttttttttttgagacagagtttcgcttttgttgcccaggctggagtgcgatggtgtgatctcagctcactgcaacctccacctcccaggatccagcaattctcctgcctcagcctcccaagtagctggagttacaggcacctgccaccatgcccagctaatttttatatttttagtagagatggggttttgccacgttgatcaggctgatctcaaactcctgacctcaagggatctgcccgccttggcctcccagagtgctgggattacaggtatgaaccaccacatgcggcctcttttaacttttagttgaagtataacatgcatatagatactttgggaggttgaggcaggcagatcacttgaggtcaggagttcaagcccagcctggtcaacagagtgaaatctcatctttgctaaaaatacaaaaattagccgggcatggtggcaggcacctgtagttccagctacttgggagactgaggcaggagaattgcttcaacctgggaggcagaggttgcagtgagccgagatcacaccacaactctccagcctaggtgacagagaaagactctgcctcaataaagaaaaaacaaaacaaaacaaaacaaaaaaacatgcatatagaaaaattgtgcatacagaaagctggtcatcagtgtacagatcgagaatgaaactttatagtactccaagagctcttcgcatgtctccttccaatacctagccatcttcctccccagagtgtttctgacttctaacaacacagattagttttgcctgttttgcacttcatatgaatagaatcatacatgtgtactcttttgtgtttggattcttttgctcagcattatatagaaaagattcatccctctttgctcaggtggttgtagattactcgtattgctgtatagtatttcattgtataactagactgcaatcttccattcttctgttgatgggcatttgggtagttttgaatttggggctattatggagtgctgctgtgagcatgctgatacatgtcctttgggggccatatggaacattttgaacccagcactgctatggtatcttgaagagcagtggcttttagcacattggcttatagtcttctgggctatagatactggcatattcatagtgggccctgtcagcagtggcagtggtatagcagcacccttaaatggcttcatgagtagaggacattgaaaagagggaaccagagccaaaaagggagaaaaagatggacgctgtatgaaggaccatgactgacagactggttcatgagcctattgagacaaacctggcatgaactccaggctactggctactgatagggatataattttaaattataaccacaaccaatagagttctagagacatctgagttgccccctttttaaatttttattttaagttcaggggtacatgtgcagatttgttatataggtaaacccatgtcatgggggtttgttgtacagatttcatcacccaggtattaagcctagtacttattcgttatttgtcctgactctctcccttctcccaccccccaccctccgataggccccagtgtctgttgttcccctctatgtgtccatgttcccactgataagtaggaacatgcagtatttggttttctgttcctgcattagtttgctaaggataatggcctccagctccacccatcttcctgcaaagcacatgatcttgttctttttatagctgcatagtattccatggtggatatgtgccacattttctttatccagtctacgattggtgggaatttatgttgattccatgtctttgctattgtgaatagtgcttcagtgaacatacatgtgcatgtgtctctatgatagaatgatttctatccctttgggcatatacccaaaaatgggattgctgggtcaaatggtagttctttctgtcttcatgtctttgaggaatcatcacactgctttccacaatgtttgaattaataatttacactcccatcaacagtgtatgtgttcctttttctccacaacctcgccacagtctgttatttttttgactttttatagtagccattctgactggtgtgagatggtatctcattgtggttttaatttctctaatgatctgcccctctttccacggtctccctctccctctccctctctttccacggtctccctctccctctccctctcccctctttccacggtctccctctccctctcccctctttccacggtctccctctccctctctttccacagtctccctctcatgccgagccgaagctggactgtgctgctgccatctcggctcactgcaacctccctgcctgattctcctgcctcagcctgccgagtgcctgcaattgcaggcgcgcgccgccacgcctgactggttttcgtatttttttggtggagacggggtttcgctgtgatggccgggctggtctccagctcctgaccgcgagtgatccgccagcctcggcctcccgaggtgccgggattgcagacggagtctcgttaactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtccgggatgtgaggagcccctctgcctggctgcccagtctggaaagtgaggagtgtctctgcccggccgccatcacacctaggaagtgaggagcgcctcttcccggccgctatcccatctaggaagtgaggagcgtctctgcccggccgcccatcgtctgagatgtggggagcgcctctgccctgctgccccgtctgggatgtgaggagcgcctcggcctggccgcgaccctgtctgggaggtgaggagcgtctctgcccagctgccctgtctgagaagtgaggagaccccccgcctggcaaccgccccgtctgagaagtgaggagcccctccgccctgctgccaccccgtctgggaagtgaggagcgtctccgcccagcagccaccctgtccgggagggaggtgggggtcagcccccgccaggccagccgccccgtccgggagggaggtggggggtcagccccccacccggccagccgccccgtccgggaggtgaggggcacctctgcccggccgcccctactgggaagtgaggagcccttctgcccggccagcagccccgtccgggagggaggtggggggtcagccccctgcccggccagccgccccgtccgggaggtgaggggcgcctctgcccggccgcccctactgggaagtgaggagcccctctgtccggccagccgccccgtccgggagggaggtggggggtcagccccccgcccggccagccgccccgtccgggaggtgaggggcgcctctgcctggccgcccctactgggaagtgaggagcccctctgcccggccaccaccccgtctgggaggtgtacccaacagctcattgagaacgggccatgatgacaatggcggttttgtggaatagaaaagggggaaaggtgagaaaaagaatgagaaatcggatggttgctgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagggttaaatggattaagggcggtgcaagatgtgctttgttaaacagacgcttgaaggcagcatgttcgttaagagtcatcaccactccctaatctcaagtacccagggacacaaacactctgcctaggaaaaccagagacctttgttcacttgtttatctgctgaccttccctccactattgtcctatgaccctgccaaatccccctctgcgagaaacacccaagaatgatcaataaaaaaataaaaaaattaaaaaaaaaatacaaagattaatttctctaatgatctgaacatagaaaccagcaaagatttcatgatgaagatgcaaaaagcaattgcaacaaaagcaaaaattgacaaatgggatctaattaaactaaagagcttctgcatagcaaaagaaactatcaatagcgtacacagaaaacctacagaaagggaaaatttttttgcaaactatgcatctgacaaaggtctaatatccagcatctgtaaggaactcaaataaatttacaagaaaaagacaaataaccccattaaaaagtgggcaaagggcatgaacacttttcaaaagaagaaacacatgtggccaacaagcatatgagttcccctttttttatttgctatgagggaactgtgtcttatttatttttgtgtcccagaagctagcacaaagcctgacacacagccactgctaacaaaatgtttgtggatttatttaataaaagagttgggagtaggtggagaatggagggtggggagcatcacacatacatgcacatgcttaaaatgtggtgatttcttcctgatctgaccagatcaaaaatataaaacagaaacaggatctatgccatgggtcctggccctttttgcttctgccagcatgtgtgaggagatgcagagacaaattccgtggcagttagagaactaactgccaagatggagcgaagggaacatttaaccttgactttccacagtcctgaggttcccaaaataaaggggaaccggaaataccaaagggtgaggaggtatctaattgaaagtcagatgggaagaagagaacttacttaaaggcagggctacacagagcatcctaaagacagaaaagatcaccctgaaaattgtggggttttttttttttaggagtagggaaaaatatctataaatcaaacacacatgggaatgcttgaggtagagaagagcgggtgaccctggggatcaggggttattctttcgggtaggcaatatttccctcatccttgtagcctaccgtccctgccaagaaacatccaagtgcctcgatgtcatgccaaaggcagcagcagcttatggatcaggcacacatctacatccgaacgctctgtggcagcctctgtagttttagcctcctaatgctgatcgccatgtccccactgaactgggtacagtttctggtgatcaagaatggccttgagctctacgcaggactctggaccttatgcaaccatgagctgtgctggagccacacacccaagccaccctgtgagtgccaccgaattaaatgccacaggccccacacaattgcagagctttctgctcacacaaattggcccttcatgtttcttcctccaagatcttttggccttcacctctccaagtgcaggatggatctttctttggtatcctcagtgtgccctttctctctcctattccaggttgtttcctgtcctaaataatgggttatactctctttatgggaagaactgtttttgtttgttggttggtttttcgagacaggctcttgctctaacgcctagccgaagtgcaaaagcactatcattgctcactgcagcctccacctccaggactcaagcaatcttcctgttcaacctcctgagtaggtggaactacagatgtgtgccaacactcctggctaatttttaatttttttaaatttttttttcttttgtagagacaagttctcattatatttcccaggctggtctcaaagtcctggcctcaagtgatcctcccaaagtaccaggactataggtgtaagccaccatgcctgccctaggaataactcatttacaaggtgttactgctaagcaatgtgattggtattctaatgtggcttgcagaattagaagagaagtgattgatcatagctggaagataaagcaaatatcttaacctctattagatttaactttcaaggtcagcttgttcttctcctagcagtggaatagaacttaaatgtacgttagatatgtggtataacaaatgccagctatgaagataatgttatttatgtcaaattttatgtgaatttaaataaatctgaaagtgcaacacaaaatattttaaaataagtttttggggctaaaaataacatatgcatgaatttttcaatcaaaccaaaaacttagaggaaagatatcattacactgacagttttcccataacccgcaagatatacatttacacaaagaagtgggtattgtgaaagaaaacatatgtgagtaaagcatctattctcatcacataagcaggggtcccatctattctcctcacataagcaggaggggagcacctgtgcccaactctgaggtacagcatcagttgtttggccatgggctgtgacatttgatattaagggacagtatcctgcatgatcttgagaagaaactaaaatcaaaggcagacagacaattcaactgcataaaacgaaaactagagaaaatatttgcaacaattatgaaagataaaggttaatggccttaatatagtaaaaggatacacaaagtattacaaagacacaaactcaaataaataagttctttttgaacagacatgcacaaaagaagaactataactatctaataaacataggaaaaataatttaacctcaatcattaaagaaaggtaaatcaaatgaataacaagatgtaacttttcaaccaccatattaacagatttttaaatgataatgcaactgctatcactcccatacgcattcctgtacatgccatgcaaattggtataactaaagcaatatgattaggtgtatccagagacttaaaaatgttcatctcctttgagtaaataattccatttctagaaattaattccaaggaaataactagaaatggattaaaaggtttaggcaaaaagattaagctgcaatcatatttatgtaactgggtgcccaggctaaaatttcatccttaagattattatttaaatttttaataaattagggctgggtgtggtgactcacgcctgtaatcccagtgttaccagaaaggggtcctgatccagaccccaggagagggttcttggatcttgggcaagaaagaattcaagatgagtccatagagtaaagtgaaagcaaatttaagaaagtaaaggaataaaagaatggctactccataggaagaggagccccgagggctgctgtttgcccattttaatggctatttctttattatatgctaaacaaggggtgaattatattcataagtttttggggaaagaggtgggcaattcccggaactaagggtttctcccctttttagaccatatagggtaaattcctgacattgccatggcatttgttaactgtcatggcactggtgggagtgtcttttagtatgctaatgcattataattcatgtataatgagcagtgaggatgatcagaggtcacttttgttgccatcttggttttagcgggttttggctggcttctttaccacagcctgttttatcagcaaggtctttatgacctgtattttgtgctgacctcctatcattcagtgactaagaatgccttaacctcctgggaatgcagcccagtaggtttcagccttattttaaccagcccctattcaagatggagttgttctggttcaaacacctctgatatcagcactttggaaggctgaggtgggggatcacttgagcttaggagttcaagaccagcctgagcaacaaggtaaaaccctgtctctacaaaaaatacaaaaattagctgggcgtggtagtgggcacctgcaatcccagttacttgggaggccgaagtggagagttgcttgagcctgggatgcagaggttgttgtgagccgagattgagctactgtactctagcctgggtgacacagtgagaccctgtctcaaaaaagaaaaaaattaatacattagaatcccgaaattatgtcacttaaagcagtgaatagtttatttcttggagccctggattcacctttatgcagataaagaaaatcaaggaaatcaagccagcctgtcactcagattttgtggagtcactttgtcactcacctttgtttatgctttgttttatctctacagactgtaattatttagagaaagtcaactgaatccttaaggtgcataagtataaatcaagtatccaccctattttccatgttattataactagctctaattcaagagtcagtaattaatctgcaatacagatctcataagaaatatcccacaatgtaagcaaaatgtccaggcctcatctccctgtgacaatataatgttattattgcccgaatacattatttatttatttatttatctatttatttttgagatcgaatctcattctgtcacccaggctggagtgcagtggcgcgatcttggctcactgcaacctctccctcccgggttcaagcaattctcctgcctcagcctcccaagtagctgggattacaggtgtgcgccactgcacccagctaatttttgtgtttttagtagagatggggtttcaccatgttagccaggcaggtcttgaactcctgatctcaggtgatccgcctgcctcggcctcccaaagtgctcagattacaggcatgagccactgcacctggcctccgaatacattattgtctaataattactgtccaattcaatgacttcaaacttttacctactggattgcaagaatttcgttcccctccctgacagtttcctttcataagtcattttcgtaagtttcacaggggctatctcaggtgtgtttaagaatgtgcatgctcatattcctattccctgggctcacttcagggtgttgtgcttctgtctctgagttcacctgggtctagatgactgacagcctctctgttgtggctgttgctaatgggatgaagaagggatggggaggaaaggacagtattcttcacttttactaggaagtctcaagtgtagaacagacccttctgttattttcccatagcactggtgagatcaggctgaaatataaaggatatattgccacagagagtagtttgaactgttttgcagagcgtgggaaagaaagggtaagtctttttgtcaaggcactgggcaccctagagttaggaccctaggaacaaccatatagtacacattgccaagctgtgtagggatgctttattctggcactccaactgggttacgaggggacttaaatactaagcagatttcatagatacctcttcagggtcctaagtctccacccaggatcatttccattccaaaaccacccacttggggcacctcatctgagcctggagaagttgtatgttgccttccgtgccttgaaagcggtcacaatggcagcagcgtggaagttcagatttggctaaataagtgagctgattccccagcttgtctccagcaacaccactttccaaaagctccctggccaacttttacttccacaacagtagaaggagatcccgcccattatttacaaactgccaaatggtgaacgttctcatttcactgagatctgaggggatgccacagaacactactgctttctggttgggtgatgccccctccaatcttggtaggggttttacatctcacccaatggtactctgaagtgtagcatcgctgactgatgctgggctgatcccgagaacatctacgaaaatcttaccaagtttttcagatgatttgtacttcctcctcaaattgaaagtgacatcctttctcttcccaaggtattagtttcagtaagctgggagaagtgccttggtattcttgtaacttaagtctgcatcaaagtatatcagtaaggaaaacatcaaaaatgtttggatacagttgacccagacaggtgacacaggggtgttcgttttatctcaggcactcctttttccggaccaaggcttcttacagaaacatacaagcagagccttttgtgatttagatcctaagatttttgaaactttgatgagtaagctgttgtaaaaactgttgtttaaaagctgaaattagctttggtgttacaggagatagaagcttgaaatcagcttttggacatttatttatttagagtaatatgaattaaaaaactataaagttaaccaaatgcagatgtcttagactctgaatataagtgtgtagtttgtttatataatttgttgtatatgattattcctaatagacttggttactttgggaaggttagactcttctatgctgcacatctttaaattgttccttcagagttgtgaggatcttgtttatgtagttttcaggagatgagaaggtaacacagagagaattgtaagaaatatataaagttgcagtcttctcctcatggtagaagaggaactggactttatatgttaggctggagttggacaggaaatatcctcgacagtgctccttggtgttttgaatattaaaatcatttgaattagtgcaagctaaagagtgaacttatttataaagattcagaagaatctgccaggtgtggtggctcaagactgtaatcccagcactttgggagtctgaggtgggcagatcgcttgagctcaggagtttgagaccagcctgggcaacatggtgaaaccccacctccaccaaaaatacaaaaaattagccaggtgtggtagtgtgcacctgtggtcccagctactcaagaggctgaggtgggaggatagcttgagtctgggagttggaggctgcagtgagtagagatcatgctactgcactccagcctgggttacagactgagaccccgtctcaaagaaaaagataaagaaaaaaaaatgtggctcagaagaataacatagactcccaaggcaggaagttcgctggaccttaggggattccagaggaggctgggatctcagataaagaaaatcaagccagccagtcactcagattttctacagtcactttgtcattcagctttgtttatgttttgttttatctctacagctcagtttttcctgtttattagtgtgtaagtgcctaaaaggtgataccccggtcaaactttacatcttctcagttcaagcaagcaaaagaggaaatccaatttctaagcataagaataaaattgtcccaggatgggtcaggttcccatgcttagtccaggtagctatagtcagagggctatacagacaatagtcaagggctatagacaagggctgctagagctcatggaggattgtggactaaataccacaaaggctgcctgttaccctgggcttcatacagctcaatctgggcttatgttctggctggctacatatactgctaattctgcataacccagtcttcagaaaatgtgcagcttgtgaattactatgttttaatgtggctcacttgttagggctacagagcaacttaacatctgtggataggggtgtggtttctctgaatggaaattcctgcaattcatcatattagtaagtggcaggttctggagaacaaaatgaaacaaggaggcagatattagactggataagcttgatacataatttctgctctctgggttactcagaagctggacttggattcttaggcatataagtggttagagaactttctaaccactggggtgggggtgagctggtccctgctacactgggacagaaaaagaagctagataaggaggcaccttataagggatactgaagatattcctgggtgtctggtagctcagaaaagctatagctacttgtaattataagttatcttctaaatcttcagtaaaatattgatggggaagtcgaagaacctgttccatcttagggatgtggtagcaaaaagtaaggttgagcatatccccgctgctctcttaccaacatccagtccgcagtggcagagccaaagagaagacacctagagccaaagatggaagaaggagaggtgtggcacttggataagagcaacttgaacaaatatgagataggactttgggggactctcagaataaaaaaaaagtggagggaaacactttgtggtaagttcctgcagcttggtaaattggggcttgaaatcatcataatatggaattaaagtaaatgaggctgggcgaggtggctcacgcctttaatcccagcactttgagaggtcaaggcgggcagatcacctgaggtcaggagttcaagaccagcctggccaacatggtgaaaccctgtttctactaaaaaaaaacaaaaattagccaggcatggtggcatgtgcctgtaatctcagctactctgggtgacagaatgagactctgtctcaaaaaaataataataaaataaagaaatagataaataaagtaaatgtgacttcattttgtagtcataggctgacaaggcctgtacatgccagatagagctggaagtgaaaaaccaatggaactaaacaatgggtaagtcattaagcaaagtatattaatatgatagaatattttgtagccatcgaaaataatatttacaacagataatggggaaaatcacatcatatattcttaagaaaaaaacccacatgatatctagtatcatatctactatgtacagagggtagaaaaataaaatattaacaatggttgcctctaggtagtcaaattgtggctaatttttttcctgcttctttgttcttttgtagtcttttgaatacttatgttgaacgcgtattacttactacttttagaattagaattagaaacaagaaaaaggtttaatctgttttgtcattggtgacaccttttataagctagtttatatctaaatcaatgcatgcagaagtatttgtatattatctttagtttaacaatcatagtaaagaaattccaagcaaaaaggatgtcatgtagcaagctctgctccatcatcctttgttcttaaatccttctctaagactctatctggcctttttaagggaaggtccctcactggactaaccacggtcttcctttcctcttcttcatgcagattatctccaatattccagggccttctttctcatctctgtctttaccatacttactggccttggctggctcttcagctcttggatccttaatcgaggaagcatgaccaccaacttggatctgaaggtatccatgctcagcttcatctcaggtacagacctagactggcagggtattttaccatggtaaaatagtcaaggtaacaaattttctctgtggaactctcatactctttttcttatctctttgctcttcttcagtatcacaccaacttgccagctatctgccttatctaattatatagaacacaccttagctgactttaccagggtatagagcctttctctcatcttggtcagtccccaggtttttatctttttgatcctcgctatacatatggcctctggaggccaaagagctgggggtggcggggaagacagactgaagatgctgatgggttgtgacatctttccttctggtcctagctacctgcttgctcctctgcctcaacctgtttgtggcacaggttcactggcatactagggatgccatggagtcagatctcctatggacctattatcttaactggtgcagtgacatcttttacatgtttgctggtgagtcacttccctgctctatgctagaaggatggatagggaaatcgcttctggaaagggaggtataatccaggagaaatagaagcactgactgttccttttcagaacactgatacttggagagtcaggggggcataatgaagaaagggtggattttagagtctgaaaacctagcattagtaacctgctctatcacaaagtgaggcatggacaagttgagtaacttgcccaagaccacacagaaaatagtggaactatgatctgaatccaggaggttcaagctttgtcctaatcagtctgagaaatattataatgcaattagagcacaggagggtaaagtaactccactgggggagagaggggttcactgaaaagatgcctcttgaactggttattaaaggatgcataagaattttaaaagccaaaagaccattgcctattgaacctcacctcaaattattcccttcccgtagggatcatctctcttctcaactacttaacttccagatcgcctgcctgtgatgaaaacgtcactgtgattccaacagagagatcaaggctgggggttggtccggtgactacagtatcacctgctaaagatgaagggccaaggtctgagatggaatctctaagtgtgagagagaaaaatttaccaaagtcaggactgtggtggtgataggaaaacctaactatagcttgtcttaaaagcaggggagaagctgagttgggaatggtcacataaattctgggaaactctcctaatatcatgtccatattacttgaggagacagcattaaagctgatgaaatgtcttttgcgtgcattggatccaaaatatatatgatagtcataaagtaaataactcacttaagaaaaacatttctaaaagaaaacaacaatgtttagagtcatgaatgaaagaaactagtgaaagatgcagtgtgtagaccagagacctctttgggtatcagggatctcatggaccagaatggcccgtggagaagaatgttaattacttctgtttggaattttctttattatgtgtggctttgggtatactcaggatggaaagcacttggacaaatactgttgaatctgaacttaatagcattaccagaaatggaataaatatcaatggatataagacctactactcaaaggaactgagaggtgctgggtagattccagggaatccatggggtcccacttactgtgaggattggtaatttgaaacatttacagtctattacgtaaaaccactgcttctccctaggcagggagataccttaaccaggcatccacaaactccctgaaattctatacaaaacttgtatatgtattcttctgtgaagagagccagagattccatcagattcttccttccccccgccccgcccccagaagatagtttcatgtaaactccatcaaattcttgacaggctggtgaccgctttgattccttaagcatcaattatgttttactgagccaaatgggactacagggcttccttcagcagatggatagatagataaatagatagatagataatagattgatagatgatagatcgatagataggcctatctatctatatctataatacatctacatctatatctatacaaactgaaagattttccatgttttatatatcctgtaaagctaagtacggagggaggaggtggtattttcaggcaatcatataggtcttttgatggctaaagatccctttcacactcagactagatttcacacataaagttcctgatactcattttgtctttcatacccttagttgctgccactactgctgtattggttgagatccattcttctccccaaagctggcaatgaaatggactatagtgtccagcttcacctcttgctgcatgtaaagataagcccttgggtctatttggtttaatttagagattcactagtaacctttgcagaaaacccaaataatagacattgagcaattatataattcttgtaatcctggtcctgatcagtaattcccaaacatttccagatggtaactggaagccctttaagttaatacttatgcttttattcctgtgggttggagcttatacacagcacacacttgtatgcacccacacacagatacacaaacagacatatatacacacacctcattttgatcctgccttagaaaaccctttcttcacgcccctcttccaatcaggtgagtttcgttatggcagaattacttgtgcctccttgcttcaagtggccttagttcagaggctcttcaggctgtttctgggcctttgtctgcttataagaacaggcatgtagtcaaagccaactctccctcctcacattaccactcacacaaactctaacctatacattaactggttaagtactcactgggttcacaatctttattcgtaatttagtttgaatactttcattatatgactaaattgacaggatgctgaacactgatgactcttcagggaacaaaagttctaaatggggcgaagagaagaaagtaagtctgagtgaaggtggaagaagcgagataataagaaagtaacgccaggtacgatggctcacgcctgtaatcccagcactttgggaggccaaggcaggcggattgcctgaggtcgggagttcgagaccagcctggctagcatggtgaaaccccatctctactaaaaatacaaaaattagccaggcgtggtggcaggcacctgtattcccagctacttgggaagctgaggtaggagaattgcttgaaacccgggaggcggaggttgcagtgagccgaggctgcgccattgcactccaacctgggcaacagagtgagacttcatctcaaaaaacaaaaagaaaaaagaaaagaaaggaagacagtaacaagtgccctggctattagaggataattggcagtaattataactaagttttccactttgctactggagaattatcttttaagcaaagataattttcattgctcctttagaaactgaatgctttctattttcttttttctctttttctttgcttgtaaataattccttaaaaggcttaagtgggccgggtgctatggcttacacctgtaatcccagcactttgggaggccaaggcgggcggatcacttgagaccaggagttcgagaccagcctggccaatatggtgagaccccgtctctactaaaaacacaaaaatcagccaggcatggtggcgcgcacctgtaatcccagctgcttgggaagctgaggcagaagaattgcttgaacctgggaggctgaggttgcagtgagctgggattgagtcactgcactccagcctgggcgacagagtgtgagaccctgtctcaaaaaaaaaaaaaaaaaaaaaaaaaaaaaacttaagtgaatttccagtcagatagctcagtaaattaccctttcgtgcactctctttgttccgtatatattttataataggttaagtgggaagagagagagggagagagagagagaatagtccagtcaaaacgagataaacattttcatagactggaaaaaagaaaaaagcaatggtatgattcaagctaagccctagacttcgtaagctgtaagtcccagagaaagcataggtgaacagggagatagctcctatggggtgaaagggactaaaagtgcttctcaagacacggactaaagccagcttcacaaccctacatcaaagaggagctctagaaaagaagctaaacaaaaactgctgcccagcactaactagcttatttggaacagcagacctaacgagggagaaggacacaaatataaccttgctaaactaagcagcctgtgggttcattaactgtgtctctgatattccttggtagcataatagaacagaaaatctaaaatatcacattatcagacctgattctggactgaggcctttggccaatgtaaggaaaccccaaaactaccaggtatgatagaataagcatagagggagaaagaaacaaaaacaaataaaccaaatgtttgtgcctacaaataagaattccagacatgtaaagaaatgttcagttgggcgtggtggctcatgcctgtaattccagcactttgggaggccaaggcaagaggattgcttgagccaattagtttgagaccagccctgacaacatagtgagaccctatctgtacaaaaaattacaaaattagctgggtgcggtgccgcactcctgtagtcctaggagcttgggaagtcctgtagtttctgaatccttgagcccgggaggtcgggtctccagtgaccatggtcatgccactgcactccagcctgggcaacagagcaagactctgtctgaaaaaaaaagttcagaaaaaaactaacaaagtcaacaatcagaatatgaaatcattctagattaatttggggtataatgtgataaagactattcttaggatgcacagatacatgacagaatcataaatttaaaaaaaagacccaaaactgtgaaacaaaaacaggtagaaataaaacaagaacaggtttaaataagaaagaaccaactatcaatcattaaaatgaaaaagtactaattggaataaaaatccaataggataaaatctagatagcacaagcaacaaaaagagaaactttgatttttagatctatctagagtacttacaaaaaatcgaccaaatactatatagttttaataaatgtcaaaggatatatcagtccatggatcctgactgtaatgaaattaaattagaactcaataatgagagtgattaaaaaaaaatacttggccagacatggtggctcatgcctgtaatcccagcactttgggaagcagaggcagatggatcacttgagtccaggagtttgagatcagcctggccaacatggtgaaaccccatctctacttaaaaaaagaaaaaatagattggggaagttctcctggataatatcctgcagagtgttttccaacttggttccattctccccgtcactttcaggtacaccaatcagacgtagatttggtcttttcacatagtcccatatttcttggaggcttttttcatttctttttattctttttcctctaaacttctcttctcgcttcatttcattcatttgatcttccatcactgataccctttcttccagttgatcaaatcggctactgaggcttgtgcattcgtcacgtagttctcgtgccgtggttttcagctccatcaggtcctttaaggacttctctgcattggttattctagttagccattcgtctaatctttttgcaatgtttttaacttctttgctgtgggttcgaacttcctcttttagctcggagaagtttgattgtctgaagccttcttctctcaactcatcaaagtcattctccgtccagctttgttccgttgctggtgaggagctgcattcctttggaggaggagaggcgctctgatttttagaattttcagtttttctgctctgttttttccccatctaatgcaatatggattaaagacttaaatgttagacctaaaaccataaaaaccctagaagaaaacctaggcattaccattcaggacataggcatgggcaaggacttcatgtctaaaacgccaaaagcaatggcaacaaaagccaaaattgacaaatgggatctaattaaactaaagagctccttcacagcaaaagaaactaccatcagagtgaacagggaacctacagaatgggagaaaatttttgcaatctacccatctgacaaagggctaatatccagaatccgcaaagaactcaaacaaatttacaagaaaaaatcaaacaaacccatcaaaaagtgggcgaaggatatgaacagacacttctcaaaagaagacatttatgcagccaacagacacatgaaaaaatgctcatcatcactggccatcagagaaatgcaaatcaaaaccacaacgagataccatctcacaccagttagaatgacaatcattaaaaagtcaggaaacaacaggtgctggagaggatgtggagaaataggaacacttttacactgttggtgggattgtaaactatttcaaccattgtggaagtcagtgtggcgattcctcagggatgtagaactagaaataccatttgacccagccatcccattactgggtatatacccaaaggagtataaatcatgctgctataaagacacatgcacacgtgtgtttattgtggcactattcacaatagcaaagacttggaaccaacccaaatgtccaacaatgatagactggattaagaaaatgtggcacatatacactatggaatactatgcagccataaaaaatgatgagttcatgtccttcgtagggacatggatgaagctggaaaccatcattctcagcaaactatcgcaaggaccaaaaaccaaacaccacatgttctcactcataggtgggaattgaacaatgagaacacttggacacaggaaggggagcatcacattccagggcctgttgtggggtggggggagtggggaggggggagggatagcattaggagatatacctaatgtaaatgacgagttaatgagtgcagcacaccaacatggcacatgaatacatatgtaacaaacctgcatgttgtgcacatgtaccctagaacttaaagtataataataaaaaaaatagctgggtgcaatggcaggtgcctgtagtcccagctacttgggaggctgagacacaagaattgcttgagcctgggaggaagaggttgcagtgagctgagatcacgtcactgcactccagcatgggtaacagaactagactcttcaaaacaaaacaaaacagaaacaaacagaaacaaaaacaaaaacaaagctctacatcttttaggacaaaataatgctccctaaaaaaattgggtaaaaaggaaatcacaatggaaatgataaaatatttagaactaaacaaccatgaaagaattactataaccaaaacccatagatgcattaaaaacaaaacaaccaacaaaaatagtttaaaataaatgagttatgcatgcaattcacgaacctgtaaaagaataactagaaaagaccaaagaaggaagaaaatttttaaactaaactttgtaaaaatatgaaaaaaccttaggttcaaatgacagactaaaatctatttctttggacaaaaactaaatgaaaggcaaactacaagtaaacctaattaagcaaaaaaaaaaaaaaaaaagagtgaaagcatgaaaaggacataactaaagtatatacgtaggtatacatatttacatatacattactcaagcatattttattgtttaaatcttctgtttctttactgctctttggtgtttttgtttgtttgttttgagatggagtcttgctctgtctcccaggctggagtgcagtggcgtgatcttggcttcctgcagcctctgcctcccgggttcaagtgattctcctgcctcagcctcctgagtagctgggattacaggcactcaccatcacacttggctaatttttgtatttttagtagagacggggtttcaccatgttggccaggctggtcttgaacccctgacctcaagtgatccacctgcctcggcctcccaaagtgctgggattacaggcctgagccaccacaccgcaccatctttactactctttgttttatgtttttctgtgttaagtctcccatgatggcttcacgttttaaattttttccttgtaatactatcaatatctgcttaatattttgaatctataagatggtaaatatccaaattaacctgtggattcaatgcaattcacaacaaaaatctcacagatttttttttctgtggaaaatgaacaagagtcaggtacccaaattcaggacagctcattctgtcctttttgcaaagggcccaaaagggccaagataattgtgaaaaataaaaggatggagacatttacattacctgatgtgaagatgacttatcaaattattgtaattaagactgtggaagtcaggtgcagtggctcacacctataatcccaactacttgggagattgaggtgggaggatcgcttgaggacaggagttcaaaacaagcctgaacaacacagtgacaccctgtttctccctccttctcaaaaagaaaaaaaaatagataatgtggtattggcacatgattacataaacagaacagaatagaaagcctagaaatacagaagaaacattaaaaaaaaaaaaacagaatgagggaactatggactgtccacctaatggggctgatgtaactggttaaatacggaaaaaaacataaaactacatccctgctttgtgatctttttgtttttaagttccaaaagatcaaaggcctatatgtgaaaagcaaactttagggaccttcactggccgatccagaggaaatctaagcatcaaaaagagtaatgaaagtactagattattacactttgaatttttttaaaaatccatgagtcctaggaaaaatcaatatcgtgaaaatggccatactgcccaaggcaatttatagattcaatgccatccccatcaagctactaatgactttcttcacagaattggaaaaaactactttaaagttcatatggaaccaaaaaagagcccgcattgccaagacaatcctaagccaaaaggacaaagatggaggcatcatgctacctgacttcaaactacattacaaggctacagtaaccaaaacagcatggtactggtaccaaaacagagatatagaccaatggaacagaacagagccctcagaaataatgccacacatctacaaccatctaatctttgacaaacctgacaaaaacaagaaatggggaaaagattccctatttaataaatggtgctgggaaaactgactagccatatgtagaaagctgaaactggatcccttccttacaccttatacaaaaattaattcaagatggattaaagacttaaatgttagccctaaacccataaaaaccctagaagaaaacctaggcaataccattcaggacataggcatgggcaagggcttcatgtctaaaacaccaaaagcaatggcaacaaaagccaaaattgacaaatgggatctaattaaactaaggagcttctgcacagcaaaagaaactaccatcagaatgaacagggaacctacagaatgggagaaaatttttgcaatctacccatctgacaaagggctaatatccagaatccgcaaagaacttaaacaaatttacaagaaaaaatcaaacaaccccatcaaaaagtgggcgaaggatatgaacagacacgtctcaaaagaagacatttatgcagccaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactataaactagttcaaccattgtggaagacagtgtggcgattcctcaaggatctagaactagaaataccatttgacccagccatcccattactgggtatatacccaaaggagtataaatcatgctgctataaagacacatgcacacgtatgtttattgtggcactactgacaatagcgaagacttggaaccaacccaaaagtccaacaatgatagaatggattaagaaaatgtggcacatatacaccatagaacactatgcagccataaaaaatgatgagttcatgtcctttgtagggacatggatgaagctggaaaccatcattctcggcaaactatcgcaaggacagaaaaccaaacaccgcatgttctcactcacaggtgggaattgaacaatgagaacacttggacacaggaaggggaacatcacacaccggggcctgtcgtggggtggggagggatagcattaggagatatacctaatgtaaatgacgagttaatgggtgcagcacaccaacatggcacatgtatacatatgtaacaaacctgcacgttgtgcacatgtaccctagaacttaaagtataataataataagaaaatagcaaaaagacaccatgacacacgtagcctctcctgtcccaataaagtatatactctgggaaaaaaaaaatccatcagtccatagtgacattcaacaaaagacagagtcagtgaaaaaggaaaaaagtagaggtagctttttttttgtatagaagaatgtcagctaataaatatagaaggaatgatagaagttgaaaatcattattttataatctgcaacataattaaggcaaggatcaccgataggtcatcattaaatggttatttggaaacaggatatcaaattatcactccactaaatatttattagttccaaaggggaaatgtatctttacaatgcaaatatttggcaatcacaatcttaactaagtggtcaccatgtgcggtttttttttgagacagggtctcgctctgttgcccaggctggtgtgcagtggtgtaatcatagctcactgtagccttgaactcctggcctcaagtcatcctcctgccttggcctgccaaaatactgggattgcaggtgtgcacaaccacacccagcccatcatgtgcctttagatatgatacagtaggaggtatacaccatcacttgtgtggtgttttgttagaaatgtctgcccgaaatctaacgataaatagtcaaacaaaaatccagaatatgggacagtctatgagataactggccactatgtaaggatttaatattatgaagagcagaaggaggtaatagtattgtttaaactggaggagactataggcatataacagtcagatgaaatccattgaatctggacttttaaaaaatgtataaactgggccgggtgtggtggctcatgcctgtaatcccagcactttgggaggccaaggtgggtggatcaggaggttagcagttcaagaccagcctgaccaacatggtgaaaccctgtctctactaaaaatacaaaaaaattagctgagcatggtggcgggaggctgtaatcccagcaacttgggaggctgaggcaggagacttgcttgaaaccagaagatggaggttgctgtgagccaagattgcacgactgcactctagcctgggcaataagagcaaaactccatctcaaaaaaaaaaaaaaaaaagcataaacctttttctttgacaatttaggaaatttgagtatgaaaagaatgttggaagttgtgttgaattaacgattttttccctcaggtgtggtaatgatgctgtggatatgtaggagaatgtcattgtttcctggaaaatatgctgaaatatttatctttttttttttttttgagacactgtgtcactctgtcgtccaggttggaatgcagtggcgtgagcttggctcactgcaacttctgcttcctgggttcaagcgattctttcgcctcagactcccgaggagctggaattacaggcatgcaccaccataccaactaatttttgtatttttagtagagatgtggtttcaccatgttggccaggctggtgtcgaactcttgacttcaagtgatctgcccacctcagcctcccaaagtgctgggaattacaggtgtgagccactgcgcccagccgagataagctgaaatatttagaggtaaaatatcacaatgcctacactcactttcagatgttttgtcaaaaaggaaaaaaatacacatagagacagagagatagagagagcaaatgtgtcaagatgttaatagttgataaatataggtgagaggtataacagtattcattttagtattcaacttttctctgggtttgaaattctgcaaaataaacaagaatatttttgaaggtaaaaaattagagaataataataaaagttttatgaatttaggtgttcttaagagaaacaacatttacaaaccacaacaaaaagtcttgatacattttactgttttaaaactaaaactttggctggatgtcgtggctcacgcctgtaatcccaacactttgggaggcccaggcgggtggatcacctgaggtcaggagttcgagaccagcctgaccaatatggtgaaaccctgtctctactaaaaatacaaaaattagctgggcgtggtggtgcgtttctgtagtcccagctactcgggaggctgagacaggagaattgcttgaacccaggaggcgaaggttgcagtgagccgggattatgccactgcactccaacctgggcaacagagagagactctatcaaaacaaaacaaagaaacaaaataaaacaaaacacaaaaacctaaaacttctatactacaagatataacataaagcagtcaaagagataagctggcttgtaagtagatatttactatatataacaaacaaaggatcagtatctagaatatacaaataaactctatgcaaagaaaaaggagggatggggccaaattacccaatagaaaaattggtgaaggggtcaggcacggtggctcatgcctgtaatcgaggcagtttgggaggccaaggcaggaggattgcttgagcccaggaatgtgagaccagcctggaaaacatattgagaactcgtctctacaaaaagtaaaaaaaaaaaaaaaaaaaaaaattagctggatgtgttggtacgtgcctgtagtctcagctacgcaggaggccaaggtgggaggattgcttgagcccaggaggtcaaggctgcagtgagctatgatcacaccactgcactccagcctgggcaacacagtgagaccacagctctaaaaaaaaaaaaagagagagagagagagagagaaaagaaagtttggcaaaggatctgcataattaatttacaaaaggaaatccaaatggctaataacacaagaaagatgtttgttcaattttactagtaattagggaaataaaaaacaaaacactaacaataaaatgtttaataaaattataatacatattatgagattattaatataacgttatagtaaaatgtgtaaatacataataaaattattattacatttaaaaggctcacattatcagactttttttcttcccttatcttctgataaaataggaatttgtatacactgctggtgggagtacaaactggttaaaaaacattttaggtagggcacagtggctcatgcctgtaatcacagcactttgggaggctgaggcaggagggtcacttgagtttaggagttcaagaccagcctgggcaacataatgagacctcatctctacgaaaaagaaaaaagttagccagccacagtggtgcacacctgtattcccagctatcttgggaggctgaagcaggtggattgcttgagcccaagagttggatcactccactgtcctccagcctgggtaacagagtaagacgttgtctcaaaaaaaaaattttagaaattaatttcttaatacttagtaatctaggagcttcagatatcttaggactcagcaattatatctctagacagtttcatttcctgctgttctccctcttcctcattctgcttcagccacattggcttccttgtggttccttgatcctttcaagcaagtgcccatcttggcactttttcattcactgttctctccattatcttgattctttacttcaggactcagctttagtgtcaccttttccgaaaagcctttcctgacccaccctatcttaaagattactcattctctatgcccacaacttgctttatgtatttgatataccttagtttactttctttctcccacccttcctgatggtagattggataattgtttttcagttaataaaattttttttttaattgagatggtgtctcgcttttttgcccaggctggtcttgaactcctgagctcaagcagtcgtcccaccttggcttaccaaaatgctgggattacaggcatgagccacagcacctggcccattgttctcaattctttactgccccatcccaatattagaattatccagccatgcctatcaccacgtgactttgcaaagcctcccactgtagttgatggaatatatttctctgctcccttgatgttagtcatatcatggcatggtttggctaatggaatgtaagcagaagtgaccatgacaatcctgagttgagaccttaaaaggcattatgtatttctactcacctctcttgtacttctgtcccccactgtgggaagaatgtatctcaggcaggcaacttgttctagaatgatgaagacatgtgaagcagatgtaaacctgacctgaagattggagtccagcctagcccagccaaacatagacaagcccagccaagatcagccaaactttgatctgcagacctgtgagtgaggaaaaaaaaaagtctgttattgtatgtcactgagaacattcgaagtatttattgtgcagcattgttgcagcaatgcagctgactaatatatacccctctggaatgtaaacttcaggacagcaaggcttttacagttttgttcactggtatgtgctcagtgagtagaacagtgtctagtatgcataggtgtttaataaatatttgttgagttaattaatgcatttgtgctaaagccataaaactactcataatcccaaagggcaaggtaaatgttcaagtgtgcaaagaaacagatataattggctctgttataaatatagtcagtcagaagctggcaccaatgtatagtgaatgaaccctgcaatcaaatcaacaagcagcttaaactggcaatagatacatatgaaactaaagaatagttgataagaggatcagaaatagaaggtcccagtagaatttcaataaaatagatatttactcaaatattaccatcacctctgaattggagactattttcaaaaatagatggggcatcagctaagtgttccaaagaataaatgaaatgggctatagtcatccatgagctggctggtggcaaaaatagaagtcaaggaggccttataaaacagcccaatgtatatagataaatcaagagagcaaatgttaaagtatatagggaaaaagtgagtttaggtgtttttgaactattataacttttctttaagtacgaaatttttcctaattttttgtaacaagtaagaaatggtggctgggcgcaggtggctcatgcctgtaatcccagcactttggaaggccgagatgggtgaatcacctgaggtcaggagtttgagatcagcctggccaacatgccaaaaccccgtctctactgaaaatacaaaaattagccaggcatggtggcacatgcctgtaattccagctattccagaggctgagacaggagaatcgcttgaatccaggaggcagaggttgcagtgaactgagatcatgccggtgcactccagcctgggcgacagagcaagactcagtctcaaaaaaaaaaaaaaaaaaaaaaagaaaagaaaagaaaagaaaaggtttgttccagtatttccagaaataaaccaaatatgactaatcctgaacatgacaacttttgtggtcttgaatgacttaagtagcaattgtctagtttttgtgtgggacaatggaacatatattgccagaatgaccataggcagattgcttcctaccggaatgaccttctcttgtctgctgtttgttctttacactgtcctttgacttaactggaggtatgttgaggaactatcatactgtttctcttggaactttattacctcccttaggtgttgtgattaagaaccacaacagttttgagcaagtagtagattctgcctctttagctgggtgtccaatgttcagaacaatcctagacaaagattcaagtacatgtatgttgtttgaaaggtacaaatggaatgctgtggggagctgatgccccaactagcatcatcaacagttcctccttttcatattttgatctccacctcaagatgtaaagctgaacataaggtgggaaagagaagaggggaagtgaggaagtgaaaaagggaagagaagggaaccaataaaggatgcattatcaagcttgcttccactatggtcaataagagcttaatcctgcagagataatggaagcaacataaaatccatgcttcagagttatacctcccacacacaggggcagggatctggttgaggactactcagagccagatattaattccttagaacatctgggccagcttagggagagaatccttccctggctccagcaaaagtctttaggaaaacagatgcagatgttggctactggaagtctgccagaaaacacacaagcgttaaggcccacaggatacaggtagagcactgaaatcatctactactaggtctgagaaggtccacaggacacacactagtgatcaaaggaactaattagcactacggcccagaaagacaactcaaattaaagatgttatatcgttctcctcttgacaaatagacatcatctaccttagttgaaactagaatgctacttcttaggacattgacattccatctgtaactactttatacatgaagattcatcctgttttctaccacattatacaatacctggccccaaatactcctttttctcatattgtattcagtcctgttattctgagatgaagaagaagagtgtgaaatgggagaaagtattgatgccagctggatgtggtggctcacgcctgtaatcccagcactttcagaggctgaggcgggcagatcacttgaggccaggagttggagaccagcctggccaatatggtgaagccccatctctactaaaaatacaaaagttagccaggtgtggtggcgcatacctgtaatcccagctacttgggaggctgagatgggagaatcgcttgaacctgggaggtgaagacttcagtgagccaagattgcgccactgcactccagcctggatgacagagcgagaccccgtctcaaaaaagagaaagtactgatgccatttggggcattaagttcagcttctatcaatgatatactgggaaagagatgagccagaaaaatgagaaactgcctcctacctgaataatcactaagaaaatcataccaggcaagtctaggaaaacttcgctacttcatatgaggaggagggagctggtctcattcttggaccattgatacagatctaccaatctatatacaatgttgacatcatgtttaccactcagaaattggccctggcttgttttattttgatctcatttccttttcattcattaatttaacaaatatttcttgagtgcttacaatggatctgagataaaaagacagactcatgctgttttctggagcttgtaatttagtggagaagcagattatgccacaaataattacttagttacaattgtgttaaatgctaagaaggacaagtatagaatactatgagtgtgtaatacagagattactcaatccatgctgaagtgtaatgtcaaggaagacttcactaaggaagatttaatctaagatttgcagagtagagtttggccaggagaaggagcagctgaagaacagcatttgcaagaaggagtttaggatgttcctgatactaaaagaaagccagcgtggcttgagagcagtagtcacagaaaagagtggcaaagatgaggctggaaggatgtgaagagcagacaaggacaagattttggaggattagggtgacagaagataacatcaatttttgctattctacatttttgccaacatttgttgttgttaatccttttaaatttagccttcctagtgaatataaaatggcacctcattatgttttaatttgcatttccctggtgtttaacgattttgagtaccttttccacacccattcgtataacttcctttgtgtctttaatttgtcctcttatttttaaaattaggttatattttattattaattgtaggagttctttatgtattgtggatacaagttctttgtcagatatgttttgcaaatcttttctcccagcttgtggcttgcctactcattttcttaatagtgtcttttaatgaccagaagttttaaaaattatattaaccatatcagtttccagttacatgcattcatcactatagatctgagttactacttgatggcacatctcatcagactgaataacttcttttaacatttcttgtggtggaggtctgctggcaatgaattttctgttcttatgtgtctgagaatggctttatttcactttaattgttgaaagataattttgctggatgtagaattctgagttgacaatattttgtcttttgacattttagcgatgtcattccattgttttctaggccccattatttccatcgagaagtcagctgatatatatatatatatatatatataatatattatatataatatatatataatatattatatataatatattatatataatatatataatatattatatataatatatataatatattatatataatatatataatatattatatataatatatatataatatatatgtatattttatatattatatatgtattatatatattatatatatacacatacatacacacacacacacatacacatataattgttcctctgtcacatgtggctttcctctggctgctttcaagactttatttttggtttcagcagtttgattacagtgtgcttaggtgtggagtttctttgtattcatcctactttgaattctttgagctttttggatctgtatgtcaaaatcttttataaaatttgatcagttttcagccattactttttcaagtatttttttctgcctcaatcctactcattctagggctcttgttctacttcttgttgttattcaacaggactctgatgctgtttgtttttcttcagtcttcttttcctctccattcttcagattggtccaattctattaacttatttccaagttcactggcacttttttcctcactgcctccaacctgctgttgagaacatacagtgaatttttcatttcatttcatttttttaattatttttttttactgctccttgtggagcagggttaacccataggccaatttttaaattttacttgttgtatttttcaattccagaatttctagtttgttttatactttctgtatccatgttaagaggctgtaactgttcattcattattcatttatcttctaagttattataaaaatgataattacttttactcaagtaaaagtaatgataacttttacttgagtatggattatattttcctgtttcttcacaggtttagtgatttttttaattgactactgtacattatgtttgatacattgtaacaacctctacacttttccatcttcctccgaagatgagtttgctctaaaagacagttaacttgcctgacctcattctccaaatgctgtctcctacacagtaggcaacaggtaaaatcttgcacagtcctttaagcttccaaatgctgtttttccataaggctctccggagtcacccccatggatatgtagtttagtcatgagccaagaatgtagtctgattttatatgcaggtcttaaagctcatctcctctgcaacccactctttttcatgatttccccctaactttctggatactctactaggctgatattttgttttttgacacatcaagccagtaagccatggctttctacttcctgagctgcatagaagctggggagttatctcaggcaaaaacccacaaacccacaaatctctgactttatagacacctttgaagggtagacttccctccagtttgtgactatttttggtcactcttcaataccttcaaagtattgcttgttgttgtgttgggttttatgcactattttctttacattttctttcttttttgcatttttaaaaattgagataaaccatataaaatttatcatttgaaagtgtacaattcaccagactttcttgacaataatttttaatagactttatttttcagagcagttttggttcacagcaaaattaagcagaagttataaagatttcccaaatacccccagtccacacacatgcatagcctcccctgttatcaataacccctaacggagtgtacacttgttacaactgatgaacctacactaacacatcattgtcacccaatgcacatagtttacatttgtgttcactcttggtgttgtacattctgtaagtttgaataaatttgtatgacatatatccaccattatagtatcttacagagtagtttcactgccctaaacatcttctggtctctgcctaatgatctctccctcatggctaactactgtcaaccactcatctttatactgtctccatagtttagccttttccagaatgtcatatcattggaatcatgcagcatgaagccatttcagactggcttctttcacttagtaatatgcacttaagtttcctttgtatcttatcatggcttgatagctcatttccttttagcactgagtaatgttattttgtttggatgtatcagagtttatttatccatttgcctaccgaaggacattttggttggttccaagttttggcaattataaataaggctgctatgtgcaggattttgtgtggacataagttttcaactcaactgggcaaataccaaagggcataattgctgaattatatggtaatggtatggctgttgctatggggttgttttggggatatatgggaaatctctgtagcttctgcttaattttgctatgaacctaaaactgctctaaaggttaaagtctattaaaaatgattgtaaaaaaacccaactgaatcatacacttttgaatggtgaattttatctcaaattttaataaatgcaaaacaaaaaaagaaagaaaatataaagaaaaccgtgcataaaaaccaaacaacaaccaccaccaccaattcattgaaactaccaaactttcttccaaagtggctgtaccattttcatccctacctgcaatgcataagagttcctattgctccacatccttgactgcatttggtgttgacagtgttctggattttggctaatgtaataggtgttgtggtgtttcattttaatttccatttccctgatgacataggatgtggaatttttttttattatactttcagttctagggtacatgtgcacaatgtgcaggtttgatacatatgtatacatgtgctatgttggcgggctgcacccattaactcgtcatttaacattaggtatatctcctaatgctatccctcccccccccgactccccccaccccacaacaggccctggggtgtgatgttccccttcctgtgtccaagtgttctcattgttcaattcccacctatgagtgagaacatgcagtgtttggtttttggtccttgcgatagtttgctgagaatgatggtttccagcttcatctatgtccctacaaaggacatgaactcatccttttttatggctgcacagcattccatggcgtatatgtgccacatttccttaatccagtctatcattgatggacatctaggttggttccaagtctttgctattgtgaacagtgctgcaataaacatacgtgtgcatgtgtctttatagcagcatgatttatactcctttgggtatatacccagtaatgggatggctgggtcaaatggtatttctagttcctgatccgtgaggaatcgccacactgacttccacaatggttgaactagtttatagtcccaccaacagtgtaaaagtgttcctatttctccacatcctctccagcacctgttgtttcctgactttttaatgatcgccattctaactggtgtgagatggtatctcactgtggttttgatttgcatttctctgatggccagtgatgatgagcattttttcatgtgtctgttggctgcataaatgtcttcttttgagaagtgtctgttcatatcctttgcccactttttgatggggttgtttgtttttttcttgtaaatttgtttgaattcattgtagattctggatattagccctttgtcagatgagtagattgcaaaaattttctcccattctgtaggttccctgttcactctgatggcagtttcttttgctgtgcagaagctctttagtttaattagatcccatttgtcaattttggcttttgttgacattgcttttggtgttttagacatgaagtccttgcccatgcctatgtcctgaatggtattgcctaggttttcttctagagtttttatggttttaggtctaacatttaagtctttaatccatcttgaattaatttttgtataaggtggaaggaagggatccagtttcagctttctacatatggctagccagttttcccagcaccatttattaaatagggaatcctttccccatttcttgtttttgtcagatttgtcaaagatcagatagttgtagatatgcggcattatttctgagggctctgttctgttcctttggtctatatctctgttttggtacaagtagcatgctgttttggttactgtagccttgtagtgtagttcgaagtcaggtagcgtgatgcctccagctttgttcttttggcttaggattgtcttggcaatgcgggctcttttttggttccatatgaactttaaagtagttttttccaattctgtgaagaaagtcattggtagcttgatggggatggcattgaatctataaattaccttgggcagtatgaccattttcacgatattgattcttcctacccatgagcatgttcttccatttgtttgtctcgtcttgtatttcattgagcagtggtttgtagttctccttgaagaggtccttcacatcccttgtaagttggattcctaggtattttattctctttgaaacaattgtgaatgggagttcactcatgatttggctctctgtttgtctcttattggtgtataagaatgcttgtgatttttgcacattgattttgtatcctgagactttgctgaagttgcctatcagcttaaggagattttgggctgagacgatggggttttctagatatacaatcatgtcatctgcaaacagggacaatttgacttcctcttttcctaattgaataccctttatttccttctcctgactgattgccctggccagaacttccaacactatgttgaataggagtggtgagagagggcatccctgtcttgtgccagttttcaaagggaatgcttccagtttttgcccattcagtatgatattggctgtgtgtttgtcatagatagctcttattattttgagatacgtcccatcaatacctaatttattgagagtttttagcatgaagagttgttgaattttgtcaaaggccttttctgcatctattgagataatcatgtggtttttgtcgttggttctgtttatatgctggattacatttattgatttgcgtatgttgaaccagccttgcatcccagggatgaagtccacttgttcatggtggataagctttttgatgtgctgctggatttggtttgccagtattttattgaggatttttgcattgatgttcatcagggatattggtcttaaattctctttttttgttgtgtctctgccagactttgttatcaggatgatgctgccctcataaaatgagttagggaggaatccctcttttactattgattggaatagtttcagaaggaatggtaccagctcctccttgtacctctggtagaattcaggtgtgaatccatctggtcctggacttcttttggttggtaagttattaattattgcctcaatttcagagcctgttattgatctattcagagattcaacttcttcctggtttagtcttgggatggtgtatgtgttgaggaatttatccatttcttctagattttctagtttatttgtgtagaggtatttatagtattctctgattgtagtttgtatttttgtgggatcggtggtgatatcccctttatcattttttattgcatctatttgattcttctctcttttcttctttattagtcttgctagtggtctatcaattttgttgatcctttcaaaaaaccagctcctggattcattgattttttgaagggttttttgtctctatttccttcagttctgctctgatcttagttatttcttgccttctgctagcttttgaatgtgtttgctcttgcttctctagttcttttaaatgtgatgttagggtgtcaattttggatctttcctgctttctcttgtgggcatttagtgctataaatttccctctacgcactgctttgaatgtgtcccagagattctggtatgtcgtgtctttgttctcgttggtttcaaagaacatctttatttctgtcttcatttcgttatgtacccagtagtcattcaggagcaggttgttcagtttccatgtagttgagcggttttgagtgagtttcttaatcctgagttttagtttgattgcactgtggtctgagagacagtttgttgtaatttctgttcttttacatttgctgaggagtgctttacttccaactatgtggtcaattttggaataggtgtggtgtggtgctgaaaagaatgtatattctgttgatttggggtggagggttctgtagatgtctattagatctgcttggtgcagagctgagttcaattcctgggtatccttgttaactttctgtctcgttgatctgtctaatgttgacagtgggatgttaaagtctcccattattattgtgtgggagtctaagtctctttgtaggtctctaaggacttgctttatgaattttaaaaatattttttaatatattttttgccgtctgtgtatcttctttagtgaggtgtctgttaagatctttggcccatttttaaattaggttatttgtttttttattgtgaagtttcaacaattctttgtatattttgaataacagtcctttagcagatatatttttgcaagtattttcccccagtgtgtgacttgcttttaatataaataaatatatataaacatatatatacatatacgtatatatacacacatacatatatacatgtatacatatatatatttaaagacaaggtcttgctctgttgccctggctatagtaaagtggtgccatcataactcactgcagcctttaactgctgggcgcaagcgatcctcccatctcagcctctggaatagctgggactacaggtgggacatgccaccatgcctagctaatttgtgtatttttgtagagatggggtttggccatgttgcttttattctcttgacagtgtctttcacagagcagaaagttctaatgaagttcagtttatcaattatttatttcataaatcatgcttttggtgtgtctaaaaagacatcatcatacccacagtcacttagatttttttctatgttatcttctaggagtcctatagttttgcattttacatttaggtctgtggccaattttgaattaatttttgtgaagggtattatgtctgtatctagattcaatttttttgcatgtgtatgtccagtgatttcagcactatttgttgaaaagattatctttgatccattatgttatctttgcttctttatcaaacatcagttggctgtgtttatgtggctctatttctgtgttctctaatctgttccattgatttatttgtttattttttcacgaataccacactgtgttcatcactatagcttcacagtaagtcttaaagtcagctagtgtcagttttctaactttgttcttctccttcaatgttgtgttggctattctgggtctcttctccatgtaaactttaggataaatttgtttacatctacaatataacctgcttggattttttttccagtttttttattgtggtaaaatatacacaacataaaatttgccatcttaaccacttttaagtgtacacttcagtgttaaatatcttcataatattgtgcaaccatcaccatcatccattgataactctgcatcttgtaaactcaaaactctatacccgttaaacaataaccctccattctccacttcccccaactcctagaaaccacctttctattttctgtctctatgattttgactactgtaaatatctcatgtaaacagaatcaaacagttttagtgaatggtgcatttcacttagcatactgtcctcaagtttcattcatattatagcatgtgtcagaatttccttcctttttaggagtgaattatgttccattgtatgtatatatcatattttgcgtattcactcatctgttgatgggtacttgggttgcttccatggtttagctattgtgaatactgccactatgaacaacagtgtacaaatgcctcttcaagacccttctttcaattattttgggtatatactcagaagtggaattgctggatcatatggtaattctatttttaattttttgagtaacttccatactgatttaaacagtggctacaccattttacattccatcaacagtgtacaagagttccaatttctccacatccttgccaacattttaatataataaccgtcataatgaatatgaagttgtatcttactgtagttttgatttgcatttccctaatgactgagatgttgtgcatctttttatgtgcttgtcagtcatttacatatcttcttcagaggaatgtatactcaagtcttttgcccacttttgaattgggttgttaggatttctgatgttgagttctgtattgttttattatctcaaaagtttaaataagatggtctgctgctatacttgttcttgctgtccactgtattagcactttccctgatgtgctttggaagttgatccatgaatttcttaaactttttgctggaattcctttaaaggggtctgattagatggtgaaaagtagactgagacaaccttcaagtgaccatgtcattgttttcttgctatgtctttggcttgatgattaagatacaattctttttaaaaccaaatggcatttgttattatgtttcccaaattaggaatctattttagttaatattttaaagaaacacaaaggcataacaaatactatcattgtttttactccagagtgttaatgaatgtaaagaggttagagagatgtagtgtttaattaatgatgcttattttaactatatttaacatgagtgatttttcattgtctttaaagaggaataatgcttattgattaaaggtgagaaattatggttaagacactgattctgtgtcaaggtctttgactacattatgcattgtgcaaataatttcatttttcatgaatgccttagttttcctactataaaataaagacaatgatgaataaaaaagaagaagaagtttctctacagattctggatattaaccctttatcagatatatgacttgcaaatatagtctcccattctgtggattgcccttttactctatttatattgtcatttgaggcagaaaaattttaaattttcatcaagtccaaattgtctatttttttatttttcttcctcttgttctttgtctttttttttatgagtcagggtctcactatttttcccaggcaagtctcgaattcctgggctcaactgatccacctgcctcggcctgtcaaagtgttaggattacaggcatgagctactgtgttcagcctccacttttttgttgttgtgtcctgtgtttttggtgtcatgtccaagaaatccttgccaaatccaacgttgtggaacatgttccttacatttttcttctaaaaaatattttatagttttaggtatttaatccatgttgagttaatttttgtatacagtgttagataaggatccaactccattcttttgcaagtggatgtcgagtttttctagcaccatttgttgaaaagaccatatatatgagggtttatttctgagctctctattttatttcatgggctacatgtctgtctttacgccagtaagttttgaaatcaggactcgtgagtcctccagctttgtctgtctttttcaagattgttttcgctatttaaagttccttgagattccatatgaattttagaatgggtttttctatttctcaaaaaatgtcattgggattttgatagggattgcattgaatctatagatcactctggacagtattgatcttaacaatattacatcttccagtccatgagcatttatttatatcttctttaacttatttgagtaaattttgcagttttcattatacaaatcatttacctccttgggtaagttatttcctaagtattttattctttttgatgctattgtaaatggaattgtatttataatttccttcttagattctccttctccttcttcttcttcttttgagacagggccttggctctgtagcccaggccggagagctgtggcatgaccacggctcactgcagccaccacctcccaggctcaagcaatcctaacacctcggcctcaagagtagctgggactacaggcacgcagtatttagcctaattttttcaatttttttgtagagacagtgtctcactaagttgcccaggctggtctcaaactcctgagctcaatgaccttccacctcagcctcccaaagtgatgggattacaggtgtaagccaccacacccagcttcctcattgttaatgtatagaaaggcacctgattttttgtgctgactttgtatcctgctactttgctgaattcatttattagctctaacagttgtgtgtgtaatccttagggttttctacatataaaatcattcatctgcaaacacagataatttaacttcttgctttctgatttggaagccttttatttctttttcttgcctaattgctccagctagaacttagtactatgttgatagacgtggcaaaagtgggtaaacttgtcttgtacctggtcttggaggaaaagctttcagtttttcaccactgagtatggtgtttgctgtgggtttttcacacatagcttttattatgttgaggtaatttccttctatttctagtttgttgagtgtttttatcatgaaagggtgttggagtttgtcaaatgctttttctacatcagtcaagatgatcatgtgctttttccattcattctgttaatgtggtgtattccattgattgattttcatatatggaaccattgttgcattccagaaaaaaaaaaaccacatggccatggtgcatattccttttttatacgttactaaattcggtttgctggtattttgttgaggattttatatcaatgctgatatggttcggatgtgtgtcctccttcaagtctcatgctgaaatgtgatccccaatgttgcaggtggggccaagcactattcccttggtgatgagtgagttctcactcagttagtttacatgagagctggttgtttatttttttgtttatttaatttttttactcagatcatttcttctccagaatttttcatttggtcgtttaaagaatcctggctcctcctcctctctcactccctctctcaccatgtgatacaccagctcccgctttgccttcctaaggcctcaccatagacagatatggcactatgcttcttgtacagcctgcagaaccataagccaaaataaacctctttctttataaattgcctagtctcaggtattcctttactgcaacacaaaacagactgacacaaatgttcataatactttaatctctgaaagttataatgagttataacactctaatttgaactataccagcttaacttcaataacatgcaaaaattctactcctttacagctctgtctccaccctttggttgatgatgtcacaaaattatattttacagattgtgtgccccaaaatataaactaacaagtctttttttttttttttaatggagtctcactctgtcgcccaggctggagtgcagtggtgcaatctcagctcactgcaacctctgcctcctgggttcaagtgattctcccacctcagcctcccaagtagctgggattacaggtgcccactaccgcgcctgcctaatttttgtatttttagtagagatggggtttcaccacattggccaagttggtctcaaactcctgatcttaagtgattttcccaccatggcttcccaaagtgctgggattacaggcatgagccgccatgcctgaccataaatgaataattcttttaaatgcactactctcttaaattgtgtagaaaacacaatatggggttgtaaaccaaagttacaataatactaaaaagtgttagtcttttaaagcatgtagaaaacaaaaagtgaagttacaaaccattgttataataatactagcttttataattgccataaatttacctttatttagatctgtatttgttcatatggctttgagttactgttgagtgtccgatcatttcatcctgcaggactcccttgagtgtgtttttcttattttgtctcactagtgatactttgagcatttcttgcagggcaagtccagtggtaacaggctccctcagtttttatttacctggaaaggtcttaatttctgcctcacttttgaaggacagttttgctgaatataagattcttggttgacagactttcccctgcctgccttttagcactttgaatataatggcccacagccttctgaccttcaaaggtcctgatgagaaaccttctaataatcttattgaggatcccttatatgtgataagtcacttttctcttgcttctttaaatattctctcattgtttttggtttccaaaagtttaattacaatgtgtctcagtgtggatctctgagttcatcttacttagagttttttgagcttcttggatgtttatactcatgtctttcatttaatttgggaagttttcagtcattatttcttcaaatattctctctgccccaactctctctctctcctctttctgaaattaccataatacacacttttgtccacttgattgtgtcccacaggtccctttggctcacttttcttcaatctttattctttctgttcctcagactcaatactttccattgtccttcttcacattcactgattctttcttctgcctacacaaacctgccttttctttctttctttttttttttttttttgagacaggatcttgttctgtcctcttagtaaaatttttatttcagttattgtactttcaactttagaatttctttttgggccgggtgcggtggttcacgcctgtaatcccagcactttgggaggccaaggcgggcgaatcacaaggtcaggagattgagaccatcctggctaacatggtgaaacccggtctctactaaaaaaaaaatacaaaaaattagccaggcatggtggtgggtgcctgtagtcccagctactcgggaggctgaggcagcagaatggcatgaacccgggaggcagagcttgcagtgagccgagattgtgccactgcactccagcctgggcaacagagcgagactccgtctcaaaaaaaaaaaaaaaccaaaaaacggctgggcgcggcggctcacacctgtaatcccagcactttgggaggctgaggcaggcggatcacgaggtcaggagatcaagatcatcctggctaacaaggtgaaaccccatctctactaaaaatacaaaaaattagctgggcgtggtggcgggcacctgtagtcccagctactcgggaggctgaggcaggagaatggcgtgaacctgggaggcggagcttgcagtgaaccgagttcacgccactgcactccagcctgggcgacagagcgagactccatctcaaaaaaaaaaaaaaagaattcctttttggtttctttttaggtttgctgtttttagattaatatttccattttatttatacattattttcttgattttttttccccacatcttcctttagtgatttgagcatctttaagacagttgttttagaagaatcatttgaacccggaaggcagaggttgcggggagctgagatcacatcactgcactccagcctgggtgactgagaaacactatctcaaaaaaaaaaaaaaagttgttttatttatttatttatttatttatttatttttgagatggagttttgctcttgttgcccaggctggagtgcaatggtaggatctcagctcaccgcaacctccaccttccaggttcaagggattctcctgcctcaaccttcttagtagctggaattacaggcatgtgccaccacgcctggcaaattttttgtatttttaatagagatggggtttctccacgttggtcaggctgctctagaactcccaacctcaggtgatccgcctgcctcggcctcccaaagtgctgggattacaggtgtgagaaaagacagttgttttaaagtctttgtttggtatgtttgctatcaggtctttttcaggcacaatttctgttgctttattattattattttttgaataggccaaacttttctgtttctttgtataacttattttttttttgttgaaaactggacagttggatctaataatgtggttaactctggaaagaagatgctctccctttcctacaatagcaggtaaccatcctccacccctgagccacttggcaggcagtttgtgcatgtgttcctagagcaccttgcaaacatcatgcgggagcccaggtggggaaaaaggtccctgtccttcaaatattaggcatctaagccatgattgctgattaccgcttctgatcatagaggtgcagacaaagaggttggctgccaaggtttgctatttttattactgtttatttttatttgggtaggcagtctctgtgccaagaatcatctgagatgtgaatttttttagtttttttttttttttgagacagagtctcactctgttgcctaggttggagtgcagtggcgcgatcttggctcactgcaacctccatctcctgggttcaagtgattctcctgcctcagcctcccaagtagctgggactacaggcacatgccaccatgcctggctaattttttgtattttttgtagagatggggtttcaccatgttagtcaggatggtctcgatctcctgacctcgtgatctgcctgccttagcctcccaaagtgctgggattacaggcgtgagccaccaggcctggcaaatttttttaacttttaagttcaggggtacatgtacaggtttgttatacagctaaacttgtgtcatgaaggtttgttgtacagatcatttcatcacccaggtgttaagcctagtatccattagttatttgtcctaatcctctccctcctcccaccctccaccgtctggtaggccccagtgtctgttcccctctatgggtccatgtgttctcatcacttagctcccatttataagtgagaacatgtggtatttggttttctgttcctgtgtttgctaaggataatggcctctagcttcatccatgttcctgcaaaggacctgatcttgtccttttttatggctgcacagtattccatggtgtatatgtaccatcttttctttatcagtctacctttgatggacatttatgttgattccgtgtctttgctactgtgaatagtgttgcaatgaacatatgcatgcgtctttttttttttttttttgagatggagtttcactcttgttgcccaggctggagtgcagtgccgcgaactcagctcactgcaacctccgcctcccgggttcaacgattctcatgcctcagcctcccgagtagctgggattataggcaccggccaccatacccagctaattttttgtacttttagtagagatggggtttcgccatgttggccaggcaggtcttgaactcctgacctcagatgatctgcctgcctcggcctcccaaagtgctgggattacaggcgtgagtcaacacacccggcctgcatgtgtctttatgatagaacaatttctattcatttgggcctatatctaataatgggattgctgggccaaatggtagttctgtttttaggtctttgaggaaccaccacactgctttccacaatgggtgaactaatttacactcccatcaacaacatatacatgttcctttttctctgcaactttgccagcatctgttattttttgactttttaataatagccattctgactggtgtgagatggtatctcattgtggttttgatttgcatttctctagtggtcagtggtgttgagttttttctcatatgcttattggccacatgtatgtcttcttttgaaaaatgtctatttatgtcctttgcccactttttaatcgttttttttccttgcaaatttgtttaggttccttatatatgctggaaatcaggcttttttccagatggatagtttggaaaattttctcccattttgtaggttgcctgtttactctgttgacagtttattttgctgtgcagaagctctttcatttaattagatcctatttgtcaaattttgcttttgttgcaattgcttttggtgtctttgtcatgaaatcttttcccgttcctgtgtacagaatggtaattgcctaggttgtcttccagagtttttatagttttgggttttatgtttaagaatttaatccaccttgagttgatttttgtatacgatgtaaggaaggggtccagtttcaatctctgcatatggcgagccagttatcccagcaccatttattgaatagggagttctttccccattgcttgtttttgccagctttgtcaaagatcagatggttgcaggtgtgccaccttatttctgggctctctattctgttccattggtctatgtgtctgtttttgtaccagttgatgtagaaacttaaggtcctctcagatcttttctgagtttttccctgtgcattcatggtcactttctgcttttccccatatatatagttatgtttcaatgtcttagtctttcaagtctggatcccaaaagaagaaaaaagagaaaaatgaaggggagaaagaaagggcatcaaccacttaaatgccagtcctttcaatcccttggaagtcacttcagctggagtgggaggggcttgcaacaattggggaagatgcaacaacaatggcagccaacctctttgtctgcacctctatgatcagaagcagtaatcagcaatcatggcttagatgcctaatatttgaaggacagggacctttttccccacctgggctcccacaagatgtttgcaaggtgttctaggaacacatgcacaaactgcctgccaagtggctcaggggtggaggatggttacctgctattgtattcaggagctgaatttgaccaaatttatactcactttagcatccaagccttctcctggatggtgcaagccttcagtagactctagaatttcaaaatagtttcatcagacaaattctgccagtgcaattgttgttaggttgggagacagattcctggtgccttctattctgtcatcttcccagaatcctgtatcaagtagctgggattttaactgggaatgtattgaatctataaagtcaggaagaattgacatcttaataatattaagtcttcctcagtatggcgattcctcaaggttctagaactagaaataccatttgacccagccatcccattactgggtatatacccaaaggattataaatcatgctgctataaagacacatgcacacgtatgtttattacggcactattcacaatagcaaagacttggaaccaacccaaatgtccatcaatgatagactggattaagaaaatgtggcacatatataccatggaatactatgcagccataaaaaatgatgagttcatgttctttgtagggacatggatgaagctggaaaccatcattctcagcaaactattacaaggacagaaaaccaaacaccgcatgttctcactcataggtgggaattgaacaatgagaacacttggacacaagaaggggaacatcacacacggggcgtgtcatggggtgggggaggggggagggatagcattaggagatatacctaatgtaaatgatgagttaatgggtgcagcacaccaacatggcacgtgtatacctatgtaacaatctgcatgttgtgcacatgtaccctagaacttaaagtataataaaaaataatataagtcttcctattcatgaacaataaatagctcttgatttatttctttgatttcttccatcagagttttgtattttccctcatatagattatatgcatattttattagatttatatctaagtatttcatttttggtggtgctaacgtaaatggtacgatgcttttaatttcacattctactagtttactgccggtatatttagctggtatataggatagtgattgaaatttttatattgactttgtatcctgcaatcttgctataattgtttattagttccagaaggtttttttgtaaattcatttggatttttacatagaaaatcatgtcttctgtgaacaaagacagtttttatttcttctgtccaaatctatataacttatttccttttcttttcttatttcattagctaagagttctagtacaacattgaaaaggagtggtgaaagggaacattctggcctcgtacctgatcttagcaagaaagcttccagtttcttaccttaagtatgttgttagcttcaggctttctgtagatgttctttatcaagttgaagacattctcctctattcctacttcaatgaaagttttttttttttttgagatggggcctcaccgtgaacccgggaggcggagcttgcagtgagccgagatcccgccactgcactccagcctgggcgacagagcgagattccggctcaaaaaaaaaaaaaaaaaaaaaaaaaaaagagatggggcctcactttattgctcaggctggaattcagtggcgtgatcatggttcactgcagcctcgacctcctgggctcaggtgatacctcctgaggagctgggactataggtgcatgccaccacacccagataatttttggattttttgtagacaattttcgccgggtgcagtggctcacgcctgtaatcccagcactttgggaggctgaggtgggtggatcacctgaggtcaggagtttgagaccagcctggccaacatggcgaaaccccatccctactaaaaatacacaaaattagctgggcatggtggtggatgcctgtagtcccagctactcaggaggctgagtcaagagaatggtgtgaacccgggaggtggagcttgcagtgagccgatatcgcgccactgcactccagcctgggcgacagagcgagactccgtctcaaaaaaaaaaaaaaaaaaaaaagaaagaaagaaaggaaacaaggagacaatagaggacagacagggcaagaagcattaaaagatattcttcttagtaaatatgaattaacagagaccagttttaaagtacgaattctctaagaggatagttaaaatttcagtcataccttaaatcagattattcaaatcaatcatatagtgatatactgaaatattactaagcagacgctttgatagttaagaaaagagaaggaagaagaaactttgcaaaggaaaggtctagataggggaagaattttgacagctttcaggcaggatgaaggggctaattacctggaggacagggatactgaaaaagcatgaaggcatgaaggagattgttaatgacaaactttacctcctttataattttgcctaaaaccatggaggcatcagatgtttgactggcttgaaaacctgtaactttcattttcttttattcatacctgcattcccatgcatcgtatttaaataaatattcttaaaaagtaaaaacgaaaaatgaaatttcctcagccatttatattcctttgactctagcctcttgtcataaatgcttagctttactatcttccttcttttctcgtcctcttttactttttgctgccccattctttgatggaacaaaatcctatttccttctattttttttacacacagcaattcatgtttctctagtctttatcccaaaatcagctctggggctatggagattcaaaagctcagctaattatttgaaaaccttgtgtttcaaactctggccattagaaaagatccataccctctaataccctagtattagaggaggggtttattctgttattacattttctctttggagtgttttgcaaagctgctgcacccattttttttctaagagtagactgaaaaaaagaccaaacacattattaattgtggtaattttcttgcttatctttctgttctgggaaatgactatagcttttctgcctttagaggggtattagctccactgctctcttcaagctgtgcttttggatttgtgccaggccttactgggtagctaagctagttcaaaggggcagcatatgcagtaagatctatggaagaagcagtacttccagggtatcggttgttacatcttcctcttctacctcactaccctaacttaccatcagaactaagaagaaactttacttatatggatgaacaaaagaacaaaataatcaacactcaaaaatcagaaactaatttaaaaattagcaatataaccaattagaaaatgtaacaataaactatattcaaaatagtaaagaataaaacacccaagaataaaaataactgtagaagatatatatgaagaaaactttaaaactttcctacaggacataacaaaagactgatttcaatagtggcataccacataatcactttctttcctcctctacagctagagataactatacgatatatttctgtccaatgagacaatagagtaaacgtgtatttgctttgtaaacactaatagtgctgctctcagctttttcctttttgttttgagatggtctcgttctgtcacccaggctggagtgcagtggtgcttgatcatggctcactgcagcctcaacctcctgggttcaagcaatgctcctgcctcagcctcctgagtagctgggacttcaggtacatgccaccatgcctggctaattttttttttttttttttttgagacagaggctctctcttgttgcccaagctggagtgcagtggtacgatttcggctcactgcaacctcccctcctgggttcaagtgattctcctgcctcagcctcccgagtagctgggattacagacatgtaccaccacgcctggctaattttgtgtttttattagagaaggggtttctccatgttggtcaggctggtctcgaactcccgatctcaggtgatccgcccagctccgcctcccaaagtgctgggattataggcgtgagccattgcgcccggcctgcctgctaatttttaaattattttttgtagagacagggtttcactatgctatccaggctggtcttaaactcctgggctcaagtgattctcctgcctcagcctcccaaatactgtgattacaggtgtgaaccactgtacccagcctcctctggtcttaaatgctattgtgatggccagagctgcaacagtcatcttggatgtatgaagaaaaagcatgaagtcaagagccaacatactgaggatggaagagcagaaatacagaaaaaccgttaagtcctcaatgacagtgttgagcaggggaaactgccaagaactacctacttccagaattcttgttatatgagaaaattaaagccatattttcaaagccagtattagttggattgtctattacagggagctacatacttttctagcaaagtgtaaatactacaaaagacaataagtctaatatcagccaggtgcagtggcacatgccaataactcaggaggctgaggtgggaagactgcttgagcccaggagttcaaatccagcctgggcaacatagcaagaccccatctccatacttgatcttagccaaaaggcgataagcagtaagatccgatttctaaaaaaaaaataaaataaaatcagatgatggaagacaaaaagaataaagggaaagaacaggaaagattccattatcaattgcgtccttctcataacagtcattagatcaatccaaagaaaatgatcattagggcatatataaagttattataaatgcattcaatagaaaaaattcaaacattctaaattatcggaataaatataaacaaaaacaaaggaaaggaaacacagaccacattttgaaaataattaaggctatagacatgaaaagcatatcccaataatatgatatattccaaaccaaatacaatttgtgtaaataaatgtgaatacttgggagtctctctaagccttctctggctagaagggctgcccataaaaaaatttaaaaacatttttaggctggtcaccgtggctcacacctgtaatccctgcactgtgggaggtcaaggcgggcggatcacgaggtcaggagatcgagactatcctggctaacatggtgaaaccccatctctactaaaaatacaaaaaattagccaggcatggtggcgggcgcctgtggtcccagctactcaggaggctgaggcaggagaatggcatgaacacgggaggcagagctggcagtgagcaaagatggcgccactgcactccagcctgggcgacagagcaagactctgtctcggaaaaaaaaaaaaaaaattagctgggcgtgttggcacatgcctgtagtcccagctacttaggaggctgaagcaggagaattgcttgaatccgggaggtagaggttgcagtgagccgagatcatgccattgcactccagtctgggtaacagaacaagaccctgtctcaaaaaagaaaaaaaaattaaaaattaaaaattaaaaaaagtgaatacttaatattacctagtaggctgggagcagtggatcatacctgtaatcccaacacactgggaggctgaggtgggagaattgtttgtggccaggagttccaagaccagcttggagcaacatagcaagaacctatctctataaaaaaaaaaaaaaagtatatataaaaggaaaaattgacaaattgcatttcatgaaaatcaaaaacttctgttctgtgaaagaccccattaagaagaggaagaacaagctatagagtggaagaaaatatttgcaaaccacatctgacaaaggactaggatatataaagaactttcaaaccccagcaattaaaaaagcacacaaaggaaacaatccaatgagaatgggcaaatacatgaacaggcatctcaccaaagaggatatacagatagcaaataaacacatgaaaagatattcaacatcaatagacattagaaaaatgcaaattaaaaatcacagtgagacattactacacatctattggaatggctaaaataaaaactagtgatatcaccaaatgctttgaaggatacagagaaaccagattatacagatattactggtgagaatgttaaatagtacagccactctagaaaacagtttggcagtctcttataaactaaacatgcaattactatataacccagcaactgaactcttgggcatgtatcccagagaagagaaaacttatattcacacacataaaaacatgtacatgaatggtcatagcagttttgttcataatagccccaaactggaaatactctaaatgtccttcaatgagtgaatggttaaactgtggtacataaataccatggaatactactcagcaataaaaggaacaaactattgatacacacaacttcgatggatctcaaggaaattatgttgagtgaaaaggccaaacttaaaggttttatatttatgattccatttataaaacagacttgaaatgacaaaatatgagagataaagaaagaatgtgtagctgtcaagggttaggaattgggggatgggagaaggataaaagggagttgtggttattaaagaacaggaggagatccttgtgttgatggaactgttctgtatcttcactgtggttgtggatacacaaacttacatgtaatcaaactgcatagaattaaatacaattaagcttctagaagaaaacagttatctccatgacatcagggtaagcaaagatttcttaaacaggacccacacataaaaataacagtaaccatgaaagatcatttgatactttggatttcgttaagattaagaattttttttttttttagatggaatcttgctctgttgcatggactggagtgcagggacacaatctccgctcactgcaacctctgcctcccaggttcaagtgattctcctgcctcagcctcctgagtagctgagattacaggtgtgcaccaccacactcagctaatttttgtatttttagtagagaccgggtttcgccatgttggccaggctagtctcaaattcctgacctcaaggaatccacctgccttggcctcccaaagttctgggattacaggcgtgagccactgcgctggccaggcaaatattaaaatttttgataagacaatcttagagtggggaacataaattggcactgcctctacagagggaaatttaacagcaacaagagaaatgtttaaatgtttaaaatatactctttaattcaattcctaggaatttaatcctatagataaattcatacatatggaaagtgatttgcatttgtagtcattcacttcaggattattggtaaatctgtaaacaacttagtctatcatagaagactgaaaaataaattattatttattcagtcaatagaataccgttaaactgttgagaaaaaggaagctttttttttttttgagacggagtttcgttcttattgcccaggctggggttcaatggtgtggtctcggctcactgcaacctccatctcctgggttcaagcaattctcctgcctcagcctcccgtagcagggattacagatgcctgccaccacacctggctaatttttttgtatttttagtaaagacggggtttcaccatgttggccaggctggtcttgaactcctgacctcagatgatctgcctgccttggcctcccaaagtgctgggattacaggcgtgaggcacggcacctggccaaggaagctttttatgaatcagtaaggaagtgttaaagacaaaaaaaaaatttaaggtgagaaaacaattatatgtattatatattttttatttaaaaaattttaaagtttaaaaatgtttaattttaggggcagggtcctgctgtgtcatgcaggccagagtgcggtggcccaatcatagctcactgcagcctccaactcctgggctcaagcaatcctccctcctcagtctcctgagtagctaagatgacaggcgtgcaccaccattcccagctaattttttaaaaaatattttgtatgtgtggctgaggaatttacgtggaggtcagagtggaagcaagtgtgagagggtccagcagaaggaaacatggctgccaaagtgtttgagtccattggcctggccttagttgttgcaggaggcatggtgaactctgccttgttgcaggaggcatggtgaactctgccttatataatgtggatgctgggcacagagctgtcctctttgactgattctggggtacaggacattgtggtaggggaaagaactcactttctcatcccatggatacagaaaccgattacctttgtcattctcgaccacgtaaggtgccagtcatcacagtagcaaagatttacagaatgtcaataccccactgcgcatcctcttcctgcctgtccctagccagcttccttgcatcttcaccagcatgggagagggctgtgatgagcctgtgctgccatccatcactacagacatccttaagcaggtggtggttcgctttgaggctgcagaagcaatcacccagagagaggtggtctccaggcaggtgaaggatgaccttatggagcagtagccacattttatttagctcatgctggatgacacctcctcgacacatctgacctttgggaaggagttcacagaagcagtggaagccaaacaggtggctcagcaggaagcagagagggccagatttgtggtggaaaaggctgggcagcagaaaaaggcaaccatgatatctgctgagggcgactccaaggcagcggagctgaccgccacctcactggccactgtggggacttgcctgatggagccatgccagccagaagccactggggataccacgtgccagctcttatgctcctgaggcggggcagtacctgctcctccagctgccccagtgaggccccacctgcctgcatctatgcgggccaactgggccacagccccgatgattccaaacaccgccttccttctctccctaccccaggaatcactgtgaaatttcatgattcgcttaaagtgaaggaaatgaaagtaaattacttcaggctgggagcagtggctcacgcctgtaatcccagcattttgggaggctgaggtggtagatcacttgaggtctggaactcgagaccaacctggccaacatggtactacaaatacaaaaattagctgggcgtagtatgcctgtagtcccagctactcgggaggctgaggcaggagaatcgcttgaacctgggaggcagaggttgcagtaagctgagattgcaccactgcactcctgggcgacagagcgagactccatcaaaaaaataaaaggacagggtcttgttgtgttgcccaagccaatcttgaactcctgacctcaagtgatcctcctgcctcggcctcccaaagtactgagattataggacttagccagacatacatacatacatatatataatatatatatcataatatttatatatacacaaacatacacatatatacaccacacatttttaaaggtaaaaaagaattgtacatatatatatacactttatatgtatatatacatttatagctgaaaatgcattgtatttgtatatatacatatacttatatatgcatatatgtaaatatgtaaaatataaaattttgattaaaaggaagacataagtggttaaaaaaaaacacacaaaaaccaagcctatccccttacttctagactgcttctcttcacttcatactgtgtatcacttggtcaattcctaaaatgccagccttcatcagtttgttgttaaaatgtaaaattgtgattcagtagattctgggcgagattggtgggattgggatctgaggttctgtgtttcctttttttttttttttttttggaggcagggtcttgctctgctgctcaggctggagagcatagtggtgcaatcacacctcactgcagcctcaacctaccctcccacctcagcctcccgggtagctgggactataggcaagtgccaccatgctccgctattttttgtagaggtggagtttctttcaccatattgcccaggctagtcttgaactcttgagctcaggtgatctgcctgcctagggcctcttgtggattacaggtgcgagccaccatgcttggctggttctccaattctaacagctcctacgtgatgcttcttttgagtaggaaagagctagaatgtacagcctttgaattcacatcacatttactatatgcaactttgttttataatgtgtgaataccttgcctactcacttgtattttaaattccaagaaagcttctagcagcacttgaacagctgattattctttccttctcaaaacattttttctttctgcttccttgacattacagtcccctacttttgcttgtacctcaatggcctcacctttcagtctttgcatgtgcttaataagtaagtaaatctttatgtagactcattacctattattaagtataatatatactgaagtgaacaccatgccatagctcctgaatggttctagagagcctttctcagactgtgtccctcaataagagtttacatattttgtaggtaggacaatagccttatgaatgaagtcttggtgatgcagccagaaactcagagactctaagtcaaatactcattggttagatcaaatataattttgccatagtctgaggattacagcaggtcacattatgctaatcttaaagtatgtgttgggctgaaccttgccatatgtattttttaaaagactttattttttagagcagttttggagcagcaaaattaagaggacagagatttccaacatatcccctgccctcctcacaatatattttacacatgaatagttaggatattttcagctgtatatagtgagacctaattcacaccagctaaaacaatatggaattttattatctcacaaaacaaagttcagtggttagggtgtctagagccacgctctggctccatttctatgctattttctcagctctgccttcctgagggtgtagggttcatccttaaatggctttcttcttggccacatgatggctgccagcagcagtagtgataacatgtacccttcttcaagtataggtgaagagaaaggaaacctctcacctactattgaatgtaagtctttcccttcagtttgattggtcaatgtaggttctctccctgaccagtaatagtcaccgtaagaatgctatgtgctgattgccttaagcctagttctggagcaagtaacaaacattggcatggaagtaggaataccatgttttcactagtcctaataaaacagctagggctagggataaggtgagcttcaaagaattatatagaattcatggaagagaggaggaatgttaaacaaaagcaaagttctttaggaaggagaaggggaaaaataaattctgaaattaactaagttatattactatgctaatagtaattgtataatagcttttataataaattttttgcttgttctctatatagctagcctcagagtgagatgtacactgatatatttgatagtgaaaccttaaatacaagtgccaagaagtatgagcacataattcataaattaagacacagagtcttaatttgtgaaaaagtaccattacatccagcttcctgggttttaccattgaactcaacagatattctgcctatttccatgtttccattaacatagccccaaattatgtgaaaactgacacgtatgcccaattgattattaagacatggagaaattctactttctttttctcttttttttttttttttttttgagtcagagtcttgctctgttgcccaggctggagtgcaatggtgcaatcttggctcactgcaacctctacctcccagattcaaatgatccttctgcctcagcctcctgagtagctgggattacaggaggatgccaccacacccagctaatgtatttttggtagagacggggttccactatgttggccaggctggtctcgaactcctgacctcaggtgatctgcccacctcggccttccaaagtgctgggattacaggcgtgagctatggtgccctgccgaagaaatcctacttctctgcctaaacttgagtagaggtttctaaagtttaaaatagaatttaaacctcgtccccatcctcctttgcttagatatcatactatcaaggacttgtttatgtaatagattttatattgaaggtattcaagcagaagctatactaatgttattgatggtactggtacatctgataaatgactggtctggagaatgcttcctaggcctagctgattgagagaataactcagaagttttaaacaatacagattccatatcctgatcatacttaatcagaatctctgaagatggagccaaagatatgtatctctcagaagcactactaataattttttacagccaatccaggaccagctcctgggtaattatttaggaatctctggactaaattttctaaaagacccatttaaatatacaattttaataacttttgacagtggaaatagcattgcactagaaattaggtgactgaaattctagtgccagctctgctattggttactttgatgacaggcaagttggtttaccctgtggagcctcagttttcccttctgtaaaattagggatgtctaaagtcccttccagctccaaactcagtcaattttacttgtttgggcattctgaggaaccaagagttgattataaagattctaatttctaatacctctagctgtttttaagggcacataaagagcttacatagacactgccatctcagaagaaaggttcaagatggggtccatagaactcttaagagtgctatcattgttttggtaactttgaacaaattttcctataaaaactggggacaaaatactataaatatgtgaacaaaagtctctttgttaccagtggttaatgggtatccctgcagctaccacctgaaacagttttggctctgactccagaaccaaactttctggcctttaactgtttggtagggtgatataattcatgttatacagcatactggtccagcttttagaatatatatatatatatatatatatattttttttttttttttttttttttttgagatggagtttagctcttgttgcccaggctggagtgcaatggcacaatctcggctcactgcaacctctgcctcctgggttcaagcaattctcctgcctcagcctcctgagtagctgggattacaggtgcccgcaaccacgcccaactaatttttgtatttttagtagagatggggtttcaccatgttaggctggtctggaactcctgacctcaggtgatccccccgcctcgacctcccaaagtgctgggattataggcgtgagccacaatgcctggatgtagtttgttggttggtttgttaagaactaattgttatggtaagatttgccttagcctgggcatggtggctcatgcctataatcccagcactttgggagaataagaccagaggatccttgagtccaggagttcgagaccagcctgggcaatatagtgagaccctgtccctacaaaaaattttaaaaagttagctgggtgtggtggcgtgcgccggtagtcccagctactcaggaggctgaggtgggaggatcatttgagcccacgaggttgaggctgcaatgaaccatgatcacaccactgcactccagcctgggagacagagtgaggccctgtttcaaaaattaaataaataaaacaaaataaaattatcctatggtccacttctcttctgattatcttactgtaattaactctagtttgtttcctgactcataatttccctctccacaccatgcccttttctctcttctctgcttccatacacaaattcaacttcttcaaccccttgttttacacatttttagtgacactcttgcccgtgatgttatcatttaaaaactttatttaggctgggtgcagttgctcacatctgtaatcccagcactttggaaggctgaggtgtgcggatcacctgaggtcaagagttcgaaaccagcctggccagcatggtgaaatcctgtctctactaaaaatacaaaaattagtccggcatggtggtgggctcctgtaatcccagctactcaggaggctgaggcaggagaatcacttgaacccaggaggcggaagttgcagtgagcctagatcacaccattgcactccagcctaggcgacggaacgagactccatctaaaaaaaaaaaaaaaaaaaacaaaactccaaaaaaactttatttacactgagtaacaaatagctagtgtttattgaatgcttaccatgcgccaggcactgtattaagcattttacatacaatatatcaattgttatacttttattttgagtactattagatcctccactatacagataagacccagaaatattgagtaacttgcccaaaattacataactagttaggtggtgacgtaggatttgaaatcaagcatttagactccagagcctctactctattgtctcctataaaagcaaggattaaagaaaagtaggccaggcgtggtggctgatgcctgtaatcccagcactttgggaggccgaggtgggtgggtcacgaggtcaagagctcgagaccatcctggccaacatgatgaaaccccgtctctactaaaaacataaaaattagctgggtgtggtggtgggtgcctgtagtcccacctactcgggaggctgaggcaggagaatcacttgaacccgggaggcgggggttgcagtgagctgagattgtgccactgcactctagcctggccacagagtgagactccatctcaaaaaaaaaaaaaaaaaaaaaaaaaaagaaaaaggaaagtgtactacactatgatgaaagagatgagagttttgtgtttttttgatagtaactagctaatatatcactatggacaggtcataattgttctgattttctcattcatatataagttgaagtagaaccaactactgtgtcataatactctgtgattctgttatgtgaaaagtgtatcttttgatcttttgtctcctgatatgaaaggactttggcatttcagccccttctcctatattttcatatttattctagcactagcttacattctaacagtgaaacacaggtaaatatgtattttatgtgtgttctgtttctatttctgtaaagcaaaatgtatctgagtagcataaaatttttagaaaatttcaagtctcatccctatttttctggtacttttagatctgatatcttgatgatggcagaagtggcttaaagttggaaaattattgtggttttgcccaacgtggcaaatcagtgctttttattttgtatataatgtgtaattttcacagctataacaattggttattatatattgatctttgaaaaagcaatgtattccagtagcatttttttaaacagggtcttgctctgtcacccaggctgtagttcagtggtgtgattgtaactcactgtatcctcaatctcccaggctcaagtgatcctcccacctcagcctcttgaatagctgggaccacagtgagcaccactttttaaattttttgtagagatggggtctcaatatattgaccaggctggtctcaaactcctgggttcaagcaatcctcctgcatcagcctcccaaagtgctgggattacagtgtgaaccatcatgccccactagtattttcttttgtgttcctatctatttcttgaattcatgtttccttatgtttatcaagcctagtttcttttacttttaggaattaaggctgaattaggacttttaatgactcccatactaaaacttcttatccttttaaagctgaaatacattgggaggatcagcaaggtcagagaaagagagggtaggtggggataagagagtaaagcccttttgcaaataggcatacttacacagactgaaagcaggcccttcaatctctctgcaagtatttaatctctctacaaaaattaaagtgtgtttgcttgttatctttttcattctttggaaaacattttagctatcgttactattattttgacattttatatttgccttttttttggaggagtcagtactgaagggggaatttaacttttaaaatggccacttatacataactagcatagaagcagaagaaaatataggtaagcaagaaaagaaagatcattttaattggaatgtgatggtggcacaactctgtaaatgtattaaaactcattgaatcatatacttaaaatggatgaatttgcctcttttttctttgttcaaccacatacgataaccatctttccaggtcaattcatattccacaatatcattttaaatggggacacaattttcgattttatattatgtaatttgttttaatttttttttttttttttgagacggagtcttgctctgtcgcccaggcaggagtgccgtggtgcgatcttggctcactgcaagctctgcctcccaggttcaagcaattctcctgcctcagcctcccgagtagctgggactacaggtgcatgccaccacgcccggataattttttgtattttcagtagtgatggggtttcaccatgttagccaggatggtctcgatctcctgacctcatgatccgcctgccttggcctcccaaagtgttgggattacaggcgtgagccaccacgctcggccataatttgtttaaccaattgattccctgaacatttttgcagctaaagtttggtacaaatttttttaggttaaattactaaaagaattattgctagatcatagggcatgctcatttaaaggtttttcttacaaattgccctctaaaaaaactaccaatttatactcctataagtagtcattctgtccttgcacttctcccttcgaaactcagtattagtattttataaagtctctattattctgaaaggtagaaatgatagcttgttatcaatttccatttcaattactaataaagttgaacttttcgtcatttattagacatttgtatttcagtttatgttctctgtccctctctccaaaacactagcatgtgtacatgtgtttcttattcattcatatgacttttatacattaaggataaataacttcatgtcatatattttgtaagtatttttccagtttgtatcttttatttatgttgtttttgcagaagtatcaaattatatggtcatacctatcaatcttttgctttatagatattgcctttggtgctatccttgataaggccttccccactctcaaatatttaaatattcaacaatatttctcccactaattttatgttttctttcttcagacctttatgtagattttatttttatatataacataggacaaggatataacttggtaaaacgaatggggagacaaatttttaccttatttattgcatgtcttctaaatatcaaaaactgtgttatatatggtttgtagtaataaacacagcagggatgttctcatccttatgtaatttaccaactcagagagacaacatactgtttaagtgcaaatttgataaatgctataaagaagtgctaagttctatggtagtgtatagtatgtggaatctatcaactgttcaggtacttattgaacagttgatctttaaaaggagatggtttggtggaagtggaggagaattcaattaaaaaacaacagggcacagtggtgtacgtttgtaatcccagctactcaggaggctgaggtggaagtactgcttaaacccaggagttagagaccagcttgggcagcatagggagacctcattttttggggggagggggaatacccaaaaaacccaaccatacacacacaaaaccaaccaaacaaaaaacaacaatgaacatttattatttcagagtatccctgggtcagaatctgggtgtggcttagctgggttctctgtttcaggatctctcgcaaagatgcaaacaaaagtcttgcccagggctgcgatcgcatctgcaggaagattcacttccaagtttgcttacatggttgttggcagaatgcagctcctcataggctgttaagccaaggctttcagttctttggtaggaattcagttcctcacaggttttttggtggctggagatctcctttagttccttggcatataggtcagaataatttatttttgtcctagggtgggtacttaagctttgataaaactgatttataatgtctttatggagtaaaaattagcacagcattcatgttcttagctctatattcaagaataaaataagtgtgtatattctgtgaatattctggttggtatacatttttggcctgtatgtaaattaatatgtgggtgacttaaacattcacagagaattaattatatattgcaaaggacaaacacataattctgttcaagataggaatgtcaagaaaactttaagatgattttgtcttttaatcacatcatggttataatttcaaatgatttttcattccctcctttccttcccatcacacagactatactgtaaatatactctctgaagttgcacaacgtgacaagcttaagcttagccacacaagtatgtgcatatacaattattttattttttgatctgatgctgacagtgctgtgcgttttacctgaactcagaaaatttaatttctaaattataatatatggttagatatttactaaaatcctgaaactagaattttactcccaatcttagaccttgcaaatggtaactctagtttagtgtacacattttcaacatgggcaatattactccccaagaggaaaaaattgtttttttgggagggtatgaaaaaaagtatgttttatatataaagcatagatacacatacagtccattaaagcatatacagtgtatctatggtgttaaaattttacagtggggtgctgaataggaaaaacaggtctaaaagggttccataagggggctgataatggaaataaaagttgagaaacatggccctagtgctaagcttaacagacagctgtttgacgaaccatctggcattagatttttttcctgcatgatttcctgtattagaatataagcttcttaaggacagaaaatgtaatctgatttgtattttcaataatagctaacacaatagttacgttcaactgcattcagtatatgtatatttaattgaattaatatggagtacatcttcccctacttgcactcatcctattagctctataaaatctaaatgtaatgaccaaaattagtctagtaaagcacaacctatcacaatctccctcacaaaaatcctagtaaaataatgacaaattttattcaaagaatggaaaatcttcaaagtagcataagagaaggagtacagactagagacagagagatgaatcagggctttgatttccacctcttatcatttgcaagccgaggagccttgagccaagttatgtaaagagaaagtgaaagaggataaaaaagaataaaaaagggacctttctaggggaagggtacaagaagggacaatggcatttctagcaggtttttgttttgttttgagacagggtctcgctctgtctccaggctggagtgcagtggtgcgatcttggctcactgcaacctctgcctcccgggttcaagcgattcttgtgcctcagccctccccccgagtagctgtgattacaggcaagtgccactaggtttggctaattttttgtattttcagtagagacagggtttcgccatgttggccgggctggtctcaaactcctagcctcatgtgattcgcctgcctcggctcccaaagtgctgggattacaagcatgagccgccgtgcctggccctaacagtcttatatacacccaaaatttcaggcatgctgaatttctggcagttccccaaataatgcatggctcaaatatgccgtatttcacacttacatattttatatatacattcacattcctcttcccagaacatcatttatttgtcctccaatactcagctcaggtcacactttttttttttttggatggagtcttgctctgttgcccaggctagagtgcagtggcacgatcctggctcactgcaaactctgcctcccaggttcacgccattctcctgcctcagcctcccaagtagctgggactacaggcgcccgccaccacacctggctaatttaaaaaaatatatattttagtagagacggggtttcaccgtgttagccaggatggtctcgatatcctgacctcgtgatccgcccaccttggcctcccaaagtgctgggattacaggcgtgagccaccatgcttggccagctcaggccacattttccctaggaaggcctccatgacacgcttgtgtgccttctacactgagttagatacatatattcttgcttccctaacattcagatcatacttctactatagtacttataattaatggtttacatgtctgcttctcttactagcctgagaacttcttgagagctgaaatggttttatttatttatcttttcagacagagtctcgttctgttgtccaggctggagtgcaatggcgggatctcggctcactgcaacctccgcctcctgggttcaagtgattctcctgcctcagcatcctgagcagctggtttacaggcgcatgccagcacacctggctaatttttttttttttttttgcatttttaatagagacaggatttcaccgtctggccaggctggtctcaaactcccaacctcaggcgatccgctcgcctcggcctcccaatgtgctggaattacagacaggcgtgagccaccgcgcctggcctatttatcttcttaacctcaacatctagcacagtgcctgacatgttagtgaacaactgacttgttgaattaactaataaaaatacaggcatacaagaagagcacagtagcattttcagcaatttgacaaatgaatattgctttgttttcttcaaagggccactactttaaaattgaataatcatctttgtatatagtcagacctaaaacaaagctctgtacacttcctgtgtcaaataataataatgtaagtcctttacactaactcatttcatcattgcaatccaatgaggaaaaccttattatttttcctttttttttcctcagatgaggaaacaggcttgtaagaggtaaactaatttgcctaaggtcacatatttaataagtagggtttctagctctggcatgtatggtgctaactaccacactattgtgcctctcaaagtcagctgagtaagaatactcactgttgcacaatatctcatccctctgtctgaccctctccacctgcaatctcccatatacactcacttaggagaaacaaaggctcacggctcatacatgcagcttgtgatttagaaaaaaaatgtgcccacatatgctcggctttgcttaatgtaaacaaatatactaatcaatatggtataaacctccaggactattctgttttaataacatgtagatacaatgtaatgattttaattactttattgtcctgtcaaattctttaaaatgggaacttgaggccgggtgcggtggctcacgcctgtaattccagcactttgggaggacaaggtgggcggatcacctgaggtcgggagtttgagaccagcctgaccaacatggagaaaccccatctctactaaaaatacaaaattagctagacatagtggcgcatgcctgtaatcccagctactcaggaggctgaggcaggagaattgcttcaacccgggaagcagaggttgtggtgagctgagatcgcgccattgccctccagcctggacaacagcgaaactgaaacttcacctcaaaataacaaaaaaaaaaggaacttggtatgctgctccagcaatttaaatgtgtcaatccacgtatccaatgttaaattatcttttccagaaagcaaaatgtgaagcggcttataaagacttcttgtcaagtatcacaagctctccattattactttactaaagatgtctgtgatgccactttgcaaaataactgtagggagtggcatttggttcctggggtggaagaggtgactatgcctactaaatcatggtattgtctcaaatgaaaccaaaagaaccaaaaaaccaagagagaaaacaaaaagacaaaaaaagaaagctttttcatttctgaaaactttggggctgtgtggtcctatcaggtgctgctatttctgggtttactattactacaatcttcaagtcctaaagatttttgcttcctgttgcagtcctttattcattcataaccaagctgcattgtaccatttgtatccaatttagctggattccaacatcaatcctatcttgccatgaagtattaaaggctgagttaccactggggatgtgggaggtaaaatgagcatttgccctagagaaatcctagataaggagtgccacggagaacatgcatatcagaccccctcttccttctgctccacacaaccttcaagttttcatgaacacctagaagaattaacaggcaagaacaccagtgttgatttaatgttggcaagattcaacatattttgaggtaagaatacaatactacatgtctattattttcagacatttaggtttatactaattcataaactttaggtttatattaatttattccagcattaacaaaagcttggaagtttgttgggaatgggcattacatagatgactacatgttctaggcatcaagcaccatattagaaatgatacgaaaaaaatagtagttttgaagcacatgaattagtttgtgggaaagagtaggtggaaaggagatcaggcagaggcaacagcagttacaaaggcaggacgcataagaaagtctagcaattatgcttttgtagaatatgccagtctagtgacttctatctttttttccctagctaggatttgaacctatctttttttataacttttttttttttttttgagatcgggacttgctatgttgctcaggctagtcttgaacaccttggttcaagcaaccctcctgtcacagcctctcaagtaactgggattacaggcacatggcaccatgaccaagaactcctttagcactaccatttgtgccagtcttcttggcttgtgacatctcttcaactgtgcacttatcattttttaaattaaccttttaatttatctccttccctaaattataatctctctttgtttctccagaatgccaagaaaggtgctttgcattgagtagacactaataagtaactattgattgcctgaccaaaaaaatcatggcttatgtactgtaagtcttcattaagaatgctaagattaagtcaggtgcagtggctcacgcctgtagtcccaacactttgggaggccaaggtggatcacctcaggtcaagagtttgagagcagcctggccaacatggtgaaaccctgtgtctactaaaaatacataaaattagtcgggcgtggtggtgggtgcctgtaatcccaactacttgagaggctgaggcaagagaattgcttgaacctgagaagtggaggttgcaatgagccgagattgcgcaattgcgctccagcctgggcgacagggcgagcctctgtctcaaacaacaacaacaacaacaaaaaaaagaatgctaagattatatttataagaataaagtagaacgttgtgaacagaagataacacgtctattcgctacgctacttttattacctatttccaggaggaacaaatactacatacagtcaatgtttatggctgtcaatctagaaagcagtaggattgacagcaattactcccttataaaaatacaaagacaaattttagaataagaataagatcttattataatcactgagaattaatatggaaaaaaactggacttgaactctgaaaacttggatctgaatcaaggttctgccacttgttgtgtactttggtaaattacttccacctttgagcttttttctcatctataaaatgaagttaagacttccaacttcacaggatcataaagaagaaattaaaaatgcatatgcagccgggggcggtggctcacacctgtaatcccagcactttgggaggccgaggcgggtggatcacgaggtcaggagatcaagaccatactaaacatacaaaaggtcacgaggtcaggagatcgagaccatactaaacatacaaaaaattagccgggtgtggtggcgggtgcctgtagttccagctactcgggaggctgaggcaggagaatggtgtgaacctgggaggcggagcttgcagtaagccaagatccgccactgcactccagcctgggcgacagagcaagtctcaaaaaaaaaaaaaaaaaaaatgcatatgcatctagtgtggcatctagtatagactcaataatatatttgctcactttttgcccattcatccatttaaatacatccataaagcaacaaaataaactagagatattgtgaactacagagaaatgtttgttttgcaaactttagctacaaaaatacttttccttcaagtccttaagtcattacgataaatatacgttcactttttggaaggtcatcatatgttactttttgttgtagtgtaagcacacatttaaggccaaataaatgtatattgcaatcatggggcacatagacactatggttttgtacatttgtccaattgtatgatagtatatactctagtttcagcattatcttttttttttcttttttgagatggagtcttgctctgtcgcccaggctggagtgcagtggcatgatctcggctcactgcaacctctgcctcctgggttcaagcaattctcctgcctcagcctcccgagtagctgggattacaggtgtctaccaccacgcccgactaattttttggtatttttagtagagacggggtttcaccattttggccaggctggtttcaaactcctgacctcaagtggtctgcccgctttggccacccaaagtgctaggattacaggcatgagccactgtgcctgccctctagttccagcattatcttatcacacattagataattacttgtataaaagctcaggctcaataataaagtctatagaccctgtacaataggcccctttgtatctgcagtttccacatccacagattcaaccaaccatggagtgaaaatattaaaaaaaaaaaaaaacataaaaagtaagaatacggcaattaaaaaaatcaaatgtaacaatacaatataaccaccatttacaaagcatttacattgcactaggggttacaagtaatctagagatgatttaaagtgcttgagaggatgtacgtaggttatatgcaaatagcatgccattttatataaggaacttgagcaaccatggattttcttatctgttggggtactggaaccaatctcctgcagatatcaagggacaactgtatttctagaataaaggtgaggtagcgaatatcttttatttttattattattttttgaaacagggccttgctctgtcacccaggctggagtacagtggcatgatcatagctcactgcagcctcaaattcctggaggatcaatggatcctcctaccttagcctcctgagtagctgggagtacatgcatgcaccaccatgcttggctcattttttcttttttttttttttgagatagggtcttgctatgttgcccaggttggccttgaactcctacgctcaagtgattctcccatcttggcctcccatagtgctaggattacaggcatgagccactgcactcagccctcgctaatttgcttattttttattcttttgtagaggcagggtgtcactatgttgcccaagctggtctaaaactcctagcctcacgtaattgtcccaccttggtcttccaaagtgctgggattacaggcatgagtcactgtaccaggatggggagatcgtaaagaaatggctgcagttaagaatcttgggttctacttttggttgtcactatctctaccagacgtctaatgtggcaggtaacttcagtttctctataccttattattattattaacacttagaactggtgtgatatgatctctcaataatgctgtaatacttcattggtatctatagcaaaatttgaaatacatagatgtttttacagaaatgcaaagtactcagcttatcagtgtctctttttgtgctttgataaaaatttaatttctttacctccttcctggtaaaacacaggaacacctaaaacattaaaaaacaaaaaacaggccaggtgtggtggctcacgcctgtaatctcagcactttgggaggctgaggcgggcggatcacaaggtcaggagatttagaccatcctggctacatggtgaaactctgtctctactaaaaatacaaaaaattagctgggcgtggtggcacgcacctgtagtcccagctacttgggaggctgaagcaggagaatcacttgaacccaggaggtggaggttgcagtgagccgagattgcaccactgcactccagtctgggcgacagagcgagactccgtctcaaaacgaacaaacaaacgaaacaatagaaaaacaggccaggcgcagtggctcacgcctgtaatcccagcacttcgggaggccaaggcaagtggatcacttgaggtcaggagttcgagaacagcctggccaacatggtgaaaccccatctctactaagaatacaaaaaattggccgggcgtagtggcgcatgcctgtaatcccagctatgcggaaggctcagacagaagaatcacttgaactgggaggcagaggttgcagtgggccgagatcatgccagtgcactccagcttgggcaatagagtgagactttgtttccaccccccccccaccaaaaaaagacaaaacaaaacaaacaaaaacaaaaagtgctgcattaaaactgattttataaacaaaatgacaaaaagcaatttcttctcacttgattttagagacaattgcttacatataagaatttttggtcagatgccctgtagggtgaccaaaccatcccagcttgcctgggacttcccagtttgggtactgaaaactccatgtcccaggaaacccctgtcctgagccaactggaacagttggtacagttggcttttccatagcttacacttctattatctgcccttagaaaaattccagtgctactgtaatttatatttatctgaaaagcacctgcatagtcttcctgttggtattcagtacataatcatttggttagcatataaatatttatggaattttgtcccatgagtagatattttataaatgtatacgaatatttttttaccttactaggacttggggacaatgggagtgccaaattaccaacaatgattatctcggcaccaaaaaggtattaatttgtgtattttctttttcaagaaccttttcctgttgttgtttagagactactgtgcttctagctagtaatcaccatcgctgggaaaacaataacacaggcaatacctttaagaacaagtcattaaaaaacaatacaaaataatgtatgtgggtcatcccttggccaatgtggggccagagagaagttgttctactggttttccttaaatagcaccataacctaacctgaatctaagatggtttccaaaatatgtatagaacgaatgttaactaattaattctataaaaatatgtatagaatgaaagctaattaaccatcaaaccatggttataatggtttatccatggataggagacccagaaattcagaagcactgtaatacttttcatgatattaataaaaaatgaagtcatgagatcatggaaaaggtttctgagaaaaaaatcagaccaattttcttccctagaaaatggggatgacacaggctgtgtacatataagcataattaaaataaaactgattaggctgggtgtggtggctcacgactataatcccagcactttgggtggccgaggtgggaggatcatgaggtcaggaggtcgagaccagcctgccaacatggtaaaacccgtctctactaaaaatacaaaaattagccaggcatggtggtgcgtgcctgtagtcccagctactcaggaggttgaggtaggagaattgcctgaacccgggaggcagaggttgcagtgagccgaaattgctccactgtgctccagcctgggcgacagagtgagactccgtctcaaaacaaacaaacaaacaaataaacaaaactgattaaaagattataaaggtgacttatgacactttttaaaagctctgattttgtgagtacttagctatgtgccaggtactgtgtcaaatgctttaaatacataatttcatttgatactcacaaataatcctatgagaacaggaattatgatcctccaaagtaaacctctaaaagagaggcttagtaatttgcttaaggttacagacagcaacggggcaggggggtgcataggcaaattcagatccatctgcttcaataacttttatcctcttcacctttatcctatgccgcttctaaacattgctggtgtaaactctggtaaaattgtatctccagctctaatttttcctgaccttcagtcttgtatcttagtttatggaactgcctactcaacacctctaccctgatgtctaacgagcacctcaaataacatgtttcagtgagtgatgccaccattcacccagtcgctcaagctccaaatacagtaggcatccttgtttcctccatcaaacccactgtcaagccaccagcaaatattttggctcttctttcaaattctatctcaatctgaccacttcttatcacctccactgccacaaccctagttcaggctattatctacttacctggactactgagatagcctcataattgctttgttttcgtagtccattcaccataaagcagtcagttatctttttaaaaacacagatcatatagtttcactcttctgcttaaaactcgttaataattgccactggaataatgtaaacttcttaagatgacctacaaggcccctactggccccctaccttgatctgctttctctgactttatcccttaacaccctcttctttgctcagcatgtctcaagtcacattggtcctgatattttcaaattcctctgtgactaaaagtcacatgttttgagaagatgtgaaagggcagggctgaagtttgaggaaactgcaaaggtgtgaaagagttgtcgagagtgggagaacaatccagaaaaatttaataggattgctgggaattattgaaggttgagttgtgcttggtgattgaaattaagtaggctgggtgtagtggctcacacctgtaatcctagcattttgggaggccaaggtgggaggattgcttgaggccaggagttccagaccagtctgagcaacatagtgagatgtatctgtaaaaaaaaataaaaaattagccaggtatggtggtgtgcacctgtagtaccagcaactcaggaggctgaagtgggaggatcacttgagcccgggacattgagccttcagtggtgatcgcaccactgcattccagcctgggtgccagagcaagagtgtctccaaaaaaaaaaaaaaaaagaagaaatgtagtaatagaatacagatggctatgcacatttctctaatagtggtcagctgctccatttatcaaagtggagactatggatggtagggttcattcaagataggggtacaatgaaaagaaaggtgaggcaaaggagtttagggtactgacgagtgttactgaatttttctgtaggtaatatcacaatggagacggggtggacagaagtgttccttgtgtccatggcttgccttagttgtggcagcaatctagaattgctaaatagaaacactgaatcaaagaacctagacctggctgggcgctgtggcttatgcctgttatcacagcactttgggaggccgaggcaggtggatcacctgaagtcaggaattcgagaccagcctggccaatatggtgaaaccccatctctactaaaaatacaaaaattagcctggggtggtggcatgcgcctgtagtcccagctactcaggaggctgagacaggagaatcgcttgaacctgggaggcagaggctgcagtgagctgagatcaccactgtactccaatctgggcaacagagcgagactccgtctcaagaaaaaaacaaacaacaacaacaacaacaaaaacctagactaccagtattgaggttaaatgctttactttgtaaatcctgaggttaagaaatataattatcggtattttaaaacttacaaaatggacaaattggaagaggctttttaacattataatggaatttttcacttttcaaaatcaatttccaaagggaacctataggttgaacagtaagatttatcaacaaatcaggggttttgattttaaaaggttttcaatctggccaattcttcagattatctcaagagggagccttcttatgcctcttcttccttcataacacttctctggctcgcatgtcctgtttgcaaagatttaagcccactcttaggcataaaatgctcttaactgacatgacccctgactaacttgcctaatattttgccatgtaccctccatgcactttaagctccccaaactattacttacttgacaccttctgcgcttttgcttgttctctgcggctagaccatcttccctaccttctctgttgaactcctagccattcatcaacactcagctcacatagcacactttcagatgagattcaagcattatctctctggctacatttggcccttgtagatatttctattattgcctgtattttgttgaagcattcatgtcttttatgtactacatagtacataatatatctacattacaaagcatttttatgattcatgttttggggcatccagcggttaaaatagggcaagggttatgtggtcttggccaggtcccttttcctttctgagcttcaggttcctcaggtataaaatgggtactatggctccgtgaagatgagacagaatatatgtaaagcccttacacagtgctcaattcatgaaaatcatcgctgtttacattgtttagggccctcaagaggcgctcttgtcagcggggtggaggaaatgcctctttaaaatgacgtcattataggagacttaaaaaccactgcacgtctgtacaagtggacagaatcacacagctacctaaagtgggttcacctgtcatacagtttagaggttccacttacaacaggtttccatcagtagccaaagcaacagaaattttagcttaacggctgagggcttccgggattaccgcagggcgggcgggaagcgcctttccgctccggagggaaggccgcgtccccaagggactgcctaagtgggctggatccctatggcctgcggcagacaccaccacgtaggcggtccaggggtccctctctcggtgactggtgaccaggaggccgcaatctcttcacataaaaggtctacgggtttccgctcggccctcacagcggcagcggatcgaaccaggaaagcaattcccgctcggctcccctcgggtcccaggcccaggaaggccgggccgtggggtctccccgggctccacgcaggggcggtggggcggggcgcagtgacgcaaagaggagtgacgcgacgacgcagcgcgacgcggtgacgcacgcccctttgttggctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccaggtgagggtggccgccgcgccagctggaccgggcccgacgggggagcggattcaggcggcacgcgcggtcccgagggacaggcctgggcctggtgcgcagcctagcccggtgcctcccggccttgtcttctccgctgcctctgctggggatagagggtgtcgaaagcagaggttcgccgattagccgggtgtggggaggtgcgctgggggcggtgcttcccaagtcctgctatggcggaggccttcggtcgcctaagccttctcttgcgggcaatttctgccagtccctgggccgggtgtcctttctctggccgggcgatcgcctactggggcggggcggaggaggtggggtggagaagaggagtcaggaagaattgggccctgacgggacttaccccggccgtagcctcatttgagcacttttggaagggattagagtaggcctaagagcagcttggtgtacagttgccccaagtgggcaccagttaataaagaaatggatcttggcagtctcaagtgcctacttaaaggtgggggaagggaagtatttctcggaagaggtgctgatgggccttcttttcagatggtgaggcttctgcttacatcttttttatgtctttgctgtttgggacctaattgctactttttctagtcgtagcagatgacttgcttgaagctgttggaatagttactgcatattgcatacccttccttgtagctaaaacaacaacaaaacgcagtgttgtctaatattggacaagactctattgtgagttagaaagcagaggttttctgcttgtgaactcctttctctgatattttctattttgtggtaagttaggcttggtgtaagttgataaccacatctcatttaaccatgtgcgtcagattttgcatttttgagctttagaaactcaaaagttttcatttggggaaaaaaaaaacctcagttctcctgaggagtcagggatatggctgaagaataaaaatgaagcttgattcagtgcaatttttagaaaacctggaaggaaacatatatgagcagcaagttactattgcctcttttatcagtattatttcttttttgtttaacttaaattggttggctaaatattcattgacaaattagaagtatgtcactgtcaactcgttgactttctattattaactgatttttatagtattataagtaacagttttaaaaattgaagcatctattcaggcactgtttcaatacagtgttttgcataatagaaaaatctctgatatctagtgccattactaaatagtggaagtcttcatttttaatctagagaacacagtctaagaaggaagttgaggattgtagaagataattttttgtttgtttgagacggagtcttgctttgtcgcccaggctggagtgcaatggcgcaatctctgctcactgcaacctccgcctgccgggttcatgcaattctcctgcctcggcctcccaagtagctggtactacaggcgcgctccaccatgctcagctaattttttgtatttttagtagagacgggtttcaccatgctggccaggctggtttcgaactcctgaccttgtgatccgcctgcctcggcctcccaaagcgctggattacaggcgtcagccaccgtgcccggcctgtagaagatgcacatgtaagaaaaatctgattaggtaagaaaaaataaaaagacaaaacaagcctgccacccagagacgtacaacaaaatgcgaactgtagttatttttctagacctttggatagccattaatatggttccacgttaataacagtggaaccatactgtatgttctgtttgtgttttcagtggaaaaacattacagaaatactctgaacaaccttctgtcaagtaaatttttcgagaacttatatgattatagatctgaactaatttatttaatcaatctgttatttgccttcctttttattttctagtttctggcttttataaatattgaaaatatcctcataggtcagtctttgagtgttcttattttcttgggataaagtgaattgctgagtcaaaagaatttgctcattttcaatgcatttgatacatactaccacattgctttcagaaaagttatgctagttttcccaaccagtgtttgatgggcaaaaaaaacctggtgagattgaatttatgtttattgggcttggtatttcttttttaaattgcccctcgctttttgctcattttattctcttttgcccattgcccctctttgggatatttatctcttactggtttgtaagacttctttctattaatagaggttggaaatagcagttatctaggtttttaatgttggtttgataaacactgaattttacttagtttgcattagagagcttactgttaactcttaaacatttaaattccctgttctcagttctaattttcagtgtgaaatcaggtaagatacatttgcaggtgaaaaagtttgaaatgtaaaaagataaccaaattaatttaatatttccttgggaatttgattactttttctgggagaggagttctgggcaacaacataaatactgttatttgtggatatttgcaggttaggtttggtcttcaaataagtcaacattattttctttcagaaaacttggttttctggctttctataatttcccaattaacatttaaataaaagaccaaattaaacaattaaactttatttaatttggtcttttgtttaaatgctttgtggctacctagcttaccttttcagcttttaaggaaaaaaaaaatcagagttttttattttgttttgtttggagacagcctcactctgtcacccaggctgtagtgcagtcgcgtgatctcagcttactgcaacctctccctcccaggttcaagagattccccttgcctcagcttccccccctaccccagtatctgggattacaggcacctgccaccaggcccagctaattcttgtgttacagggtttccccatgttcatcatgctggtactgaactcctggcctcaagtgatctgcccttctcggcctcccaaagtgctgggattacaggtgtgagccaccatgcctggccagggtgttttttgttatttgtttattttgagacagagtttcattctgctgcccaggttggagtgcagtggcgtgatctcagctcactgcaacctccgcctcttgggttcaagcaattctcctgcctgagcctcccgagtagctgggattacaggtgtgcaccaccacacccagctactttttgtattttttagtagagagggggtttcaccatgttggccaggctggtcttgaactcctgaacccaggtgatccacacagctgggcctcccaaagtgctgggattacagtcttgagccaccgcgcccagcctaaaaagtagttttctaatgtaactatataagtagctaggtaatttattaaaagaaccctgttcaattctgcagttgggagtatttaaacttgccattttgtttttccacaacagtgttcagcaaatgttgattgtgctttctaagtatgccaggcattatgttaagcagaggatatgctccttgcctaaggagcatatagggatagggaatatggaggtccttgaactccacttccagagattcttactcattaatgaagtctgaggtgaaaccttagcatctctgtattttagccttctagtgataaccaaaccactggaatagtgatagttaatccactgtcacgattttgactcaggcagggtgagtagagtgagaagagcagcagctcttaggggcacagattgggtatacctaatcaaaaaatcagaaatgctctgaaatcactttgtgttgttgcccagactgaagtgcaatggcaagatcatagctcactgcaacctcaacttcctgagctaaagtgattctcccgcctcagcctcctgagtagctaggactataggtgtgtggcaccactcctagctaattttttttcttttttgtagagacacagggtcttgctctgttgcccaggccagtctcaaactcctggcctcaagcgctccttgaacctcagcctctcaaaatggtaggcctggaaatccaaaactttttgagcaccgttgtgatgctcaaaggaaatgctcactgcagcattttggatttcggattttcagattagggatgttgattgtaagtataattaaatattccaaatctgaaaaacttctggtctcaagtattttggataaggaatactcaacctgtaccatatttagagtgtgtgccgagaggaatatggacctgggactattgaatgtgagtggtcagaggaggtataaaaaacagtggataggtatcttgcttttataagatctgttatgctaaataactttttttttttttggagacggagtcttgctctgttgccaggctggagagcagtggtggcgtgatcttggctcagtgcaacctctgcctcctgggttcaagcgattctcctgcctcagcctcctgagaagctgggactacaggtgcgcgccaccacacccaactaatttttgtatttttagtagagactgggtttcaccatgttggtcagatggtctcaacctcttgacctcgtgatccgcctgccttggcctcccaaagtgctgggattacaggcgtgagccaccgtgcccagccaaataactcattttaaagaaaaaaatatctaagccttactgaagaaattttctgttggctgttggttcgaaagctgtatttcacttatttaattaagagatttaattaaagaacctcaagttgaggttgcaagcctaaactaaggaagacagtgtactattctttttttttttttcgtttgagacggagtctcgctttgttgcccaggctggagtgcggtggtgcgatctcggctcaccgcaagctccgcctcctgggttcacgccattcttctgcctcagcctcccgagtagctgggactacaggcagccgctaccatgcctggctaatttttttgtattttttagtagagatggggtttcaccatgttagccaggatgatctggatctcctgacctcgtgatccgcccacctcggcctgccaaagtgctgggattacaggcatgagccaccgtgcccggtcaacagtgtactattctagcatattgtttactgattggggagtcagttatagccctggtttttactctgtctagttaatatctcagaaccttcaaattttttttttttttttttatacatgtctcactgtgtcacccaggctggagtgcagtggcctgatcttggctcactgcaacctccacttccagggttcaagcgattctcctgcttcagcctctcaagtaactgggattacaggcacgcgccaccacacccagctattttttgtattttattagagatgaggtttcaccatgttggccaggctggtctcgaactcctgacctcaaatgatcgacctaccttggcctcccagagtgttgggattataggcatgagccacggtgcccagccacactttttgttgttgttgttgagatggagtttctctcttgttgcccaggctggagtgcaatgacgcgatctcagctcactgcaacctctgcctcccaggttcaagcgattctcctgcctcagcctcctgagtagctaggattacaggcgtatgccaccacgcctggctaattttgtatttttagtagagatgggggtttctccatgttggtcaggctggtctcaaactcccgacctcaggtgatctgcccgcctcggcctcccaaagttctgggatcacagtgagccaccttgcccggccttgttttgtttttaatctgggactgaaaatgagggagttgaaatactaggttggtccttttttacattaagtgttttattcgtttaacatcattttaaaaacctcagttaattggagatgttcattttttccaagaaattgaattcaggtgtgcatattgtggttatgttcattaattgggagaggaggaagagggtgtacaagcctgtgcatgatgtgtgcaggcacatgtgttttgaagttattaaagtgtttgatatagtttagatttatttcttttggacttttatattttcccagctgatctccttgagctgtaagtttaaattacactgacttgttgaattgctatggcagtagtcctatgaatcaaactctggggatggggtctggctgtctgttttaacaagccttctaggtgatggtgatgcaagctaaagtttgagaactgctgatgtagttgaaatttaatagcagtgtttctctatgtgttacgtgtagtgatagattactacagaggtgggttaatgagggaagataaattgtttaagaaactaataataggggaccagtcacggtggctcacacctgtaatcccagcactttggggactgtgccaggcagatcacttgaggtcaggagtttgagaccagcctggccaatatggtgaaacactagctgggcgtggtggcctgtgcctgtaatcccagctacttgggagacttgaggcaggagaattgcttgaacctgggaattggaggttgcagtgagctgagatagtgtcactgcactctagcctgggtgacagagggagactctacttcaaaaaaaaggtaataatgggaaaatttccagaacctaggcaacgtttactaggctaatcatagggttggaagatgtttgtcatcgtagatgctatccttcatgctatgctatccttcagctaaggtggtctttactcagtattttcttttcttttcttttcttttttggagacagagtcttttctctcttgcccaggctggggtgcagtggcgccatctcggctcactgcaaccttcgcctgctgggttcaagcgattctcctccttcagcctcccgagtagctgggattacaggcgcccaccactacgcccggctaattttgtatttttggtagagacggggtttcaccatgttggccaggctgatctcgaactcctgacctcaggtgatccacccgacttggcctcccaaagtgctgggattacaggcatgagccactgcacccggccagtattttcaaatagacaaactaaactagtgacatctgacattctagattggagttcttgatttcccttccagtcctagatttttttaatatagaatgttgagttttctaatttattagtatgctggaagagatataaagtcctggatagatataaagtcctgtttaaaggaatatgagaagacttattcttaaggagttgagaatctcttagagttaaagctgttaggttagtgagtaatttaaataagtggatagtaatagatactcatggaagagacctctgtaggtgttgtcaaagatggctaggatttgggtggataaaaaagaggaagtcattctaaggaactgaatgaggtgagaatgaggagagtttttgggtaatggtgaaatcagctaaagtagaatggagcttataaatgctggataataatgtagaacctgggagattaaatactgtgatgaaaggtaagcagaagtcatcacattagattcttttggggttgacctgtggtaactatgtagattggttatcttttgccttatgttaccccaaaacttagtggcttaaaaaaacaaggatctgttatatcatagtttctgtgagtcacaattctggatgcagcttacctgggggcctctggcttatggtctcttacaaggctgcaaccaaggtgacggcttggtagcagttctctctctctcttttttttttttttttttaaagacagaggcttgctgtggtgcccaggctggagtgcaatggcataatctcggctcattgcaaccctcacctcttgagtccaagtgatcctcttacctcagcctcctgagtagttgggactatagatgtgcaccaccacaccccagcttatttttttgtttttgtgggttttttggtagagaccagtatttttttgttttgccatgttgcctaggctgctcttgaacaccttaattcaagggatctgcccgccttagcctcctaaagtgctgggattacaggcatgagccaccgtgtctggcctgggtagcagtcctcaaggcttgactggggaagcttccccttccgagctcactcatttggctgtgaccaggccagattttcactggctggttgttgcccagagatatcagttccttgccatgtgggcctctccataaagtggctgacaacacagtagcttgtttcctccagagtgagggatcttagagaaaaggcccatacgatggaagccacaaagtttttataacttaatttcagaagtaacgtcgcatcactttgcaatattctatttgttgtaagtgaataaccaaatccagcccatactcaatcggaggggattatacaaagatgtgaagaccaggaggcaggggtctttgggggctatcttagaggccggctgtttgtctctgtctctctctgttaagaggtaaattacagctattgtataatgcctttctatccaatctttttgtatgctattgggagaacatagtgttttggattttttattttggattaaccgtaaattaattacttttggctttgcaaaacattatacctgtaaatgataaacattcctaataacctttcagtggcttaagtttaaaatagcttgtagtctcagaattggtaggaatttgagattctccagtttactgattttttttttttttaactctagctacgtaatggaatcacctggggatttttttcattactgtttttaaaatagaaaattgtagattcacagccgggcatggtggctcacgcctgtaatcccagcactttgggaggccgaggcaggcggatcacctgaagtcaggagttcgagaccagcctggccaaatggcgaaaccccgtctctactaaaaaaatacaaaaattagccgggcatggtggtgggcgcctgtaatcccagctactcgggaggctgaggcaggagaatcacttgaacccaggagacagaggttgcagtgagccaagattatgccattgcactccagcctgggcaacaagagtgaaactccatcaaaaaaaaaaaaaaaaaagaagaaaagaaaagaaaattgtagattcacatgcagttacaagaaataatgcaaaaatcccacatattcttttttccaaaaaattttatttccctaggttattggggaagaggtggtatttggttacataagtaaattctttagtggtgatttgtgagattttggtgcacccatcatctgagcaatatacactgaacccagtttgtagtgttttatctctcacccccttctcacctttttcccccgagtccccagagttcattatatcaatcttaggcttttgcatgctgatagcttagctcccacttatgagtgagaacatataatgtttggttttctgttcttgatttacttctcttagaataataagtctccaatcccatccaggttgatgcaaatgccattaactcattcccttttatggctgagtagtattccatcatatatatatatatatgtgtatatatatatgtgtgtgtatacatatatatacgtatatgtatgcgtgtgtatacgtatatacgtatatgtatgtgtgtgtatatatgtatatatatatgtgtgcatacatatatatgtgtatatatatacatatatatacacacacacacacacaccacagtttctttatccacttgttgattgatgggcatttgggctggttccccatttttgcagttgcgaattgtactgctacaaatggcgtgtgcaagtatctttttcgtataatgacttttcctctgggtggatacccagtagtgtgattgctgaatcaaatagtagttctacttttagttctttaaggaatctccacactgttttctatagtggttgtactagtttacattcccaccagcagcgtagaagtgttcccttctcaccacatccatgacaacatctattattttttaattttttgattatagccattcttggcgtgactgaagttgtatagcattgaatcccacgtactctaccgattttttctacagtggtaacatcttataaaaacagtatcttgcaaaacatcttgcacagtatcaccatgagggtaatgacattgatgtgatcttactcagattttcttacctggggattttaaaaaatacaggcaggcaggccctaccccataccaagtaagtgggtctctggggggtttggaccaggcattgccgttaaacaagaatctttcctggattattttaatgcacatccaggatcgagagctcctgcttttgtaagaaatctttctaaaacactgccgtctctgcttaactacaaataaataacagtgagctatttttgtgatgcatctcaatacagtgtttgcctattgatttttttttttaatggaaagaaaatctacttccgtattagctttcactcattgttcttagtacctgtagcaccctgaatggttttgttttttatataactatcattttggaatcctgaaggaaaaatttttcttcctgaggttaatcaacccccctttcctcagtcattcctgccttctaggtaattgctgtctttcttataataggcatagtatcataggccataactttgctaaattattgactgtatatacacaactcatcgtttgatcttgacactatattactatgtaactttgtataaatagcttaattattttcattaaatgatgggataaatagaagaatgagaatttatttaggttgacattattggatgagatagtaatcaggctgtttctaacctggagtgactggatcctttggggcccatggagatagtagtggtggtccttgcattattttcagtgttttaaaaagcctcatgtatatttttttaaaaagctgtcaagccacttttataaagtcagtagatttctataatcacttatgatttaagtttctttctaaatttttaatttttttttccctaaattgtcattcacctagtgataggaggtcatctggcttgaccatacaatggtttccccttatctacagtttcagtttccaaggtttcagttacctgaggtgtgcagcagtctgaaaatattaaatagaaaatttcagaaaaaaacaatttgtaagttttaaattgtacaccattctgagtagtgtgatgaaatctctcaccatcccacccaggacgtgaatcatccctttatccagtatatagcagtatatagactacctacctgctactggcctcggctggtcacttcactgttaccagattgaaaaaacatagcatgtataagttcggtattacctacactttcaagcttccactgagggtcttgggacatgttccctgaggatgaaggggactgctgtaatgtctcatttgatacagcttggggtatagttgatgcccagttagtgtttaagtgatggatagtatgctatctcagaaggtggcttaaaaaattcttaatgctctctaacatctgctctggcaaatcagctttccagagccctactttttttttttttcatttttaaaaatgactttttttttttttttttttttgagacagagtctctgtggcccaggctggagtgcagtggcatgatcttggctcactgcaacctctacctcctgggttcaagtgattatcgtgcctcagcctcccaattagctgagattacaggcatgcatcaccacacctggctaatttttgtattttttggtagagacagggtttcaccatgttggccaggctggtctcgaactcctgtcttcaggtgatccgccctcctcagcctcccaaagtgctgagatacaggcatgaaccactgtgcccagcctgacaattttggttttaaggccaaaagtttgaagatttaaatgaaaaatgccaaatattcaggaattttctcctattattattattatttttttttgtatgtaaatattgttgtgtagtattgttctttccttttttgctctgttccatttaaaagtgtcagaagtgccctgacaatacattttggcaaaaaacagagcaggtaatgaagtattaggtaacattttcttgttactgagacatttgcttagacaatgctaagaatagctatcatcctagacacttctccccaggcttgctttgccattgcctttgaaactgtcatacttataactcagatattaactggctctaattacctggtaatatgtcctctctcctaatcacaattgtacagtgtttttagggataaagtgtaaactagaaaccgagaagtattacctgattcttagcaagtatttataagtgaaagcctctaatgtggacatttatcttggaatttgtgacatttggacagatatttatctgaaacttacttgaaactcaaatttaataccttctctctttgaggcttttcccccttttattggcttatctgagaaccattcttgggatttgagtcatccttttttttttccttcattttccacatccagttatccctgatcaagttacctctgaaatttgtttcatgttgttgctatcctttttactaactaatcctagtttaggacctttttattttgcctccttgtctctgggcttccagtgtatcattctgttaccaaacacaaatttaatagtcatcctcctgctaaaaagagactttctgtcaaaagtctatcccagactccttactatggcattcatggcttccccatcttaacatagctaatttttttcaatctcatctgcagttgttcctcatcccttatcacccccagttgcactgtttgtaattctttactgtgtaacacatatttgtgttttcatgcttttgttcatacttgtccctcttcttttgataccttttcttttctttctgtctctcttttttcttgagacagggtttttgctctgttgctcaggctggagtgcagtggcacgatcacggctcactacagccttgaactcctgggctcaagcgatcctcccacctcagcctcctgagtagctgggactacagttgcatgccactacacctggctaattttttgtattattatttttatttatttattttttgtttgtttgttttgtttttggtagagacaattttttgccatgttgcctagactggtctcgacctcctggactcaaacgatcttcccacctcagcctcccaaagtgttgggattacaggcatgagccaccgtgcccagctctctttctcttcttaactgcctgatatattcctattgagaatctgccaggctggctgcggtggctcatctcctttcaggttcttctctacctttcctgtgcttccttatctatgtttgaatagtgcttcatatggatatttggtatagcctataagaggttatgatatagctatccctatatccaagcctctagctatatatgagggttttgaaggtgagaactaaaactccttcatctttgtgttcatagcagagtttcttctctgacagaagaaactcagtaaatatttgttgaagtttgtccttgcctagtaaatgcttgctttctcagtttccttgtggtaaaccaaagggatccagacaagattttcttctggcactaacaaattattttatgatttctagataatgccaaagtggtagtgtaagaagatggcaaggaagaaatgtttgaattccaagaggacaagcttcttaaggtccctgaatattcaaccttttaggtgaagctttattatttgcgtatagttccctggcgctgggtgtgaactgacacagtgatgatgttaaagacagtggaatcacccaggtgcagtggctcacgcctgcaatcccacaactttgggaggttgaggccagaggattacttgagtccaggagtttgagaccagcctgggctacatagactttttctctacaaaaaaaataaataaaattagctgggcttggtggcatgtgcctgtagtcagttacttgggaggctgaagtgggagaagaggattgctgagctcaggaggtcaatcaaggctgtagtaagccgagattgtgctactgcactccagcctaggcaacagggtgagaccatgtctcaaaaaaaaaaaaaaaaaaaaaagacagttgaatcagtttaatacagtacttctcaaagtatggtccataagaacaaaactatttaataataacagaaagacactatttgcctcttaaaatgttctggcatttgtgctgatgttgcagggcaatgaggaggtaaaaccactggcaccttagtacagaaggtatcagtggcaccaaagtatgctagtagtcattgtgttcttcactatcacacactcagagtaaaaaaatacgtttcacttaatcctaaatgaataagtaaaaattactagttttctaagtctttattccttaaggacacatcttaattgcttgtgtgacaaaatgggaggtatgcctaaagcacttctgcatactgaagtatggtggtcgtcccaaaatgaaaacatttgtgtgtgcttttgacttgtgagcttgtttctgtttctggacctaccctgggcaggtttccacagttgagaatcttagcgtattgctgttacctcaaatttccacacactaccagtttgtcttttgaaatgttatttttataagatgtcaaccctggtatggttcacttttgttatatgttggcacctctgtgggttacggaaagctttgccctccaaagcaaccagttggtttttaggaaagggaaatattgatctttgtggataagtagagtcttgttaaaagctattagaaggctctctttggaaaaaaatcagaaaaatcaaaagaactgtgaaaaggatgataataatggaaaagaggcctttgtagccttgtgaatgtaatacgtatagtcaccacagatttttcagggaggccagtcacggtggttcaagcgtgtaatcccagcactttgggaggctgaggcaggaggattgatagaaccaaggagtttgagaccagcctgggcaacatagtgagaccccatctctagcaaaaaaaatgtttttcagggaatgctgaaatgtctccttctcaaaaaaaaaaaaaaagtctccttctcttacaagttagtcaccttactcagtttattacagcaggagttcccaatcctcaggctgtggcctgttgtgaactgggcagcacagcaggaggcgagcagccagggagcgttaccacctgagctctgcctcgtgtcagattggcagcggcattagattctcataggagtgcaaaccctattgtaaattgtgcattcaagggatctaggttggcactccttatgagaatctaatgcctgataatctgaggtggaatattcattgttattgtctgactccactcccctcccgctcctttcatggaaaaattgtcttccatgaaaccagtccctagtgccaaaaagttggggaccactgtactgtagtttcaaaaatgttcatatttggcctaaatctatagtctgaggaagcatatcacatctttatcattcatgacaagcagggatgggagaggaagcagggataggagtggttatgtgggcagccaatagcataggaaacttaaaaggaacctacttagccaaacatgttttgagcctttgagtcccagtgactaaacaatgcagattaggataaaagatttgctcacacctgtaatccctgcactttgggaggccgaggtgggcagatcatgaggtcaggagttcgagaccagcctggccaacatggtgaaaccccgtgtctactaaaaatataaaaattagcccggtgtggtggtgtgctcctgtaatcccagctactcgggaggctgaggcaggagaattgcttgaacctgggaggcagaggttgcagtgagccgagatcgtgccactgcactccaggctggatgacagagtaagactcttgtctcgaaaaaaataaaaataaaaaataaaagatttattagcatgataaatcaggcttttcataatgtgcccctatctaccttagctgccatttctttatgcttattcgtattatagcataataatcacattccctgtggaaattttctgtatgcctttgtaaggtttttttcctatgcttcaaatgcttccccccacccccccataaacccattcatacttcatgacccactgtaaatattgtttcttccttgaatctttccctgtgagcctcagaattttgtatatacttttataataaaaagctcttatctcattatttccttactagatagactctgaaattcttggttgtttgatcagtgtattaattttggtattcacgttgtacccacaaagttcctggaacatagctgttagacattgagtgaaaagtcagatatgaatgaattttctaattgattttattattgataaaaataagtcttggtactatccccatttttttcctttgtgaattgttcacatttctcttctaccaaattcactgaattaacccttccctcattctctaacatactactttttgctcttaaccagttatcttacggaactttagttatcacaactgttatgtgaaataggtgacatttttactgttttgtggttaaggaattagaggcatagaggaattaaataaccagcttttcatagctggagttggaactcagtattttatatcattaaatatacacaaacgtgtgaatgttattgttgtgtgtgctgggtattttctgtttgcctctgcggaactcttctacctttttccatcctgctgtgctccagaagactgacttatacaggctgagtcaatgggctctgacttgtgacttcattgctgtggcctctgaatccaaataaatgactaagagtggaatagagtcagaagtctactacataccccatttaagactttacagcttacatatgtaccatcctcaagaaaatatcaagccaaaattgctgttatatttactgttttctactctaagcatttaaaaacacaaagtttaataaaaaataattctcgaccaaagtaatagaatacatatatattatataaaatttgttcgttatttatgtatgaagttacaaacttagactagtggtccaaaaagcccagcattcttctgaaagaagcaccaagagattctggaagaatagcaccgtgaaactgttatggaggcactagataacaaatgcttgctttaaagggagaagagccagtttattttgctcggtaatgagaaaatagttctttagtaaagttctcaggtgagcttattactaatgccgtttaacttcaaatgtgagaaaatatgtttactttttaacctgttcaccacttcacctcttatgaaggggaaaacttagggagtgggcctcaaattacttgtcatttaatttggaaatgttcctttgaaatttggaaacgtatgtacataattttagtcactgatttgttacagaatttttaaatgtagtaattacatttcattggccctaaaaatgttgtctgtttttaataatcatctctaattgtattgcattaatataatagctgggtccttaggatatatgataatgtatgaagcttgattataatgttgcattccacccagctataaagccaaagtggtgaaaataggacttttaaatatacagaagtattctagtcacccttaggaatgaaagtataacattaagcaatatttgaagatttaaggatggcagtaagcttgcctaatctttgattcataccactgtcaacacagtttttgattcatgtagagtcaaattaacaaggttggaaggatcctaatggttatcctagccaaccacatatcaagtactacctccctggtaagtggtcctgtagactattcttaaatgtctactctggctaaaccttcacagccacttccagaagacctctgatttagagttctttcatactctgattttgtcttcctgtagctttttacctgaacctacctggttctaacccttctcatgatagcgattctataattttaaagacttatttaacatattggagactagcagtgcaataacctaatccagactaacactttttggggggggaggtcagaacccagaataaagctgctgcttattctgggtttacttcttatggattgttgattagaaagattattctgcactggtattttggattgaggcctgtgcatgtctgttcaggcaaagtttacataaggtagaacactacagcagcacatgtgcaccctgctcaattaaataaatatcaggcagatctgtttgttcataccctcattgcagatactgaagggttggtgggttttgcagtaacgaatgaataattcatcttgatattactatattaatagttttgggttctgtatatttcctccgactcagaatttacaaaaataaaagcactttctagacagttaactagttagctctgagtagaatgttttctactacctttttaaagattctagatcattttgagcaaagaatattgaaattgcattgcaaacttatctttgtgaatcaggtttttcttcattctatgtacaaaacaaaatatagaaataagatgtatactgagcttttctccataacctcagattttttttaaaaagttaaaacagtcttagtatgctaagagtgactgtttataaacttttttaaaggattttaaattttttattgtttgtgcatacatatattttcttggttcaaattcaaaaagcacaaaagatttaaaaaaaacatatatatctgcctttatacctcaactacgtggttccctccctcacagtattattgatgtcttagtacttttctcataaatgcagaacccttccctaacctgatttttatatttcttataagatcctaaataatcgtgttatagtttatgaatttctgaggttagtgggtccctaaatataatgcttcagtttaattgggaaccatttgtaaattgagtacttgatttatttttatcagctgagatttctttagctgccacactgctgggggaatacagataatggacaactctttaagaaataatgtataaataaattataatgcgacgctttgtttcatagtagaagcataaggtcgagaaggaatatttaatgctcttctctgggaggaccgacttgctggtaggaatggaagctgaattttgaaaaatgaatggtagcttactaggcagatggggttagaggtggcattccagacaaaggaggaagaggaatggaagaagttgtggtatgttgaatgaacaataaggaattgaatattgctgaaattactgggaagtagagtggtaggagctggggctagacaggcagtgtgatcagattatgaaagcttttagcgtagtgctgttgagatggacttaattcactaggactacgtgaaacaactttaaacttttaaattaataaggaattagagtttaaaaggccactctgttggtactataggaaataaatgagaacaggacgggattaggaaactgggagagtagtgagtaatccattagaataacctgtgaaagaaatgggttagcaaggctggaatggaggagggaaggcattcaagataccgtgagaaatgatgaattattaggaaaaaaaaaaaaaacttagtgattaagtctttggtgtcatttagaaccacattcagttccagctttgccttttaccagctctgtgacttcgtatgtaaatttgattttaataaattctgtttcatcatctgtgagtattgtaattgtgtagttgaagctttaagcaactttcatttaactaacttggtgaatagttaatagttgctctccattccctcagtaaaagagacctagggcagtgttcatgacaggctctcagcttgtcggcctaagtggcaaaattaaccagtcacgatagcccttatactgtgtggtatcatttatacaaaatgtcctgaattggcaaatctatagagatagaaagtagatcagtggttgtcagaggctgagtgggggaaatggggcgtgactgctaatgagtatagggtttctttttagggtgatgaaatgttctaaaattaatggttgacacaactgtcacaattctgtgaatataatcaaaaccactgaactacttttgagagttaatttcatggtatatctcaagttgtcacagaaaaaaagtctaattcagtattccccatttgtccaatacgtcttttatagcttttcttcttttggtcaaggatcatggattgcatttggttatcatgtctctttatttgtccatgttcttgatgggttaaaataataaagaatatacaaatggttagatctcctataaacaaaagaatatacaaatggttagatctcctataaacaaaagtttcctgaaacttccttaaacatgtagcatggatctagtttattttagttgcatgcaaaataaaacaattgattaaattaaaattgttctttcatggctgtaagctcttggtgaagacaggtcagacaggtatttgggttaatgtcaggcaaaaatttctgtatcaaaacacaatatttatactggcttgagctagaatgttgagacattgttttaaggtttgtttttttaaaatagcttttagaagcttattgaggtgtaactatatatgctatataaactatgatatacaaatatatatactatacaaaaatatatcttacaatttttttcctcaagagatactgtttttctgtcacccaagctggagtgcagtggtgtaatcacagctcaccgcagccttcaactcctgggctcgagcaatccttccgcctcagcctcctgagcagctgggactacaggcacacaccaccacacctaattaaaaaaaatttttttttggagatggggtctgttgcccaggctagtctcaaactcctggcttcaggcagtcctcccacttcagcctaccaaagtgttgggattacaagcttgagccactgtgcctggccatagttttgtatataaatgtcttactattatagtttggtaatcgacctaaataatactgttacatattgttttaagcccccaaagttgtcttacctagatgtggtgctagcaaacgtttttataaaggcaggaatgtagaatggcaaaatgctgaaatacaaacatactctaagcacacagaccttagtgtcacagtagaaacttcctgcttgcaataattgccattttaattttggtgcagaaagccttctatggatgtgatagtttatgtaccaaagagcaatctctatttgaagaaactgtgtggcctggttacaaaagtgcctgctgtatctgtaactgtcagtggtattaaaaatactgatttattttgcctgttgtgataatcaagaatagcttatttggatatatgcatgggatggttgcaaataccaagttcaggtattttactatggaatatagataggggtgttttcttctggttttccccacccctttatatataccttgattttaatttttatcaagtgtgtctctttggcctttgccgctgtggcccattgatctgtccatctgtctgttacagtgcatattgggtacttccagaagtatgaattcagtgatgcaaaggacaggcgggctgcagcagcaaaggtaggacagaatcattccaaagacaagtcattaaaagaccattaaacacacatacttacacacagacattggcaaccagtacctcattatttaagggcacatcatttatcctataaatctttgtgggaaagtttgttttgacatgacaaatgtgatgtacttgtaaagggcacaattttattattatgttttaaaccagaagcctacttggcacttaggcaacaaagtaaatggcatttgccactgtctttaagatgccgaataatagaagagataattaaatggaggatattaatggtattaattgattcatggagctggctgattttcagaaactatgataaaggatcctattttgtaaactgggaggagaaacagagaagatagattgagctatgtgtgtatatttatgtgttaatgtttatttatattcctgactctggaatattttgatgaaaataatctaaatcttcctgttatttcgctgacatcactatgaggaagattaagaaattctatttaaatgtttgtaccatttacttaagtatttgtatcagtttacttgctaaatgatagcagttataatagcaatttctggcttaaaaaaaaaacagggttaggatggaagggcaatagcatttttatactgaatcctaaaacatcagttataggcaagttttaaaacttaatcatacgttgcaaacacttgaagatgaaatggaaggcttataaggttaagtgttaggttttatgtgtcattctagtattggctgaaaagtgagtgctatagggatggtggaatgatgcagatatttgcatcattttctatgctgttatgcttctaaaaagaagaggctatgttttcctaaataggttagtagagtgcttctcaaggcttcccaaatgaaaagtcagacaaaaatatgtatttgttcttcagtgaagattgttgggttttcaaaccagcaatcttagctgtaaaacctaagatcttaccacagcctaaattgtgactcaaatgctgatgttagttaatacttttataaactccatatactatattgaggagatctagtttcttgaatgtggaagtgaagcttcataatataccatagtagggatgtttcgaatcaatagtgttaaaatgttttgggttttttaaagattttttttcagctggtcttggaaaccttttcagttatctgtttttgattctaccaaaggtattaggtatttaatgctccactaaatagatcacaaaaggggagtcttaaggaggtgaagatgtgaacttcttgactagatgtaaatcactgctcagaaagatttgacttttttaaatgatgcattcttatgtcaatagactttaatctgcaaccaaaatgttttttttttaaataaaaatgaggcacatttgtgctttctcacttctgctccaattctaccttattctgcaagttgctattttttcctttagcagtacactatagatttaaaaattgtatggtattttctaatataaccatatcaatttatcagttttcctattgttggacatctaattcactcatatttgtgtcttcttcctttcccttacagagtttttgtaaagaaggctgagtgttttcaaaagttatgtttatatttacatgtgtgtgaactaccattttctgtatacccttgctgataactattaagaatcttggtctggcgtggtggctcacgcctgtgatcccagcacttagggaggctgaggcggtggatcacccgaggtcaggaattggagaccagcctgaccaacatggcgaaaccccgtctctactaaaaatacattagctgggtgtggtggtgcatgcctgtaatcccagctacctgggaggctgaggcaggagaatggcttgaacccaggaggcggaggttgcagggagccaagatcgtgccactgcattccagcctgggcaacaagagtgaaacactccatctcaaaaataaaaaaaaaaaagaactcttcaaatttttattaatctggtaaagaaaatactagttgttttaatttacatttttctgaattgcctttttatgtcgtttgcaccttttcataaatttttttttttttttttttttttttttttttttttttgagacaaagtcttgctctgtcacccaggctggagtgcagtagtgtgatctcggctcactgcgacctctgcctcccgggttcaagccattctcccgcctcatcctcctgagtagctgggaggcgcacgccaccacacttggctaatttttgtatttttagtagagacggggtttcaccatgttggtcaggctggcctcgaacttctgatctcaaatgatccacctgccttggcctcccaaagtgttggcgtgagccactgagcccagccagtaatggtatttaatgtataattattgtagctctttctccagtttgttatttgtaagaaaaaaaaaaagcaatacatgcatgtggtaacaaatgtaaatgttatatcttacaatgattacatttatagctttaatatgtctcttccttttgacattatctctttcctttttcttcctccatccttgagaaccccactttatgccagctatagttatatgttatcaaaatatttttgtcttgtgattataaccaaatgttattagttcgcttatagcttgatttttgaagtgacatcattgaatgtttgtttttatggtttataaatatcaatgacattctaagtagtgtattatgattactgttgctttttgtttttaacaggtctaatttcaaatgctgtgaaccttcctaagaacagtactctggtagcaagatggtttgggtttatttatactccttggagcccttcattctgctcttgtaatcaggatggctttccctgtaagcctcttacatatagctctcaaccatggactttgcatcattctcctgtgttggagcctctgattcttagatacatgtctttttcttgactgaatctcattgtgctggactgcatccttaatttaactctcacaacacttttttcccccctgcaacactcttaggctgttacttattgtggctctgataatgtgcttaattttccttcaaacttgattgctagattggctaggttggaaactctagattagaatatttgtgcaagacattgccttctgcattcactgttggtgataagactgatagtagtctggttgtcatttctctcttttttttttttgagttggagtcttgctctgttgccaggctggagtgtagtggcacaatctcgtctcactgcaacctccacctcctgtgttcaagcgatttctcctgcctcagcctcccgagtagctgggactacaggcgcacaccaccacgcccagctaatttttgtatttttaatagagacggggtttcactgtgttggccaggatgatgtcgatctcttgacctcgtgatctgcccgcctcggcctcccaaagtgctgggattacaggtgtgagccactttatgactttatttatttatttattttttaagtttcagccttttctctgaagagatatgtaagtgtgaatcttctaatccattgtgctggatcttcagtggaccctttcaactggaagacttgtgtccttataaagctttggggaattaacttctgttactgctttgctaatttcattccctctcttcttcttttggaattcctatcagttgaatgtgaaaaacaatggatataacttaaaataatgataagttatggaagaaagattgagaggtgcatgtagcgtgccagatcctcatctttcacattaggaaggtgacagataatatctaaaatagaaaaataataactccttgagcataagcatattatttagcataaaagtaaatactagaagacacagaagagtttaaaatggttacctcagaggattagaaatcagtagtgactgaagtatggcaaagaacactgttaaatcttgcagtaccattaacttctaaaactatgtatgtatattaaataaaataacttaaaagtgatttaatgtaatccttaaggtctacatttaatgataccttcattctttaaaatatcgtcaggaagtttatgtagacgtgttcttagaccaaatatacactatcagccttcatgggaggaggtacacactatgtattcctttgtcatgattcgtaattattgagctgtgtattttgagaataattgatagagaatgtactggagatttacatggcctgttattgcttggttttaaaacttaaaggatacaggggtatatttttgtctaattcaagatcatttggatttatgacttttattagctttaaagaagcctacaatggcttttttcaaaaatagaatttttcttagaaaacagtttttaagagacaaatttatttaaatgcccactcttttaaaataaagttagatgtatggttttcaaataatcttatgtttgttattgaacaaaatcttatttactgtatatacaaatatatagtatggatgagtaagaagcagtgaattgctaatcagaatcccaccacttatcagtaagtgttttgagttgcacggtttgagaaagtactggttcaaatgctgttaaaaatcaaatttttgtatgctgtctctagatggtttgttgatgacctagtggttgtgttaaagaagtggagttacattgaagtcacgcgaatgttttgcttgtgtgtttggtggaacatttttagtatatgccacagcagatacgtggaatgctgatacttagggcttaacagttggaacccagaagtgagtatgtgaacaaataactgaaaggttacaaaataactttaatcatctcacaattctaatcaccacaaaaataataaagtagcatgaggtggtctatatttatggtttacattagccccactgtgccagggcagtttggaatttaagttacctggttcttggctctacctttagtttgtaccctttttatcaatagggcttttttgcccctataaggaatagccagttaagagactgcaacccaagaaaatcttgcctgaatggagtttcaggtaacgataaaagtttaaaaactagggtgttatatatattagaagtgacttgtctcttgatgcaaagtcatagactgctattttaagtcttgagtatttttttttgatataacattgaaggataccttacctattgtttctattgttcatgtaaatatacccttccattatctctccccactttggtttgccgctgaatttttatggaagaaatcaaatgattatacatagtgataacatccttctacttacagaaacattgtattaaaacactgattaaactcttgatgttttctagaggtgaaatctttatatttgggatgacatagaaggaagtaatttccctcataaaataaatgtgcaaagaacagcaaagcccagatgtgtcattggctaggcacatttattaacaagtttggatgcatcaggattacatatttaaatcaaatgcatatctcagcaaaatttcaaattgttatgtatttataggattgccaacagttaattgaaacttgtcattgttaaattttgctttaaataatctccaagagtaatgagtggctgggcactcactcatggctgtaatcccagcactttgggaggctaagacaggctgattgcttcagcccaagagtttcagaccagccagggcaacatggcgaaaccctgtctctacaaaaaaataaaaaaattagcctggcatcgtggcacgtgcctgtagtcccagttacttgggaagctgaggtgagaggattgcctgagcctgggaggcagaagttgcagtgagccaagatctcgccactgtactccagcctgagcgacagagccagaccctgtcttaaataaaataaaattaaaaaaaagagtgatgaaggtatgacattcctgcctgctgaagtaatctgagaagcctctttaagggggagttctctcaagaatattatcctcaacatttttaccttttaccttccttctcctgtggtagcttagaagtaaatattcataactgggaagtttgatgatcagtgtttagttgtaaattcttttaaaatgcacatacttttaagccatctagagattgtgtggattgtctcccttagccccactaggtgcttctctgtcctaagtagtctagaaggccaaaaactatttctcagactattttgcatttagggttctagatataaaatagttgtgacaattataatatatatgtgggagatttgaagggagtttatgttttcttcgtttttgtggtctgggtcatgaagaagtgagattttgccaacagtagcagaaatgcagcatagcattatttattctccagcatcttgagttatcaagaggcttttgtggttaaggcagcagctagactgttttattgtgtacatcccctagctgggtatttagaggcagttgtgacagtggcaacttcctgattcaagctttccaatccttggatcacagttatctgccatgtgttcttggatttagtggtcccattggtagcttcttatgatttcagttctgtagtgttctggtagtcactcctggagacatattcctatagccccattcctccattctttcccgtaactaagcatctaattcctttttaactcccctttgctcagaatatctagtggtttctattccctccaccaaatactgattgatcaaagtcaagagcatcctttggtgacaaaatgctactcttacatttagtagatggtactgtatgtgatgcaggatttttcttgaccccttctttggacttgtgatggaggtgccccatttactctgcttgcagccctcaaccccttgcaggagggagcacgtgagcaagtgaatgcgggatctggctggctgctttgggtgctggcaggagcaagtttcatgtgggccctgcgatggcacccaggttggggtgcctgcaacccctgaagccctagagggcatgttacaatgctgtcttagctccaccgtctgtggacagcggtgtgttaccagctcagtaggctccttgccttgttgcgtggggcagccgccctccactagtgagggcaaagggccagtgtgatagcctttatttatttatttattttttagatggagtttcgcccttgtcgcccaggctggagtgcagtggcacgatcttggctcactgcaacctctgcctcctgggttcaagcgattctcctgcctcagtctcttgaatagctgggattacaggtacccgccaccatgccccactaatttttgtatttttagtagagatggcgttttgccatgttggccaggctggactcgagcttctgacctcaggttaatctgccgtctcagcctcccagagtactgggattacagtgtgagccaccgcacccagccagacagccttttttgggtacctgcacttggtgggtcccaagttcttgtctggtgtccaagaaaaatgaggtcctgccagacgcttgaaggatggtggaggcggataattttctttagtgatgaaaatggctcttagcagagaggggagctagagaagagacaggttgggcaggtaatctttcctgaagtcaagctgcccctctgaagtccagggacctctctccagtcaagccgcttctctcgttcgtctttatctgcacaggatgaggggtgggttggccatcagtagttttggaaaaagcaacattcgattggtaaaaagacattattcggaaagaaccaactgggagagaatcggcagacggaagttctcattttgggccacaggtttcaggctttttggtttgaagttggggtttcactgggaacccacccctgtctgcctagaatgtctctgcttcctgcctctatcattgaacttcagatatataaagaagttattctatgatatgtcattgactaagcattaattatgttgacccttttagtgactctaaataaagagctctcaacaaacctatacctttaaagggaagaaaaactatacctgaattacacatgataatttcttagaaggcattaagtatttaatcatatctgaggagaatttggaaatgaaaccatttacagttgcaatttaaccagctctcaagagcattacttcctgtagcttatatcagtgctcctcaaactttaacatgcatacagatcacctcaggaacacttgagggtctgttcaaagtgaagattcagtagatggctgttgggacctgggattctacatttctcacaaactcaggtgattgtaattttgtgaaccacactttaagtagcaaagcctatagtatttacagttataaataaaggtaatattttacatttctatttatttgaaatttctttttgaatattaccatatcatagaaatttacttttttaacacaaaaatggaatattgtgcactactcagtagcttgttttttttcgctcagtggtatctcatgaataaccttccatatttttttaatggctgcataatatttcaagtatgaatatagcataatttataggcagtctcctcttgaaaaaatgtataaatgggaaaatgctttcccaaataatgtggatgtgaaaattcttatacttctatacttggtatttctgttgagcaggttcctataatgggtatttctaggtcctagttcatgtgcattttaaattttgatcacttctgccaaactaccctcagaaaaggtttgaccaaagttgccatctcattaacaaattatgacctgtttctcttgccgttgtcactggatagtgtcttttttttctccctgagacggggtcttgctttgttgcccagaggtggagtgcagtggtgcgatcttggttcactgcaccctctgcctcccgagttcaagcagttctccttcttcagcctcccgaggagctgggattacaggctcgtgccaccatagcgggtaattttttgtgtttttagtagagatggggtttcaccatgttggccaggctggtcttgaactcctgacctcatgatccaccctccttggccttccaaagtactgggattacaggtgtgagccactgtgcccagccaatagtatcagcttttaaaaacttagtcattgtgggccaggcgcgtggctcacgcctataataccagcacttggggaggccgaggcgggcggatcatgaggtcaggagatcgagaccatcctggctaacacggtgaaactctttctctactaaaaaatacaaaaatattagccaggcgtggtggtgggcacctgtaatcccagctactcaggaggctgaggcaggggaatggcgtgcacccgggaggtggagcttgcaatgaggcgagattgcgccactgcactccagcctgggcgacagagcaagactccgtctcacaaaaaaaaaaaaaagaaaaaaaaaaagaacttagtcattgtggaagatttaaagcattcattgtattaaggagattggatattttcgtgtgtttttcagccaattgtaatatgggaattgatgaactgtccatttttgttggattattttcttttttgagtgggtatgcttgctcatttttgttgtagcatttataaatattccttagaatacagatgtttttatactttgtgacttttgagtttctaatattgtttaaaaagtattaaaaaattctctttaaattttggacccataagcagctcatttgaggagcttgtagattttatgcaaacatgagcccatgcttctgtaggaaaatcttaaaactgaggtttaaggtggtgcctctaacctgtttaattctcgttcagatcaaattctgaaataataaaaaggtgggttttggaggttttctgtgtatgtaaactggaataaaaaagtggtttttttttgttttttttgtttgtttttttacttagctttatcctaaaataagaaagttgtctcttgagatttttgaaaaagtagttgcctcccactctgctaaatataggaatgtcattcagcaatttggttgtgattatttttatgtatgtatgtatgtatgtatgtatgtatgtatgtatgtatttatttatttattttttgaaacgcagtcgtgccctgtcgcccaggctggagtgcagtggcatgatctcagctcaccgcaacctctgcctcctgggttcaagtgtttctcttgcctcagcctcccaagtagctaggactataggcgcacaccaccgtgcccggctaatatttgtatatttttggtagagacggggtttcaccatgttggccaggctggtctcgaactctgacctcaagtgatccgcctgccttggcctcccaaagtgctgggattacaggcgtgagccaccatgcctggctttggttgtgattctacctggagagtttgtcatactcttgaatatgggcctgtctgcacacatgtgtgcatccagattatgattctccactgtgactgcttattggaatctcttgggagtttttgaaaatggtaatgcccaggtgtccccctcagtcctcttcctcactccccccatattctgatatatttggcctggggtttgtggcttgtttaaaagcttcctagatggctgtgcacagtggctcattcctataatccctgtgttttgggaggctgaagctggaggattgcatgagcccaggaatttgagaccagcctgggcaacatagcaagatcctgtctttaaataaaaataaataaataaataacagtcaattaagagcttatgtgctactaaaattgagaactacttgatcaaaggataggggatgatggtgcaattgatgttaaagcttcagctaggacagttgacataatcagacttactaatcaactttttcaaaatgcaaaactttaaagtaaatacagctgctctgagcctggaatgttattttctttagattactaaaatactatactgccacattcatgggagttctacagatgtactttttcggagcctgtgtagtgggaaattgtttagagcagtagttcccagttctgtctgcatgttaggatcatctggggaccttcagataaaaatgttggatgaaaatatatatattcatattctacccttgacagttgaatcagaattgctgggggcaaagcccaattaatggtattttttaagttcctcaggagattcttatatgtagccagaatggacaggggtgggtggtactgatttagagttataactagacaagatgtaaggttttaggttgttctattgtcctaaaagttaaatgtactgctgctagtattagtactagttttctgattatagtgattttactcaaactgtttttgtttggtttgtttatatcctttaaaaaggatgaagagctctttatttcagccaagagcttgaattggcttttcactgaactatcagttttggtggcacaccgaagtgaatttctctcctttgacaagtccttgtagggagtggtgctataatcataaattaaaaaataatttctccatgtattcaaatcctactagcctattttatcctggaccaagacacttaacctctgtaacctcatctgtaaaatgtaaatcatatctaacttgcataaaatattgatgtgagtattaaatgaaataatgtatataaagtatctagcattgtgcccggcactaaataatttcaaatctatgttctccttttcagcattcccttttactctcattgttctttctttcttttttttttttttttgagacggagtctctctctatcacccaggctggagtgtagtggtgcagtctcggctcactgcaacctccacgtcccgggttcaagcaattctcctgtctcagactcccgagtagctgggactacaggcatacgccaccatgcccggctaatttttgtatttttagtagagatgaggtttcaccatattggtcaggctggtctcaaactcctgactttaggtgatctacccgccttagcttcccaaagtgctgggattacaggtgtgagccactgtgcctggccctttttttttttttttgagactgagtcttgctctgttgcccaggctgggtgcagtggcctgatctcagctcactgcaacctccgcttcctgggttcaggtgattctcatgcctcagccacccaagtagctgggactacaggcgtgcatcaccactcccagctaatgtttatatttttagtagagacaaggtttcatcatgttggtcagcctggccttgaagtcctgaccttaagtgatcacctgcctcggtctcccaaagtggtgggattacaggtgtgagccaccacacctggcccacattgttctttttaaaagaacttcactacaggtgctccagtgcaggctagattacgtttatagttgaatactttaagtttcatacaataaaatttacactggagcatacagttctctgagttttgataaatgcctagagttgtgtaaaccaccaccatagttaatttacagaacagtttcccctcaccatcacccctcaaatttctttctaccccattgtttagtcaaaccctcccccacctttaatatttggcagctctggatttgtaccctatccttacttatttatttctatttattttcactcattcatttaagacagggtcttactctttcgcccaggctggaatgcagtgatgcgatcataggtcactacagccttgtgctactggactcaagggatcctactcacctcagtctctagagtagctgggactacaggcatgtgtgtcatcatgcctggctaattttttaaaaatttttagtagaggtcttgctttgttgcccaggctagtctgaaactcttgggctcaagcagtcctcccgccttggcccctcaaagtgttgggattacaggtgtgacaccaatcgcccactccagccccacctttttttttttttttccccaaagagagatggggcctcactgtgttgtccaggctagagtgcagtgactgttcacagatgggatcctagcacactacatctttgaactccttagctcaagtgatcctcctgcctcagcctcctgagtacctgggactacagggatctcccacctcttctggcctgagccctgtaattttgccttttccactgtgtcatttaaatagaattgtaaatcaatttttaaaatgggcttttattttcttgttaggtttttagatttttaaaaaattattctaggtacaaattcttcatcagaaatgtaatttgcaggtatcttctcctagtctgtggtatatcttgtattttcttaacagtatcttttactttcgatggatttcagtgtatccgttttctctaatggattgtgcttttgatgtatgtacgaactatttgtgtaactcaaggtcacaaacattttctttaagttttacagtctgatttacatttgggtctgatccattattaattttgtattaaatgtgagctaaagtacattttaaaaatatgtacatcttaattattccagtactacccagcactttgggaggccgaggcgggtggatcacgaggtcaggagatcgagaccatcctggctaacatggtgaaagcccatctctactaaaaaaattaggcgggcttggtggtgggcgcctgtattcccagctactggggaggctgaggcagcagaatgatgtgaatccgggaggcggagcttgcagtgagccgagatcacgccactgcactccagcctgggcaacagagcaagactctgactcaaaaaaaaaaaaaaaaaaaaaaaaaaaaaaaaaagactttttccccgttgaattgttttatcacttttgtaaaagatcacttttgctgtatttatgtgggtctatttctggtctccattccattcttttgatctgtatatctttttgccagtactgtaacttcatagttatgttttgaaatcaggtgttctgttttaaaatttttcaaaatttggccactctagtttccttggtattccatataaaatttagaatcactttgatgtttatccaaaaaatatttggagtttgattggcattgagtggaatctataggtcagtttgggaagaattaacattttaattatgttgttttccaatccatgaagatggcatctctctccattatttaggtcttattaaaatttctttcatcaatattttgcagttttccgtgtacacgttcttcacatattaaatttatacctatgtatttcacgttttggtgctattgtaagtggcactttaaatttttttgatcttcagttattcattactagtatgtaaaaatatagctgatcttttctttctttctttcttttttgagatggagttttgctcttgttgtccaggctggagtgcagtggcgccatcttggctcacttgtaacctccgcttcccgggttcaagtgattgtcctgcctcagtctcctgagtagctgagattacaggcgtctgccaccatgccctgctaattttttgtatttttagtagaaatggggtttcatcatgttggccaggctggtcttgaactcctcacctcaggtgatccacacaccttggcctctcaaagtgctaggattacaggcatgaaccaccgtgcctggcccagctgatctttttatattggccttggacttcgctaaactcatttcttctaggaattttttgtagattaatgggattttctgcatagccacatacatagtcatctgattagaaacagcttttttcctttccaatttcttttatttctttttcttgccatattgtatttgtaagactccgtccagtacagagttgactgagagtgactgggcagctggcctagaagtgcctcttctaggcacttctttttcgtttcctagtttgctgagagatttttatagtagtggatgttgaattttgtcaaatgctttatttatatcctatcctgtgacttttcttcattaggcttttagtgtggtaattaaattgaattttgaatatttaaaactatccgtgcaatcccaggacgaaccccacttgattgtggtgtaattatcctttttatatattgctagattgtatttcctaatatttcattgaggatttttgcatctttgttcatgtagtaattttcttgaaatgtctttgtcggattttgatatcagtgtgatcttatggaaattgggaagtggtccctcctattctagtttttggaagagtggtgtagaatttttttttttcttccttgaatgattagtagaattttccagtgacaccatttttggtccatgagttttctttgtgcaagagagttaattacatactcagtttgcttaatagatataggatcattcgtgttgtgtcttctttagtgaggtttagtaatttgtgtctttaagaagttggcctgttttattgagttgatgaatttaatgggcaaagagtttgtagtatttgcttatcatcctaggtagagttttattagtttcattgatctttagcactagcttttggttttgtttctcggtttttttctttttttttttcctttttaatttcattgacttctgctgtttattattccctttcttctgcttgctttgggtttttctttttcttttttttcctgaagtgtttgagatctttctgattttcttacataagcatttaatatgataaattttcctgtaaacactgttatgtcccacaactttgatatgttgtattttcatttttgtctagttcaagatatttctaattttctttgagatttcctctttcaagcttggatttagcaaaagatggtttaatttggaagtaggctgtctacatattcagtggattactgagagaggagtgttgaaatctcttaagtataattgtggaatcatctatttgatttctatcagttttttctttattttgaagttactgctgctaatttttcttgttctggagtttgctttgtctgatagaaatatggccactgtagccttcatgtgattagtgtttgcgtgatatatcttttcccatctttttacttttaatctgtatatatcaatcattacattgaaaactgagctgttatggacagcatagagttttgccctttttaaaaaaaagatctgagcggttgccctgccttttaaatggtttgttttgaacatttacacttgatgtaattatttacgtggttagatttaggtcttttaaaattacttttctctttgttcctcctttttctgccttttggattacttgaaatttttaaaatattctacttgatatatttattggctttttaaaagcttttctcttggtcttactattttagtggttgctctagggagtataatctaactcttgacattctagttaaggtaaatattttaccttctcaaagtaaaacaggtttttttcctagcctctttatattacagttgtcgtatgtgttatgtctagaaacatttaactcttcctaccaagcatgatgttacagttttttatttcaacagttttataagttttcaagaatttaagtggagaaaaatagtgtataatatttacccaggtatttaccatttctgtcgcttttccttctttcctgtagttccaagtttacccccatatcatttcccttccacccaaagaatttcttatagcttttcttttagagcaggtttcaatctctctctctccctctccctccctccccctctccctccctccctccccctgtccctccttccctccctccccctccctccctccccctctccctccctccctccccctctccctccctccccctctccctccttccctccctccccctctccctccccctctccctccctccctctctgtctctctccctccttccctctaccccccgccccgcctccgccaaagacagagtcttgtctgaggctggaaggctggagtgcagtggtgtgatcacagctcattgcaacctcagcctcctcagctactgggactaatacgccaccacgcccagctaattttttgtagtttttgtagagatggggtctcaccatgttgctcagactggtctcgaactcctgggctcaagtgatcctcctgccttagcctcccaaagcactgaaattagaggcatgagccactgcacctagcctgttttttgcttttttgtctgataatgtgtttgtcttcatttctgaactatacttttagtgaatacagaattctagcttgataccttttgatatcctataggggcctgagagattgtttgtttttaaaaaatatttcttctctcttttgttaagattggataatttgtgttgccatatcttcaagttcactgactcttctgtcatcttctttctgatagtgagccggtccagtgagtgagttctaaaattttcatttttttaaaaaatagtaaactctttcttttttgagaatttcagaccgggctctgtaatcccagcactttgggaggtcaaggtgggaggatcatttgagtctgggagttcgagaccagcttgggcggtatacaaaaccctgtcgctactgaaaatacaaaatattagctgggcacggtggtgcatgcctgtagttcagctgctcaggaggctgaggtgggagaatcacctgaaccaagaggttgaggctgcagcaagctgagattgcaccactgcactccatcctggacgacaaagcaagaccttgtcttaaaaaaaaaaagaggattttggccaggcgcagtggctcatgcctgtaatcccagcactttgggaggccaaggtgggtggatcatttgaggtcaggagtttgagaccagtagagggggtttcaccctctctactaaaaataaagaaaattagctgagtgtggtggcatgcccctgtaatcccagccactcaggagaattgcttgaatccaggaggcagagggtgcagtgagcctagatcacgccactgcactccagcctgaatgacagaacaagactccatcaaaaaaacaacaaaaaagataatttcacatttcatttgttttaaggtgttctttttttacctaatggatcatggttgtaataactgctggcctgtaatccgagcactttgggaggccgaggtgggcagatcacctgaggtcgggagttcgagacctgcctgaccaacatggagaaaccctgtctctactaaaaatacaaaaaattagacgggcatggtggcgcatgcctgtaatcccagctacttgggaggctgaggcaggagaattgcttgaacccgggaggtggaggttgtgggagccgagatcgtgccattgcactccagcctggtcagcaagagtggaactacgtctcgaaaaataaaaaataaaaataaaaaaatataaaataactgctttaaaagtctttgataattgtaatatctgggtcatctaggagtcagcatctgttgattatcttctgctttaagaattggtcagttttttgttttttgtatttgctgtgtttggtagtttagattctatcgcggacattttgaatattgtattgtgagattctgagtcctgttgaagtgctgtagagaaagtttaagatttgttttagtagacaaattgacctatttagtttatacctgcaaattctttctcatcttacataggcagtggttccattatctcttcagttttcaaagtctttgccatgttgtttgcatttgcccctcccattcccactttggttgatctagcacttgagcagtgatttatatcctaattttattgtgaaagcctcccttacacttctttggatctgttccatatatatatagatagcttgcagctgggcccacagacttagggatctacttttctgtctcttaatcatcagtgatttcacctatattcttcagctcccaggggccttctttattcccctagccagaagcatggaattatagtttgagtctcctacctgtcatgcctcacatggcagtgagcacatttagggagcccttgccctaaccatattaaataaaaacatggtggtggaaactaggaatctgttttaacaaaacttaccatagttacttttgataaaccaataacagatttgggaacttgtggctagaaacaatatttggcactagcaacatcaagttatactccctcccctctgttttttccctttttgcaagttgaggctcttaacaattcctgaaatagtttaccccaagcaccctatccagtggtagaaaatacagtgtactggatgccacaaagttatagtcatgcaattttagttaataacaggagacttaagtctcttgattgatggagagacttaagatttagcttattttacatatagctaaatctaaattagtgactttatttcagttgtaggcaaatcctcttgttaaaacttgtttttaatttctgagttcttttaaaaaaaaagttttacatcacatttctaagagctggagatgacagtgtctctgttttctgttttctctacaaataaacgtataacttaggatcagttaaaatatttcttttcacatcttaactcttatagatgggtggtgtctatcagcagtgctctgttaaagacagattcttaggggagtgtgggtccagagaagtaaggagtacctagattagcaaaatgtactaaggtgagtaagtgagtgtctgtatctttggcttttggaggggagtatgcatgtgtgtaaatttttctgtaacaaatggtactgtcgaaaacaattgacatacatttctttcatgacactatttttatacaagattactttaaatctgtagctaactacggtctgcttgtggtgaagtaaagtggttttagtccacagagatcttttttggaaggttatttgatgtagtaaaattatatatgagataaaaataagcagacacatgtttgagttccacttctgctattgtaactagctcttgtatctttgaatgagtcaggccttgctgacttcttaggccccgttgcattttgagttaaaattttgtgcacaaatagtgagctcactagtttcatgggaaatggagatatttgtgacagcattgaatgataaggcagtaaactttggttttatttcatagtggtaacttttctttcttgaaatagcagcctaaaagtatgccctgtaaactactatgtggtacagtattttttcattttggttaaatatctctgaagtatccttctaacttaaaagtgatttgaactcatttgaactattcagtgtataaggtattaaattatttttttaaaagagactgggtctaactatgttgtccaggcttcactcgaactctggggcctgagatcctcctgcctcaacctcctgagtggttaggactataggcacatgcgatcgtgcctgagtgttggaaattttccttttttaaaacaaatttttttttttttgagtcagagtcttgccctgttgcccaggctggagtgcagtggtgggatcttggctcactgcaacctccatctcccaggttcaggtgattctcgtgcctcagcctcccaagtagctgggactacaggtgtgtaccactacacctggctaatttttgtatttttattagggacgggttttgccttgttgcccaggctggtcacaaactcctgagctcaagcagtcagcctgccttggcctctctaagtgctgggattacaggtgtgagcaccctgcctggctgaaattttgattacatttagtgtgctgatgtggcagtctgctgaaattattttttttttgcaattaagacagcgccggatttactatagtaacttactttctgtttaatttctttttggcttatttttaatcctaaagaaacctgacatagtagtgtggcagactatgtttaaatagtcttgatcttatcattcaaatatatttccttagaggaataaagaaataactctagggatggaaatttgggtggagtattgtggaaatttaacttcaacctaggagttcactaaatgtccatgaagtgctattaccttaaaatgactttttttcccctccttctttagaatccagcaactatcacaagaatactccttagccacttcaattgggataaagagaagctaatggaaaggtaaggaactatattgtcagctttgtacttagaagtaacacagaaagcctattgaaccgaatttacaagaatcaagtaagggaattgatgaatataccagtatgtggacaacccagtgtgcaactagtgactgctttaatttcttgtattccccttttgtaaattttgcagtaaatttaatgttagggagttcagtcttagtgtttctttttatttgggagtatgtgtgtttgggggtgtgcttcagtatcttctacatatatcctcttgggtaccaagaactgaaagcaggtagagaaaaaaagcacctgataacattcttggagtacatgagtaagatcctcctttaattacttaaaaagatttcttgctcatccgggcatggtggctcacgcctgtgatcccagcactttgggaggctgaggcaggtggaacacgaggtcaggagattgagaccaccctggccaacatgctgaagccccgtctctactaaaaatacaaaaattagctgggtgtggtggcgtatgcctgtagttccagctactcaggaggctgaggcaggagaatcactttaacctgggaggcggaggttgcagtgagcagagatggcgctactacactccagcctggcaacagagcgagactctatctcaaaaaaaaaaaaaaaaaaaattcttgctcacaaacctttaacctgttattagtagcatttattcagtagaaacaaaattgagaagttgcttaggcttttctggccaccagaccaggtgcttggactggttctctggtttcagggcaggattctattccattgggtttttaaaaatattttctttctgaaaatctttatagttttaaaagagaagaaattagtgggactggagaatgacagtattaatgtcattcttaatcttgttctgctctttggtttggaaatttgtttgaatggaaatttgggacacttgttaatggtgaggttgacaacttatgtttatttcattatcaattctaaatttaataaaaaattaaacctagttgttgggaactgacaacccatatattatagaaataaatggaaagtatttcccatttgattttaaaattcagagagtactttataaaacataaataataccgagaatatcaccccatttcatacaccttgtatctattaaattacattgtaaataatatctattgttactattaaattacaatttaatagtaacaactatctcaaaacaaacacatactgtataaagctttcccatggttcatgaaggataacatgttcaactagtttgatttttctttttatgcattctgaccatgttttttttgtttttttttttttttttttttttttgagacggagtttcgctcttgttgcccaggctggagtgcaatggcgtgacctcggctcactgcaacctccacctcctgggttcaagcgattctcctgtctcagcctcccaagtaactgggattacaggcgccctccaccatgcctggctaatttttgtatttttattagaaatgaggtttctcagtgttggtcaggctggtctcgaactcccaacctcaggtgatctgcccgcctcagcctcccaaagtgctgggattacagttgtgagccactgtgcccagccctgaccgtattttttgacatcagtggtgtttcttaattttggtaacatttactttcaggtttttttatttgatgacacctctactaggagaaagagtttttatcgtttacttgtgaaactctaatgaattaacactgatttactcagagtttctctcatattaatgtatttctccaagacattctgaattttatcctataacactgctgaaaatatttttccattaaatattgtacttaatatttgtgtactattggatttaatgttgtactaaattttgtactttatatgggaactgtagcttctgctcagtttttctgggaaccttaaactgtctaaaaaaataggtggtaagtgtgaatttaaattaaaaggaggtttctgggaaacttctgagtatgtgaacgtttcagtttctccttgtagtttctgtagagaagctattggatacctaaaagatttataattcagtctttaaatagtgtctttaaaatcaatatgcaatatctttttgtctcatttaatgattttcacattatattttatgttgtctgctattagcactgccacactttttttttttttaaagcatttgactgatgtatcttttccattttttaaatattcaacctttctgggttttaggagtgtcttttgtaaataccatgtaggtgccgtttaaaaaaatctgaatgaaaaaactattatcttttaatatcagagattaacatattcatgttttataattaatgtttagattaaattactgtcattttaagttgtgctttatatttgttatgttttctgttcgcttattctgttggcctcatcagattttcctttttctcgaataatttcaaatttatatatgtattctatttcagtttttctagtcacttttacaatttgtacatgcctacttacaactatataaaagtttctaacaatatttacttgaagttttaatccatcctctgtacaagacaaaaactgtagcataaatttttttctttgtcctttccttgtccctatcagcttgataagttgatgtttgaatttttttttttcttttctttttgaaacagggtctcactctgtcacccaggctggagtgcagtggtgagatcatggctcactatagccttgacctcctggactcaagcaatccttccatttcagcacccccagtagctgggaccacaggcacgcatcaccatacctagttagtttttatatttttttgtagagatggggtttcaccatgttgcccaggctggtctcaaactcctggacccaagcaaccctttcaccttgaactcccaaaatgctggaattacagacatgagccactgtgcccagtcgatatttgaattttttatttgattgtaagcatttttactatgtatgtatttaatgccccccccccccccttttctggctaattcgctttttgcataccactattttttttctaaatacactgtttttcttagaatatatcctgtaatataaattgtttcacatgtgacaaactttaagtcctataatagaaactcttaatatactgaaacttactgtaatatttctggatgtgagttttgaaaacataaactgttgggccctttaagtctgacaattcatatttttggttttggaaattctcagctgttatttgttcagcataccttttctccattctcttgatgctttctggaattcctggatccatgttgaaacttggggatctctttccatgtcttctaacttttttttttttaagatggagtcttgcctctgtcagccaggctggagggagtgcaagtggtgccatctcggctcactgcaacctccgccttgtgagttcaagggatcctcctgccttagcctcctgagtagctggggttacaggcacccaccaccatgcctggctaatttttgtatttttagtagagagagggtttcaccatgttggccaggctggtctcaaactcctgacttcaggtgatcttcccctctctacctcccaaagtgctggggttacaggcatgagtcattgcatccagcatgtcttctaactttctaaaaaatacttcttctgtattcatctccccacccccagcacttgggcaagtgccagtgactgtactcatctttgtttttgactttgttctgtgaaaattcctcagtttatcttgcttttcttcctgcatccattctgctttatagtcgtattgaattgtttattcaacagtatccatcttattccttttaataactttgttcttgttttgtgggtacaatttttgctttatctctcggtttattcttacattaaaataattagaattaaataatgagaatacaaagatgagatgtggctgaaaaggtccagggcaatttacagtcttaagggtttttattagaaaaagaaaatgaggtaaaaaactgggctgcgcaccatggctcacacctgtaatcccagcacattgtgaggccagggaaggcagctcacatgaggccaggagtttgagaccagcctggcctacatggtgaaaccccatctttactaaaaacacaaaagttagccaggcgtggtgatggacacctgttattccagctatgcaggacgtggaagctgaggcacgaaaatggcttgaacccgggaggctgaggttgtggtgagctgagattgtgccattgcactacagcctgggcaacagagtgagactctgtctcgaaaaaaagaaaaataaaaacaagagaatgaggtaaaaaaaaggaccaagcctttgaaacaggaagttagaaaaataaaataaacccaaagaaagtagaaaaggtatttaagataaaattagatattaatgaactagagagcaacaacaacaacaaaaaagataaagatctttgacatgaattttctggaagataagctacagactgagaagatatttgcaaaagacacatgtaacaaaggactcttgtccgaaatatacaaagaactcttaaaactcaacagtaagaaaacagtctgattaaaaaatgggccaaagagcttaacagacacctcaccaaagaagttatacagatggcaaataaatgaaaagatgctccatgtcctatgccatcagggaaatgcaaattaaaacaacattgagataccagtacatacctattagaatggccaaaatcaaaatactgactaccaaatgtggaccaggatgtggagcggtaggaactctcatcatttctcgtgggaacgcaaaatggtacagccacaaaatggaagacagcgtggcagattcttaaaatacaaaatgtactcttactatgtaactcagcaatcaaaacttctttaaaattacccaaatgagttgaaaactgtgtccatacaaaaacctgcacatggatgttcatagcagctttattcataattgccaaaacttggaagcaaccaagatgtctttcagtagatgaaaggatgagtaaactgtggtacatccagaagtgggatattattccgtgctaaagaaatcagctatcaaaccatgaaaaaccgtggagggactttaaatgcatattattaaatgaaataagccaatctgcaatggctgtatactgtacgattccacctatgtgacactctggaaaaggcaaaactatgaagacaatgaaaagatcagtggttgctaggggttagtgaagagggagggatgaatagtcaacagcacagttttttttttttttgggtgggtgggggcctaaactattttgtatgatactgtaatggtggatatgtatcattatgcatttgtcctgacccatagagtgtataacatcaaataagaacccttatgtaaactacagactttgggtaacaacggtgtgtcaatgtaggttcattgaatgtaccactctgtgttgttgatagggaggctatgggtatgtattaggacagggttatatgggagctgtagcttctgcatatgtttgctgtgagccttaaactgctctaaaaaataataagttttttttttcttttaaagggggaaataaaccgttggcaaatgtgttgggggagggggagaagacacaacattgagaataataaggcataattagaggtaggaaaaataccgtgtgctacttttacatctttttttttttttttttttttttttgagatggagtctcgctcttttgcccaggctggagtgcagtggcgcaatctcggctcactgtaagctccgcctcccgggctcacgccattctcctgcctcagcctcctgagtagctgggactacaggcgcctgccaccatgcctggcgaatttttttgtatttttagtagagacggggtttcaccatattagctaagatggtctcgatctcctgacctcgtgatccgcccacctcggcctcccaaagtgctgggattacaggtgtgagccactgtgcccggccttttttttttttttgagatggatggagtcttgctcggttgcccaggctggagtgcaatggtgcaatgtccactcattgcaacctctgcctcccggttcaagcgattacaggcgtgcgccaccatgcctagctaatgtttgtattttttggtagagatggggttttgccatgttggccaggctggtctggaactctgacctcaagtgatccgcccaccttggcctcccaaagtgctgtgtgagccactgcgccagcccaagctggtccacttttacatacatttgaaagcttagaaatggaaattacctaaattgtccctcaagaagaagtagaaaaatagagtaaacccataaccagaaaaatatggtgaatatagtaaaagattccactccttccccaaaaagtactggatgattttatgggtaagttctgtctcataaacgttcaaggaactgccagttcctgtagaaaattatctccaaacattgaaaatggtaggacatcattaattcatgttagccagatcagaataacccagttccaaaatttgacagacagtaggagaaaatgatacttataaatatagctgttgaatttataaataaaataatgattgaatcaacgactcttagtaggatttctctttttttccttttgagacagggtctcactctgtcacccaggctggagtgcagtggtgcaatcttggctcactgcaacctccgcctcccaggttcaaatgattctcccgccttagcctctcccaagtatctggaactacaggtgcgtgccaccatctctggctagtttttttctttatttttagtagagatggggtttcatcatgttggccaggctggtctcgaactcctgaactcaagtgatctgcccgcctcagcctcccagagtgctgggattataggcatgagccactgtgcctggccaatttagtaggatttctcctaagaatgcaagaatagatcatcatcgggggaaaattttttcgtttataacatttacaacattaacagatttatgaagataaagaataatcataataaatgtcagttatgcattttaataaaattgtgtattaactcgtgatttagtgaaaactagattcttagcaaactgagaaagtgatttctcagattgattaaaggtatcaactaaaatctacaataaaattatagttaatgttgaagcatcagaaacatgcccattgtaatcaaacaaggattatggctgtcaccaccatttgaatgtattggaagttctgataaataacgtaatacatggaaaattaaataagtggcataaagactagaaaggaagataaattatatgtaaagtatataatctaggaaacccagaagaatcgactgattaactattaaagtgattgcccattaaaatcacctgagaagtgaaaaaaacccacagtgcccagtccctttccattacttcttccttcagttctcttggaaaatgaaaagaaacatggaatgtaagtagttgtagcttcggtgacccctgtgttcctccacattcttttttttttttctcaatttttttgtagaagcagggtcttgctatgttgtccaggctggtctcaaactcctagacacaagcgatcctctcacctcagccccacaaagtgctgggattgcaagcgtgagccaccacgttcaatctccacattttttgcatataaaaattgaggttacccatatggtaatcctgtaggtatttagtatcctaggaattgttaagaaaaggtaagcaatatacctacctttagtctacatatagcccataaggtttgtaacatcgtattttttaaaaatcgtgcttcctaatgggtaacactgaatgtattaaagtgtcatttctccttatttcgatatatttaaagataaatcttatcctagttaaaattgtgaaatattttaaaactttcttttcctttgtcatttccatataccaggcatattagtatttctttttattttattcattagtaagccatagtccctgccctggagggaggtgcccatggtcccctgagggcaatagaggtataaatagatccttgccagttattcctcttgtttgccccatgcctcttagtctgtagtttaaacaaatttatactgaccctaaaaatgaatgtgattttttctttttaaaaatatattttgaggcaggtacagtggttcaaccctgcaattctagtgactcaggaggcttaggttggagggtcacttgaagccaggagttccagaccagcctgggcaacacagtgagactccgcctttaaaaagaagtaggaaacttagctgggcatgatagtgtgtgcctgcagtgctgcctaccagagaggccgaggtgggtgtctcacttcagtgcagagactgcagtgaaccctgatcttgcactccaacctgggcgacagaggaagaccctgactcttaaaaaattaaataagatataaattttgggcaaaggtcggagctggtggagaaaggacacctttaactttatggtcttttcttttatccattatagcagttttccagaccactgtcattttctttcttttactgtctaatgcttttttttttttttttaaatctctgcagattaatttctcttctgttttacaaactaaatagaattttctataattactaatttctttccatgcctctccagatgaagcaaagcaaagcataaaatcagaaatacagcaacaactgttatctgtcaagtcttccatctgggttttgatactatcatgatttttgtgggatattgcctccattatttcatctgtcatatcttgaaccttttcctcctttcttggtatatcagtcaggatttttcattataaacaaactttaagaagttaaaagtgaaatagacattaaagattgagaatcttaggtgtgaaggttgtgcagtcaggaaaatgccaaaatcagaatgtcaaactattttagtggaggcactgttgctgctgccattgggcacaggtatcactgctgataacatcaatattgggcatatgacaccacaactaatacctctgcaacgtctgaaagctggatatctccttactcctttgatagattacctcattgaaccttctttgagtagtgagtttttgataaactgtctccctgctcctgcctgggaggaattctctcacctggagggatgggaaagtgaattgtgtcctctgtttaccttgctagctttttttttttatctccgtatccttatgtctgttctcatattacactttagtagtacaaaacttttgtgacagtcaccaaattcatttttctgctgcctcagctttgcaattgtgttttgacccagggcttctgtttactgtgcagctctagggagcatctttggaattgtactgtcattggcccaggcctgacttgcctttcttactgtcttttttcctaattttccttcaaaactcaagttaaccttttcttctgagacagcttttcttatctctcaagatctacttgctttgcactgtattgtttatttgatttagtattttaccacttctatttgaggttctttgtgcagaaactatcctacttttcttgtattcctacacataacgcagttcctaatatatagccattgtttactaagtattttaattaaatccagccatttataggttttcttttctgtaatagaattttattgaagttatgacatgaatgtaaatcagatttcattttgggagcttttagaaacagcatcaacaatggagctacttttaagttgataacaagtaaaaaaaaaagtgtctttcttgcagctcagatttcttgtaggttattaaattataataacatttaaaaactcatttcagttgatagtatggtagtatatagggtaaatgctaatgaattaattggtgtgtttgaggtgggatgaaatacaggtggttgaaaacttaaccacctataaaacttaattatacttggacaggtataattaaagaatcctgaagaaggatttcagtctttcctggactctgttacaaatagcttttcacttttcattctgaagcattaatacccatttaatgggtaggtactagtgttaatacttggatgtgattatgataacatggaactttttgtagccacattattaataatatataatttcataattagcctcagggatggtgaaagtaaatttggtttttcagaaaccttgcctttttgatgacatttatcactattctacaatacagtgaaatttttcctgtttaaacaatccacggccgggcacagtggctcatgcctgtgatcccagaactttagctgactgtggcaggaagatcgcttgagcgtaggagtttgagactagcctggacaacatagggagacccccatctctacaaaaaaataaaaaattagctaggtgtggtgatgcacacctatagtcccagctactcagaaggctgaggcaggaggattgctggagcccaggagggtggagctgtgatctgtgatcatgtcactgtactctagcctgagtgaccaagtgagaccctgtctcagacaaaaaacaaaaaacaattcacgtattattgaggagagtagtgaagggcaagaggcaaatgtacggctgggtgtggtggctcatgcctgtaatcccagcactttgggaggccaaggtgggcggatcatgaggtcaggagatcgagaccatcctggctaacacagtgaaaccccatctctactaaaaatacaaaaaattagccgcgtgtggtgatgggctcacgtagtcccagctactcaggaggctgaagcaggagaatggtgtgaacccaggaggcggagcttgcagtgagccgagatccaccactgcactccagcctgggcgacagagcgagactccgtctcaaaaaaaaaaagcaaatgtactatctcattatagtacagtgattaagaacacagaattcttgctccccctatctcactatctcacctagactggagtgcagtggcgtgatcacagctgactgcatccttgaactccggggctcaaactgattctctcgcctcagcctccctagtgggtaggactgtgcaccacaacacctagcaaattttttgtagagatgggaccttactttgttgaccacactggtctggaactcctggactcaagcagtcctcctctcttggcctgagccactgcaccctgccaggaattttttaaatatcagctatgtttaagacattgagcaggagcttggtgatgaggagttacacacaacagtgtatcatacaatagaccaccatggtacgtagagataagtttttatggctccatggtacttagagataaatttttatttttgacctaggtgggaaaggatttagtaatgaggtgtggcatttgattggacaaggaagggcagaagtgatatgggaacctgggtatttaaggctcagaaaacaaaactaagtggggcacaaagtttaaggaatatatgttgaacaattatgagattgaatgtctggagtatgcgaagaatagaggggaaatggttggaaatgtttaatgcacgttataagggccttgaattttaagtaagtgaatttggaatttttctgtctttattgggaagcccttgaacgttgttttatggagaaatagtgatggaaaagcattatttcagaaaaaaatctagtaataaatgagctgttttaactatccaggtaaaaggaaaatattgtcctgacttacaatagtgacagctaaattgatagcagagggtagatggaaagagaagtaaaattagttttaactgagacaaaatataggagactctgggaaacttctggtaattttgaccgttcctttcactaaatacactagaagaggctaggtgaaatactgaaacatgtttgaaaagtaagattatcaaataattagtaagataggaaatagaggttcaaggttgagagtttgggaatcaagggaaatttagagaaacaagcttccagtccttgttgctctagcagtgtatgttgatccagaagaggtagctaagagacttagctgtgagttttgtttgccctttgttagtagagggggaagttggaatattaggtctactaagagcgaaaattgaatacactagctccttaaagactgaagatgatcttcatgtcttttgggtagtccagaaaaccttaaaccttgaacttgggttaagatagcccccgtatataacagaaacaaacgtaaatcttctctagggaaataacattatttaagaccttaaactattttctcaaattatttttctaattaaaacataacaacctggaacttaagatactggaattgtcagacctagaccaaaatgagtatgctatcaccagggagctgtcattcagatttggaaaaaaatcagaatttttataactaaacaaaataagcaaaattaactttgtgacatagtttaacagcagactggacaaagctgaagagagtttagtgtatttgaaaatcaaacaatgatccagaattaagtatatccattaaaagatggaaaatacagaagagattaagaaatacagaggatataatgagaaggtctcattgagttttagaaagagaggagagaatgtggcagaggcagtattttaagataaaaatgactgagaattttgcagattggtaaaagacccaaatgtcatagattgaagaaacataacagttcccatgtgtgatagctacttgtttcactgatcctaagatacacagtttttcacattttaacatctgaaatctggatgcatctttcaattattgacaccttacagtccaaaaagattgaaattttgactcgtgaaaaattttccatgtcaacttctgttaagatcatgaaatttcagcacgaaagcattttagattttatgaaatatggtaaaaagaaatccacatttttatttatttatttatttatttatttattgaaacacagtttcattctgttgtccaggctggagtgcagtggcacagtctcagctcagtgcagcttgcacctcccgggttcaaggcattctagggcctcagctttctgagtacctggaattacaggcacgagccactaggcctggttaactttagtatttttagtagagatggggtttcgccacgttggccaggctggtctcgaactcctgacctcaggtgatgtgcctgcctcagcctcccaaagtgctggtattataggggtgagccactgggcctgaccagaaatccacatttaaaaacatcttagtaaaactacaaaatcagcaaaaataaaaaatctaaatcaatgagatacaagaaaggctgctttcaaaagagtgaaagtataggtataataatattctagagcacagctcaacagcaacagtgaaagtgatagtaagatgatacctcagtcttttgaaagaaaataaaccttacctagaatactatgttcatggaaaatatattcataaacagtatgttttaattaatataaatggttttatgttgtacctagcttttgtatctttttaaagccaaccaacattttgttctgccagtgttgattgaagtttcaaatactcataattgttatttaagcaactatttgtctgttaaagggaaaaatcttgcagaatgttgtactttggaatttataaccttaaatgcataatgagctaagcattcatcttaaaagtctcaagtaataagcttagaggtctcaagttaggaaaagaacaacaaaataaatatagggaaaatacaaggaaagaaataaagaacagaatataataaaatagaaaacatgcagtagaagggatcaagaagccgtaagatttttttttttttttaagactgataacgttgacactttgatgaggttaggaaaaagagagatcctaaataaccagtattaggaatgaaaacagagtatcactaggatcttgtggatggtttaaaaaaaaactcttaaaattatggacaactattcaaacttgatagacgaaatgggtagattcctagaaataggcaatttcccaaaactgacataagaaatagtaaacctgtatccttattaagtataaagaaatgaaatccataatttaaaatgttcttataaagaaaagttgaaattcaaatggttatactggaaagttctaccataacatttaatatgacagtaacttcaaccttattctaaagaacagaaaaataggatcttctgccttcataaagatatcataacctttataccaaaacccaaggaaagatgatacaccagtttgtcttatgtacatagatacaaaaaaaccatacatacacacacgcacgcacacaaaacaaaaactggaacaacagaaacacctcagaatattagcaaattgaattcagcaatacatatataaaaaggagggtaacccagcatggccacctgaggtgaatcctgggaatgctaggttggtttaacctgaaacaattcagcatgattggtcacttgaacaaattgatgagaaaaacatttcagagatgccaaggagcctttgcttcatgattttaaaaagaagctattagcaatctagaactttgttaaccttataaatcttacagaaacatttgtaggagatatcatagtttatccactgaaatgttaaaaaagatttcccttttagatgggagttcaagatgtggatatcgtatctccagttcaattcagcattatactagaaatgattctagccagtagaacatcaaaaaatgaaaacaaaatacagtgttgtaagagaaatgcctgtgtttttgggggttttcttttttttgagatggggtcttgctctgtctcccaggctggggtgcagtggtgagatcatggctcactgcagccccctacctgccaggttcaagcaattctcctgtctcagcctcccaagtagctgggactacaggaccatgcccccaagcacagctgatttttgtatttttagtagagatggggtttcaccatgttggccaggctggtcttgaactcctgagctcaaggaatccacctgtcttcagaagtgctgggattataggcgtgagcccgtgggcccggcccctggctgttaatattcactgacaatgtgattgtgtattcacaaacaatgtgattgtacatgtggaaaaatcagaatctggaggtaaattgttagaataaatgtctttagaaagaaatatgaaaaatttcttttttctttgacccaataattccgctctcaggtatatatccaatagaaagaaatacgtgcacatctacattgaaagtcatatataaaactggtggtggctcatgcctgtggactcagcaacatgggagaatcgcttgaggccaggagttacagatcagcttgggcaacatagtgagaccccgtatttacagaaaattaaacaattagctatgcatggtggcatctgcttgtagtcccagctactcaggaggctgaggtgggaggattgctggagcctaggaggtcaaggctgctgtgagccatttttatgccactgcactacaacctgggcgacagagtgagaccctgtctcaaaaaaagaaaaagtcatatataagcatgttcctagcagtatttattcatacttcaacctataaacaacccagatgtttatcactattacactagatagataattatggtatattgacatagtaactattcagcagtgcaaaataaatgagcaaaagctacaagccacagcatagataaatcttaaaaacatagtgaaaagaaaaggaccccaagtaatacctatctactatatggttctacttacataaaatataaaaacagttgaaactaagtttatattgtttaaggatgtgtgtttaggtggtgtagctatttaaaaagggcagtgattaaaacagttgaaactaagtttacattgtttaaggatgcatatttaggtgtaattattaaaaaaaaaaacagggtagtgatcatacgtttaggggggcttgtagagtactagcagtcttctgtttcttgtcctgggtggtatttatatactggtgtttgttttataacagtttgtaagctgcatgtttatgtacttctctaggattgtgttattgcaaaataaaaatcattttaaaacacatatacacagacataggaaaaggatcagtcttaaagggaaggtccatcttttttcctggacatgtaggattaatagttcctttgtacctacaagtaaacttacattttgccaagacagcttttctcactgctctcctaggctctagtatattaaatctatcctaaatttaacttagattgtgttaacttacttgagcaacctctgctacccttgtggtttctgccacatcaaagccatactccccggatttggggtttgaaaaccttgtgtacattcactccattctgtatgtctttgcttataactgtatattccttgggatgccctctgctattcaggcctcaatcttaagagctgtagctttgtacagaatcagagcgtatcaagaatacttcattctggggttgtgctcatagccatcacgtacaattctgtgcatcacaaatcgatgcctcctatgtcttcttattgtctgtattctttttttttttgagacggagtctcgctgtcgcccaggctggagtgcagtggcgcaatctcggctcactgcaggctccgccccctggggttcatgccattctcctgcctcagcctcccgagtagctgggactacaggcgcccgccacctcgcccggctaattttttgtatttttagtagagacggggtttcaccgtgttagccaggatggtctcgaactcctgacctcgtgatccacccgcctcggcctcccaaagtgctgggattacaggcgtgagccaccgcgcccggccttattgtctgtattcttaccacatttaccaacttgtttcaacatcttgaagttagttttctgtacttctctaggattcttctcccattcttgcatgctaagtagcatgtcatactacaaacaggtattcatctctttccttccaaacaattgacattacaactaactagcataattcctacatatagttgctgaataggtgagggaactgtgttaaatggaacttaattatattactaccttgtgttttgatggataatttgttttaacatagctgaattttaaacatacttgtttgattcataggctttcaacttttacagcctgaggacttgcattagatatattgaaaaatcgttatcaaaacaataaaaagacaatttctttttatatacttgaagaaacgatatttctcttcagttggaatgagatccactgttgcatgaatcacaagtagtagtgtgttttattttctagataaaaatgtatagcaggagcaaaagaccattaagcagagggtgtagatttcctttaatgcacgtatttggaaagaggtggacaaaaaaagccactgtcttggttttctttgaagtaaaaatagttttttaaaaataatggttcttgtcgttttggggactgtagtctcttttgaaaaagtaatacaatcttgaaccttctcctgggagtgcgggggtggggcgggggcagagaacatttgtaaataagttataacatttggattctgcccaattgttgaaatgccagggacctccaattacaaatttatgtgtttgatgatcttggtaaaactgaaatagtcataagccagaagtcgtagacaaccaccagtaaagatgacacatgtgtttgtagtgtggctggaacaccctgtgaaaaccagcatctgtgtcttctaaagcctgtattgtacagatgttctccattctgtgttagaaaaagaatagtcattaacttcttttgtaaatgtcctccatacttttatttttatcttttaaattttatttctaatagagatagggtcttgctatattgttcaggctggttccgaactctgggcttgagcgatcctcccagcttgtcctcccacagtgctgggatacaggctcactagctactgcacatagccttttttttcttttgaaattttatttacctgcatagttttacatctacctttaaaactcatgagaaacaataaaattttattatgtaaaaaagctttttgattagcaaaattttttatcgtaaaagctgaatgggggggatgtaagaggtcaatttactgttcacttggcttttgggtatttaggtttttctgtagtaaatgggtattggatccctttggaagatggcatagtttattgtaattctgttatggttttgcgaattcgagcctagaaagagttatcttaacatctgtttcactgtggttagttccttaatccacctgccttcatcctggctcagaactaaaaaggttaaagtatgcagtaagatttttgtgctgccacttggaagtagtattaattagtagctgctctatcaagcattcttttgcttagcagtaagcaaacttaggagattttattacaatgctgtttttttaggttttattttattataatgcctttttaaaaaaaattaggctaataagaaaaatcttatggcctcaaaaagtattctactttttctgaaaaatatatgagcagtatgtatatttagctataaaaactacatagaatacccatttttttttagagattagcttaagaaacctaagtcttttatagcaagctgttacagatttgtgtgagttctcatttttgttgttgttgttgttgttgttgttgtttgtaacatgagggctaaaagctttccttaggataaaaaggttttctatccttaactcctttagatggtttttgttctttggaattctgaacttacctagtagaggtatgtagttatgccagtcatcttacattcttttgaaagaataactttaaaaaccacaaaggatgcagtaatatcttttaatttgtttgaaaacttacattctgcctcaggaacccttttttaaatttaattttttatcaaagtaacacaatcatgattttttaaaagtccaatagtttcccaagagttataaatgaaaaatagtgctccaaaccctcagttccaatcccattccccagaagagaaagaactatttattttagtattttttatgacttattattccgtattgctgttttaagacagtcatcttcatacctcatgttacttttgctttttataaatgtgacggcagttcttattcattcgtatgatttaaatgaatttaagatattcctttgctcctttgacattttcccttaaatgtacattttctaaaagtagaaaaaaattacatcattaacaggttaatgtggctggggggagttgaaatggcagttcttggaagggttttggcaccctggatttttgttctttgtcagaactataaggtatagaataattgtgacttttgtagtattttgaaattgcaatccgatacccataaactgccatatgtgagtgttaaaacagaaatgttttggtcatttagaagtaaacgttatgtgtatatacattttcatacatggatacatataacctataatgtgttttttaatacattttcatatgtgtgcttatttttactccctctcaggcttatagcaatagctagttgacttgcaaatgtataatggaagcattaaaagactggataggaggattgagctctgatagtttaagaataagcatagaggctgggcgtggtagctcacacctgtaatcccagcactttgggaggctgaggtgggcagatcacttgagcccaggagtttgagaccagcctggccaacatggcgaaaccccatctctactaaaatcacaaaaaaattagccaggagtggtggcacacatccgtaatccgctactccagaggctgaggcacaagaaatgtttgaacccgggaggtggaagttgcagtgagctgagatgaagccagcctgggtgacagagagagactttgtctccctctcccccgcaaataaataagtaaataaaggaatacagcgtacaaaagcctactttatatctttaaattggttttacattttgcttttctgattctattgtgagaattagtacttctccaatagttgttggtctttatgaagtatgaagacttagtagctttgaagataaaattaaatattcgaatggcagtgatgccacagtcactcaggattcaagaagaagcattagccagtggtgatccctaccagccccgtttcctctctcctcaaccagacataagagctcttaggctgtaactttcctgccttgaaatttaattcatattatttggtatgtttctctatagcaggcaagtaaaatgaaaaattaagattcaaatattctggaaagttgtctgagtaccaggttgctcagctgtatttctgtaaatatactcaatgtgcagaaataatcctggagagaagagaatttacaatctactgagaaactgcttaaatccaatattttttaaattgacagattattgtctatatgaaaatcttaatgtagagaaatataggccataggaatgggtgttaacctgcttgtgccctttcttcactaaggaaaggctgaaggagaaaccatactgctgcttgtttttttactttgatcaatatgatttcctgaaaaggataggcagggttacagggaaggagagaagcacagtcctaggataagctttgcagctctttcaagtcaatgaagcagagagaagtatttggttaactcattaaagatgcctcaactacagtgctttacattgagtcagttcctttttattttggtctgattttcagaagcaatgatttacatagaagccagcaaactgaaggaacttccagatagtgcccaggtaaacagtgtggatagttaagaatccagcctattcttctatgcctggactactatccaggcacagtagtcttaaataaaacaatcataattagaagaaatcagctttgtcttaggaaattaaacataagactcttgagatgagggatcagaggtaaactgataaaacaacagaaggtgaaaagggaactgacagaacagaaaaaaaaaagaaaggataaataatgattttgtagaacttcaaaccatgttgatagcagaaagaaatagagcaggcattacagaaaataggtctggaagacaggaaaaggacaaagaagtaagtagcaactggtaaacatggaggacaaattaagagactggatgcaaaccaaacatattcttaacaactaaaggatcttgaggtaattaatatccaaatgacatttcaaaagagaaagttaagtgcttagaataaagcctagtggaactgctaaagttcaagaataaagaaagaagaaaatgagaaaattattttggccagacttcctcagtaacaacaggtaacaagaaaatagaacactatctctatatgaatattgaggagggaagggattttggccaaagtgagcagttgaacacatttaaacattagaattatgtctaagtagttggaggtgatcaagtttatgagacaaaaaacagttatcattcttgaaagaaaggctacatgatataaaaacaatgggccgggcacggtggctcatgcctataatcccagcactttgggaggctgaggcgggcagattacaaggtcaggagttcgagaccagcctaaacaatatggtgaaactctgtctccactaaaaatacaaaaattagctgggcgtggtggcaggcgcctgtagtcccaggtacttgggaggctgaggcaggagaatcggttgaacctgggaggcggaggttgcagtgagccgagattgcaccattgtactccagcctgggtgacaagagcgagactttgtctcaaaaaaaaaaaaaaaaaaaaaaaattagtgaaaaaattatataaaactgtaatcaactgggaagagctttaggaagttctgaccaaaaccaaagggatgatcaatgtattatttaagttttataaattaagaaatgtatttaagtattaattacataggccactcctagtaaaactaaattagattttagtaatttccaaataaacattgtggagtcaggggtgaatggaccatataataaatacagatcagaacaaatacatgaaactttggtaaaagaaaaagatttctgggcctactacccccaagaatatgagtggatttttagcttcccactcatatttcatttaaaatacttagcagtatttgaaagttcctttggtggcttctagaatggatcaaaaagctataaactccaagccacatgtagtggtgtgcacgtatagtcccacctatactcaagaaggtgaggcgagaggatctcttgaggccaagagttcaaggctgtatgctattattgcatatgtgaaaaactgctgtgcaccagcctgggcaacatagtgagaccctaactcattttttttaaaaaaggtattaactccaatatacgctatttttaaaaatgctgcaaactccagtacatgctatctaaagcacaggaattcagattgatagtaaaagtgttgatgtgatcggacccaacaccaggctgtgggggcgacaaagtccagcggagtcaaaggaatgagaaaagacaagagacaaagtgggaccagggggccaacgctagtatggaggctgcgaaggcctggagctctgggagcccacgctatttattggtgatcaaacaaagaaacaggtggtgaggatgtgggggttaaaaggaagcggtgtatcaagcgaatgagctacagctgtgagggtttagcattttctttgaaacatatggctagttgagataatgggagtgctagaagtaaggagccagcagtctagcaggcatgcaagccctgcctcagcttctctcccgacactcagcttttctcccaacaaaaagaacttgaaatacctgagaataaagttactggaagatgtgcaggatccacatagtgaaaaaaagttataaaactattgagagactgaataggaattggaattaagtaaattaaaagatactttgttcttggctaggaagacaatattatagagtcaattctttcagtcagtttactcttgatataattgtagtaaaagttccaagaggatttgaaaaaaaaattaatgattgtacttaacttgaaaaaacaaatatggaagaacagagaaaattctgtgagaagaatgataaagggatctttgtcaaatattgagaatttatcgactacaagagcagacaaattagtggaatagaatggagagtccaggaataaacttgtctaaataggaaatttgggtatatagtgaacagatcagtggggagagttagattagtcagttactctttaagaagaaactaagtgcttgtaacatgcctgtagacattaagggctccaggaataataaagtagtcctcatggggtttacattctagcagagcaaacataaagagtgattacagttagtaatgttgtaagtgctgcaaaggactgcagagtaacaatgggatgtaattcaagggaaccttatctaatgggggtggaagtgaggagctgtcagagatcagttatttgaggaagctgggtgtaagctggaacctaaaggtgggaaaaagtgtttccaatagatgaaacaacccttcaataagtgattagatttttggattgaaatgaaatggaatcctggctttactccttattacgcaaaaataaatcaacagttttaatggaaacaatttaaaggtgagatctaaatcattaatgaatttccattaaaaaatctttgggtatagaggtcttttaaagtgtgatatgaactgcagaaatcacagtggagtagcacgataaatgtgcctacataaaaattttaaagtggtaattaaacactattaaagaaggttgaaagacaagaaagaaatgaaagaaagcaacccatgaaacaaagatttactcttcctctttgcatactgaacttaatagggaataagatcaccacagaaaaatgtgttcaccttcactaataaataaataaatacaagttaagtctaggtatttttccctatctgatgggctaagattttaatctaggattatttatatgtggcacatttaaatgtccttcagaataacattggttggatatattatagtaaataactacagtggaatattgtgcaaaaatgaaaaatgtagacatttaaagacaaaggtgtctgttagatattgtctagtgaaaaaagcaggttataaatctggactagggtgttacttatatgaaattagggacacatgtctgtgtggctgtatactcatagaatgctgtctagaatgttaaccaaagtatgagagtcattagttccctgttgtcaaattttggatgacagaagtttgtcttgtcttgggagcatgaatatttttataaaacaaggtgtttagctggtttatgaattgatatttagtgttaatctcttatgctttcagtttttcaggtaaaacttggtattttatattatctttttttttttttttaaatttgagacagtctcgctctgtcacccaggctagagtgcagtgcagtggcaccatcttggctcactgcaaccttgcctcctggattcaagcggttctcatgcctcaccctcctgagtagctgggattagaggcacctgccaccgcgcccagctaatttttttgtatttttagtagagatggggtttcaccatgttggccaggctggttttgaactactgacctcaagtgatccacccacctcagcatcccaaagtgctgggattgcaggtgtgagccaccgcggcgcctgtaatcccagctactcgggaggctgaggcagtagaatcgcttgaacctgggcggcaaaggttgcagggagccgagatggcgccactgcactccagtctgggcgacagagtgagactgtctcaaaattgtaggaaagcatttgattttctgctttaaatatattctgattatctgaatcatcagagacattaattttctatttgtatgagttcctgacaacttttaactttctgataatcctcctttttataatgtgttggcatttcgattgataatatgattatttcattgaactatgctgtagtcaaagtatttataaaaaagatatttatttattagtcttaggagaagtgatatggtttgttctcatttgaatgatttttctggaggtacagtaagatatagtagcctttgacacaaagcctaaacaagaccttaattaaaaatattggaaatttcttttgagtattgattacttttaaaattgaaaatctcctgtttgtatataaagagcattatagttactgtaatctgggctttacaacccaaaaagtaattgaccagattgcacattaatatttttgctggttatattggttttacagattgaaaagtttttttttttttaatatctattgcttttcccttttgaatagtaagctgtttcaggaggccagggaacatgtctcatctgaattaattggaaacattgtgctaagtatttactgttatcttaaccacctcaacccaccttaaggtctgctctactatcttctgtccagaggtttgctatttagttaaaactctaggtagtacttggcatatatatactcttgatgtcttagatatggaactactctatatttagatacatattttatgaaaagctaatatgtaatttattttatataaaatgtttgaagatacacttctttgttttattcctcctcctttctcagtaaattaaaaatatttcaaaataatgtttagaaagcaagtctattatgtaaaatgagacacgtaataattatatttttaagatgatttgtgcagtaagataaatgctttactgaagctaatatgtttaaattgctttaactaaaattattaataaaatgaattcatttgtataaaatacagcctacccatgtaaaatattactcttcataggtaccccagcaacagcacaactttaatccttaagttttagttgcagtactgttaaaatactaatagcttaatttcccaagattcagttatttaaaaccaaagtttagggggaaaaaggcagcaaaactcagtctactagtttacatacatacacacacacacacacacactcatatatatgagagtagactgaatttttgctgtttgcaatatatatatatatgcacatgtatacacacacctttatttgctataatttgtaccatgtagcttttatttcctctgaataaaaaggttgttatcttgttttattttaattcaacttcttgcttttccctatagaaagtcaggtttttggagagctctaacagtgtgcaagttgctgggctcttatcctttctgtttaaataatgcaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcggtgagtatctggtagtttaaggctagtgctgactttgtatttcagagggtaaatcaacttccattatttaaacaaaggaaaatttgtgggtctgggagtagtaacctctaagccataacctatcaatgtattcagtgtgaggaaaggaagaaaaagagtaaaagcttggttcctcttacctccaacccccatttgttttttaaagcagcaacaacttgtccaagttgtcatttatagacctaaatctttctggagtttattctatcaccatgggagaattgtgtaatagtaggcagtaagtagaattctttctcatccaaattaaaatagatttaaactttaagtgttttttaaatatccagaaacactcataaaataccgttaatactatttgctagggaactctcagaattcttcagaagataagattttcacttaatcaaatccattcaaatggagattgttaaatatggtatgtggggacagagttggagcagaaccagtgatatagcaagagaaccaaagaactgatgttaatcccttaagtacaaataaccttcctaaaaatttattgaactgaagctggactcagtggctcatgcctataatcccagcacttggggaagccaaggtgggcagatcacttgaggccaggagtttgaggccagcctggccaacatggcggaaacctgtctcaactaaaaatacaaaaaaattatcctggcatgatggtgcatgtctataatcccagctacttgggaggctgaggcatgagaattgcttgagcctggaaggcagaggttacagtgagctgacatcatgccactgtattccagcctgggcgacagagtgagactccgtctcaaaatataaaatagaatttactgaactgagatgatttacttacttgatttacttgagtgtttactaaggaagtttagtcttaagatgtctaagataacttaattctatgataattacaactgtcttgttcatattctctgctttaatagttaagcatctctttctaataattactatataacaagtctttgacactgttattttaacaattatttggttgatgggggtctcactatgctacccaggctggagtgttatggctattcacaggcacagtcagtgtactacagccttcatcagactcttgggctcaagtgatccttttccctcagcctcccaagtagctggaactacagacgtgcaccatcaagcctggctaatattatatttatattgaaggatttttattgtttatcttagagttgtatatgtgtatctctaatggggtccatttgtggggagttaacttgttcacatgtacaagtgatgagaaaagttttaaaagaaaataaagtactcttagagaaatagaatgatcagtgagttatttagtaggtaaagtggtgaactgaattttcaaattctcaagttctgatcgtaactctaacgtgaaatttttggctttagcgggaggtaagccatttaatgtcactgggtttttcttttttctttctttcttttgagacggccttgctctgttgtctaggctggagtgcagtgatgtgatcactgcagcctcaaactcctgggctcaagcgatcctcccacctcagcctcccaagtagctgggaccacaggcgcatgccaccatgtctggctgatttttctgtgtgtgtgtgtgtgtgttttgtttgttttgttttgtttgtttgttttttttgtagagacggggtttcacctgtgtgtgtgtgttttgtttgtttgtttgttttggtttttttgtagagacggggtttcaccatgttgcccaggctggtctggaacttgtctgagctcaagcagtctgcccacctggcctctgaaagtgctggcattataggtgtgagccaccacgctcctccagttttggtttcttctccttttcttttcttttctttttttttggaggggggggggtgggacggagtcttgctctgtcgcccaggctggagtgcagtggtgcgatctcggctcactgcaagctccgcctcccaggttcatgccattcgcctgcctcagcctcccgagtagctgggactacaggcgtctgccatcacgcctggctgattttttgtgtttttagtagagacggggtttcaccatgttagccaggatggtctcgatctcctgacctcatgatctgcccgcctcagcatgccaaagtgctgggattacaggcgtgagccaccgcgcctggcctctttccttttctcttttttttttgacacgagttttgctcttgttgcccagactggagtgcaatggcacagtcttggctcactgcagcctgcgcctcctgggttcaagtgattctcctgcctcagcctcccgagtagctgggactacaagcgccggccaccacacccggctaatttttgtatttttagtagagacggggtttcaccatattggccaggctggtcttgaactcctgacctcaggtgatccacccaccttggcctcccatagtgctgggattacaggtgtgcaccaccgcacccaacagtttcttttttctttctgatgagttgaataagatactctttcaattttcttccaacctgagtattgtatcatttctcttaccttaaatcacaattctaatttgaatattttttaaaaagtactactgttacaatatattaatattttgactattttattgtctttaacagattctccttgccagttgacatttatatagtgcttacagttaaatgtttctgtgaggtaatactaagacccaggttttacaaggtttccttacttcttggcgtttttcctcctgccctatcatagacagttccttcttaacttaaatcttaactctgatttgagtactgaagcttggctgcttccaaatatccactataactttctcgctgttcttaatatggtctaacaatctcaacaaactagaattcaaaatcatgacttgagatttacagtgtaaatttttgttttgtacttgtaactgatgatggagaaacctattcattgaacacactaggcactattctaagaaacaatggagaataaatacataattcctaaccagataatttgcaggttagttgggtagataagtagtaaggtgacatattcagaaagagtggtaagtgctttggtagggcaaatataagatacgatactgtgggaacgtgttggagggatacctaacccagtttttgatcaggcaggacttaccacagaaatctgaactaacatctgaaggcatggtagttaggctaaggaggaaaatgtagcaagtccaaggaagagagaatgtactttcaagaactgggggatggtaaatagtactaaaagattcagagaaaagatttaaaaagttaatttgaaatgaaatgaaggagtgaggtaggatgggaaaccagacttcatgggctaaagagtcactgacttgaaggtgggaaaggaaatggaagcaataaatgtaatgaaattactcttttacaagaaatttcactatgcaagtgataggataagatagcaaaaggaacaacatgggttggcaagtaaggtaaggcattatggaaactgctaagtgttccgaaaagtatcatgacaaaactaggatgtcctttcctcataatttttagactcatatagaaggataattttaacctcttcagttttggaagtaaatgtcacctgaaactcttcataaagttttattattggatgagtgagttcttcacttacattgtataactcccacattttactactctccaagcatttgtacttttttattatatatatcttcagtatctttatccttccagaaagcaatttttgctttatgcagtgtcacatgcacattttaaaataagtgcttttgatagcttagtttacaaccctttggagttaactgtcctgagtggctgcttctttcaaaacaatgtcctgagacattggagcactttgtaaattcatagattccaacttaatgttttaggttaaagtagttaagataatagctgtactggcccaccactgtgctaggaaatgtagcttcgactacagcgtctctctctctctttttttttttttttttgaggcagagccttgctctgtcgcccaggctggagtgcagtggcatgttctcggctcactgcaacctccaccccgcagtttcaagcgattctcctgcctcagcctcccgagtagctgggattacagccgcccaccaccacacctgtctaatttttgtatttttagtagacatggggttccaccatgttgtccaggctggtctccaactcctgacttaaggtgatccacccaccttgacctcccaaagtgctgggattacaggagtgagccgccacggccagccagtgtctcatttttatgaagtaaataatttgtattttctaagaataagatatgtgaagtaggtaaaggcagagttgaaattgtgaggaagggtggtccaccatcccgtcccccattcctgaagcccctctgtggaatcttggtgctgctggaaactgcttgaaaatacctacgtcccaccctattttccttttaacacattacattttacacacaagggaaccgattcccaggtcatttgttcaatttttataaacaaaggggtttcaattttagaggttatatggacaacttattatggaagaaagattcttaattttcttactgctatttgacattagttgctgtgtatgtaaagtgatgcagataaatgaaacctttaagagtgtattcttaagtttctttaagtccattaatttcttttgtagataatatttcatgtatttttcgtgtactctcttgatcggatgtatttgtgatataaacagggataagtttagtgaatagataatatgatcccctgggacaggggaaagcccagggagccatgtaggtgaacctagctcaaggttatgaggaaacgaatatatcagaggagggagagggaaagggaagtaagacagacaggaagatatctgcgataataatatgttcctcgaaagcacaatgaatatgtatctttagactacagatttgtgtcttggtttttggtgtttttatttttttgctctatctttagacatccatgtatgatttatttttctaacttgtttaatcttgttatctgattagagaagttatttaaaaagaataaaaagcttttatctgtgtgctgaagttgtaacaaggttgagagaggtgcatctcacacgagtgtgattacatttatgaactatctttttatcttaaaatgagctctagactagaagtcaaaaaaggttgagacttaaagtgatcacttagtaaccattgtgaccgttgatctctgttaaggattcctacttgaaaaaagaatgaagcacatataagcatgtgtatatgtttttaagttttgaataaaacattttagagttgctgatatatttactgtatttgtgtcttttacagaataccccttcctttaacagccttaaaaatcaaagactccattagtgatgtggtaacaagttagtgccaaatctccttctctgatggggagtaatgataatagattccctttaagcttgatatttattttacatgtcattctttcagtaaacctaattgcaggactgatacacttcatatatatatatattttaatgagatgaagtctcactctgttgcccaggctggagtgcagtggtgtgatctcggcttactgcaacctccgcctcccgggttcaagtgattcttctgcctcagcttcccgagtagctgggattataggtgtgtgccaccatgcccagctaacttttgtagttttagtagagacagggtttcaccatgttggccaggttggtcttgaactcccgacctcaggtgatccgcctgcctcagcctcccaaagtgctcggattacaggcacgagccactgtacccagccctctcatagatttcttttcatgtccttgtctttgtatttaaaaaatatagttgatgtgctgtatatagaatttctgtcctaacgagatatttgtatctaatatcataagtaacatcagaaattttataagtacatgtcacataatggctaaatagaaaatctaagggaattttaaaataccctttataagagccacgaaaggaaagaataaaagagctaggaataaacttgataagaaatgtgaaagattgctatgaagaaaacttcaaatactaagataaaagaatgacttgaatatttgagatagaagaaataggaaaatattgaaaaagaagattaaattgacaggggagagctgagtgaggactagtcctgctagatacaagagtagacagagcggtggaacaggatagagtcaaatatgcatgaggagaatttagtgtattacagaggaggcatttcaaataaggtgtattatttgatacatggtagcagtggaacaggatacagtcaaatatgcataaggagaatttagtgtattatagaggaggcatttcaaataaggtggattatttgatacatggtgttagagcaacttggtagccatatggaatagaaacttaagattcctacctagcttcataaataaaagttaatgaattcacaagcggtaaatttaaacggtgataagtttcactgtgagtgaagagcttctgtatggcaacaaaatatgaacactaagaattaaagtgggggaaaagatttcccctacttataaatggccaatttcctacataagtaaaaagcctccgtaaataagtgaaaaacccacaggcaaagttggcaaaatatatcaagagagtatacagaaaaagaaatatacagtgtaaaaccttttttgaaatattataatttcatttataataaaaattcaaatcaaaactaaagaagttagtgtgtttttcacctattagattggcaaagatcaaggagttggatcatatactacattgtcatgggcatgagaaatcaagtactcttgcacggcataaatgacgacaatctctttgcaggggagcctgatgatagctattagattgtaaatgtatatatttattataatgtcacctctacagatttgtcctaagatacattcataagatcacaaagatgtatatatagtcaatgcagtagtatagtaggaaaaaaaaaggcagtgtaaaggttcattaatagtagactataaataaaattgtggtacctttctataaagaggcaaacccacaccagtgtggtaccatatgagaaatccattggatttatttttgtttttttaagacggagtcttgccctgtcatcaggctggagtgcaaaggtgcgatcttggctcactgcaacctctgcctcccgggttgaagggattcttctgcctcagtctcctgagtagctgggattacaggcatacactaccacacctggctagtttttttgtatttttgatagacacagggtttcgccatgttggcctggctggtctcaaactcctgacctcaaatgatctgcccgccttggcctcccaaagtgctgggcttacaggcgtgagccaccgtgcccagccctattggatttttttaaacaacaacaacaaaaaaaaacaaggtgcagaagagaatttgtggtactgttacagtgtgtgtgtaagtgtgtacgttagaacacctctggaagaatatgtaaaaaactggaaatagcagttgcttctgggtagaggaaacaaacaacagggatgggaatgagggaggcctgtttttttttttttttgagacagagtctcgctttgtcacccaagctggagtgcggtggtgcgatcttggcttactgcaacctccatctcctaggttcaagcgattctcctgcctcagcctgccaagtagctgggactacaggtgcctgccaccacacctgcctaatttttgtatttatagtagaggcaggattttgccattttggccaggctggtcttaaactcctgactgtaagtgatccgcccacctctgcctccagtagtgctgggattacaggtgtgagccaccgcacccggcctagggaggcttatttttcaacataaactctgaacttgtactgttaaagtaattgtttttagtaatgtctatttaacttactcaattaaaaataatttagaggtaaattatggcaaaatgttctttaaaataaggtaaccattatttgaatctttttaaaagacataatcctccagatcatctaatattatttaaagtatttacttaatgtcccattacaggatactgcttcatttaacgatcccttaactcttaagattttagaacaaagtgttagttactattatccttagctattctgaataaatcttttcataacaggtttattgagatataatttatatactatccagttcacccatttaaagtggttttagtatatgctacagagttgtgtgccatcgccataattttaaaaacattttataaccccccaggagataactttttaaattcaccccctaattcctcccaagtcccccagcccctaggcaactgctcatctgttttctttgtcaatggatatacctattctggacatttcatatgaaagaatcaaacaaggttttggtacggtggctcacgcctgtaatctcagcgctttgggaggccgaggtgggtggatcacgaggtcaggagttggaggccagcctggcaatatggtgaaaccctgtttctactaaaaatacaaaaattagctgggcgtggtggtgcgtttctgtagtcccagctatttgggagactgaggcagaagaatcacttgaacctgggaggcgaaggttgcagtgagccgagatggtgccattgcactccagcctaggtgacagagtgagactctgtctcaaaacaaaaagaatcaatatgtgatcttttatgactggcttattttcattcttttacaagaaatttcactgtgcaagtgataggagaacaaccttggaaacaaggttcatctatattgtggcatttatcagtactttatttccttttatggctgaataatattttatttatggaaatatggaaaaatatttttttcttcagttgatggacatctggattgttttcattttttggctgttacgaataatgctataatgaacacttgtgtacaagtttttgtatggatgtatgttttcatttcttttgagtatatacccaggattagaattgctgggtcctatggtaactctatgtttaatattttgaggaactgcctgattgtttccaaagttgctgtaccattttacatttccatcaacagtgtacgaaggctccaatttttctacatcctcaccaacacttgttattaatattggctttttttttccaaatagagtctcactttgttgcctggtgtggagtgcagtggcatgatgacagctcactgtagccttgacctctcaggttcaagtgatcttcccacctcagctcccctgagtagctgggattacaggcatgtgctaccacacctggctaatttcttaattttttgtggagacagagtctcactatgttgcccaggctggtcttgaactccttgcctcaagtaatcctccgctctcagccacacaaagtgctgggattacagatatgagccagtgtgctctgctttatctgtctttttattatagctgttctagtgagggtgaagtggtgtcttactgtggtgttgctttgttttgttttgttttgtttgagacagggtctcactcctttgcccaggctggagtgcagtggtgtgatctcagctcactacaacctccgcctcccaggctcaggcagtccttccacctcagcctcccaagtagctgggactacaggcgtgcgtcatgatggctgactcattttgtattttttgtagagacagggttttgccatgttgccccgccttcatggtggttttgatttgcatttccatgatgctgaatgatactgagtattctttcatatgctcatttgtctttttatatttaatacaaacattgttgcccgcctttcctaagatgtatgtgtgttcggtgtatctgcatgtctagattcaccatgaaaagttcattttaggagcccatctattgtcaaattggacattttagccacgtaagaaatgtgaccttacagagccctgttgagtcactgtttatagtgagttttctgataatacctttgttaagttcatgttttgtttttcttacagtatttcactggccttgaatgtggacataagttttgtatgcagtgctggagtgaatatttaactaccaaaataatggaagaaggcatgggtcaggtaaagatatcaagttgtttttcagtttttgttgaatttcctatagtgttaagacccttgcacaaatttgcacaaataaaaacaggtgaagctttatgtgtcatgattctagattcaaacaactaaagataataggctttttcctaaagtaatgtggcattccagttaaagagccactccaggtaacgttttctcagccggcatcaatattggtatatgttaacttaaacttgttgcacgattttgtcagattatctcgcttttgcctttaaaattgtgtgtttaaaaaccaattagtcaggttagcaagtctagttactttatggtgataaacatactctcacacacatttcctttaaggagaaagggaaggattgagatcctgtaaacattaaggtattcccagaacctagcaaagtgcctggcgatggtaagcattcattaaatatttgttgaatgaagacagtttaaatttcaatctttttcagactatttcgtgtcctgctcatggttgtgatatcttagtggatgacaacacagttatgtaagtatttttgatagattctgcatgtgaatattggttagttggttaaaccaaattaatttttacttagtacctcaaaggaagtgaaactttttaaagtctgaagaaactttttaatctgcgttccttagtagtagtacaaaagcccatttgtaacttggttaaatgcctgatcactattcttacaaacttagaaatgcatggtagctagattttgataaaccttgggattggagattagaatgtgtgtatgtgttagttgaggtgttcttggaagcagatcccaagatagaataaaaggtgaaactgacttattgtggaatagcatctgtgcaaggtaaacagcaggagcagatagacattgatataggcctgacatctgttaaaagacaaagaaggaagattcaataggaagagactttatatgatacagctatgagagtctttggcagccctgatgggggaacttcagtgcatagattgcccatagaggaatacctcaataagtagaaagagctgggcccagtacacttgatatgctcagttgttggctgggactacccagggagtcatggtctttgctgaaacactgctgctgatttcagatacactacagctggatgctttcagctaacagctcttcttgtgaaaggttctttcttttttttcttttaacttttaggttcaggtatacatgtgcaggtttgttacatgggtaaattccttgtccgtgaggtttggtgtacaaatgatcccatcacccaggtagtgagaacaatacctgatagtttttcaactcttgccgtcccaccctacccactctagtagtccccagtctaaatagtcttttattctcatcttcatgtgtactcactatttagctctcacttataaatgagaacatgtggtattgagtatttctgtgttaattcatttaggatgatgacctctagctgcatttgtattgctgcaaaggacatgattgtgctcacttttttttatgactgcatagtgtttcatggtgtccatgtgccacattttgtttatccagtccactgttgatgggcatctaggttgatttcgtgtgtttgctattgtgaataatgccacagtgaacatactagtgaatgtgtctttttggtagaatgatttattttccctgtgatctcaccaacatctgttatttttttactttttaaaattattttttgtttaatttttttttactttttaataatattccttatgactggtgtgagatgatgtggtacatcattacggttttgatttgcatttctctagtgattagtggtgttgagcatttttttgtacctgttggctgcgtatatgtcttcttgagaaatgtcttttcatgtactttgccctttttctttcttttttttaagtgaaagcaagtttattagagaagtaaagaaacaaaagaatggctacttcgttgacaaagcagcctgctcatttttaaatggggttatttgttttttgcttgtttgattaagttccttatagattctggatatgaggcttttgttgggtgtataatttttaaatattttctctcattctgtaggttgtctgtttactctgttaatagtttcttcagctgtacagaagctcattagtttaattaagtcccacttgtcaatttttgcttttgttgcagttgcgtttggggacttagtcataaattctttgccaaggctgatgtctagaatggtatttcctggattttcttttaagatttttatagattgagctcttacattaaagtatttaatcctttagttaatttttgtatatggtgaaagatataggggtcaagtttcattcttctgcatgtggctagctagttatcccaacaaccatttatgtgtgtgtggctattatcgataggattgcattattaatttggcgcttaccttgaatgttattggtatatattaaatgctactgaattttgtacattgattttgtatcctgaaattttactgactttgtcagctctaggagccttttggcagagtctttagggttatttctaggtatagaatcatcatcagtgaagattgatagtttgacttcttttcttatttagatacattttatttctttctcttgcctgattgctctggccaggacttccagtactatgttgaataggagtggtgagtgtgggcatccttttcctaagtggaatgcttccagcctttgcctgttcagtatgatgttggctatgggtttgtcatatcatagatggctcttaatgttttgaggtatgttccttcaaagcctagtttgttgatagtttttatcatgaagagatgttggactttattgaaagctttttctgtgtcatttgagatgatcgtatggtttttaattctgtttatgtggtgaattacatttattggtttgcccaggctggagtacaagtggcaccatatcggctcactgcaacctctgcctcccgggttcaagcaattctcctgcctcagcctcctgagtagctgagattacaggtgtacaccatcacgtccggataagttttgtatttttagtagagacagagtttcgtcatgttggccaggctgttctcgaactcctgacctcaggcgatctgcccgccttggccttccaaagtgctaggattacaggcgtgagccaccaagcctggccaataactattttcaatttgtgatggtaacaaatctttgtcaagagaattgtcttattaatgaccagagtgacacttgctgccaccttcttgagaatgcctattcttgaagatggatgctcactttcttttacttccttatcaatatcagataaactaagggtggaaccttgtcctaataactgttggctgatgtttgctctcacgtcctggtggtccatgccaggtttagatagctttttaggctaaggccagctatcagaaatcattagggtttgtcataccagaaaagcattatgggtaatacatgtgtaaataagatgtgtgtgtttggcaatcaaggcatctgacttttggcctgatacattccttattattatttattgatataaaatctgtaatataaaactcattttaattacagttatccttagtatactggggattggttctaggacccacgtcctccaccctgaatataccaaaatctgcgcatgctcatgtcagcccagcagaacccatgtatacaaaaatttgaccgtccatatatgcaggtttcacatcccacaaataactatttttgatccctgtttggttgaaaaatattcataaataagtggacccatgcagttcaaacctgtgttgtttaagaagcaatggggttttttttgttttttgtttttttaagatggaatctctctctgttgcccagagtggagtgcagtagtggcatgatctcggctcactgcaacctctacctcctaggttcaagtgattctcctgcctcagcctcctgagtagctgggattacaggtgcctgccaccatgctcggctaatttttttgtatttttagtagagacgaggtttcaccatgttggccaggctggttttgaactcctgaccccaagtgatcacccacctctgcctcccaaagtgctaagattacgggcgtgagcaaccgcacatggccagcaactgtatttttaagtatattatccagtggcttttagtatatacataatattattctacaaacatcacctaattgcagactattttaatcaccttatatccgttaagcagtcattcgctattcctttctccccctagaccctagcaaccactcatctgctttctgtctttgtggattagcctattctagacatttcatataaagggaatcatgtaatatgttgccttttgtgattggcttctttaatgttttcaagattcatccatgttgtatcatgaatcatcactttactccttttcattgctgaataatggttccattatatggacatttccattttttacggaaatgtcttatgtgaacatatgaacatttgtgtacaagtttttcattgaacatctgtttttaattctcttaagtatatatatttcaaaggagaattcctgggtcttgtggtaatgctatgtttaactttttgaggaaccatcaaatacacaaattatttttagaccgcaggttccacttctgtgaaatatggagatttactcatttaaaaaatattaattgaacactttctacaggcgtactggacacctggggatcctttcatggggttgggaggagaaagacagatattaaacaaatgattatacagataactgtctaattaaaattatgataatttctataaagtagatgtttaaggtgccatgagaactgagagggtatctatatccaaacgagtgtggaaactcaggaaaggcttccttgagtaatactttattgtaactgagtgaagtaatacagtaatagcgtctaatatttattgagtgcttactatctgccaggcactattctagtctcacaaccatgtttctgatatctattttacagattagtaactgagaaatggagagttcaaagaatttaccttcaattcatagctagtgagttgtgaggctggcattcaaacctaggctgtcccaccttagagctccattacaatattcttgtctttccaagggaggcagccttatgcacagcctctgaggaagggtggtacttactgttttgaggaaatacaagaatacgaatgtgataggagtgcactgaaagtgccacaggacagggtgggatcttgtggaaggagagaggcctatgaagctcaagagtcaaatgaggccagattggttcatttaaaagattttaatggggttgaactacatgcatgttcttcatgtctttctcagtgggaatacactcagaggagtatttaccatagaactaatgaaacttaaacttcaggattcctcactacgtgggatcctgtgaattctggaaattcttgtgagttatagtgttcagaagaggccaggatgcagtcagtgagcatttctggttaatttctaagagctctcagaagaagaaggctcttaaaattgtatcagctttaggtatcacaaaacctggatccatttcttaacatttctggcaacaatatctgtctcatttcgcatactgatttgggtggggtgtctgaaggaaggtggctgagaattgctgtcttaaggcatgatatgatatcagagtcaaaagaccctgaaatgcgcttatacttggcactagttggtaagtcattaggctgtaataaaaactgggtaaaagtagactatttaaaaaataagaaccatggaaaaaaagtctatgaaaataaaactatacaaactttgaaattattgttctgatcagtacagttatatttgttgatagcctatgtgcatttcagtatttacagcttagggcataaacatgtagccgtagcataaacagcttttgaaactatgttttataaatgtggaaaatactcttgactggaaactttctaatctatttttattcttggtttcaggcgcctgatcacagattcaaaagttaaattaaagtatcagcatttaataacaaatagctttgtagaggtaagtgatttgttttccttcttgtaagaaggaattctgtttattaatagaaatactattttaaaaattataatttattgacagtaaaaaacatctttaacatatttatgaagcatgccaaaatacctttattctcaaaagagtatgacaggccaggtgtggtggctcatgcctgtaatcccagcactaagggaggccgaggcgggtggatcacctgagatcaggagttcaagaccaacatggcgaaaccctgtctcttctaaaaatacaaaaattagctgggcacagtggcacaagcctgtaatccgagctactcgggaggctgaggcaggagaatcgcttgaaccctggaggcagaggttgcagtgagccgagatggcgccactgcactccagcctgggtgacagagcgagactccctcttaataaaaaataaaataaaataaaataaaagagtatgagaaaccagtaagtacatctctccatagatcttgaccttggataataaaattatttttactgtattcttcctttacttttctttatccctagctgagaattgtagtagattactaatcgtgtcatgtttaatcatgtttgagattctaaccctgctatttctctgctcgttttaggtttcattaccagtaaatcttgttaataaagaatgctatcctttattggaccatgcctttgcccatttgttctatgactccttttgtgctacagtggcagagttgagtagttgctacagagactgttctggcctgcaaaaccaaaattctttaccctcttggcttgttacagaggagtttttcagcccctgtatgacaacatcagtaacttggtcttttaattctagaaagtaattatttctgttagagattaaacctggaaacagcctattttagaaatagtgtattatttgaaatggtcaatggacttctgaattctggtgcagagtgtttttttttcataatactataaaagttatatttccttttgaggaactaaaatgcaatctttgcctgtggtttaggaactgggttttttgtttgtttttttttttccttcttacaagagctttttatgggagaagttgtatgtatatcctttagcctatcttgaactattctgtagcttctaaacaccttccttgataaagagtatatctgattttcttgtgtcttttgaaaattgttctgaaatagaactgtaaataaattagtggtttttaatggtcacatacatgatatttaattaaagttattcagtgggattttgaagatagaacaagaggtgattcatgtattttataaaaccaggtcttcagggatcagtcatctttaaaaaaaaaaaaaaaaggcacatctgaagtgttgctatagaagaccacagcaagttttcataagcttgtgtaattatcccccatttgccccttgtaccagagaagcaatataaatagcttgatgtactaggaaatcttgcatcatgacctaatttaatttgctgtctttttttgaggcagggcctcattctaacacccaggctggagtgcagcagatgatcacagctctctgcagcctctacttcctgggctcaagtgatcctcttgcctcagcctcctgtgtagtcgggactacaggcacataccaccatgcctggctaaattcttttttcttttttttaaggtagagacaaggtcttgctatgttgcccgggctggtctggagtgcttgacctcaaacagtcctcccgccttggcctccctaagttctgggattataggtgtgagccactgtgcccagccagctgtcattttttattttctaacttgtatttcagtgcaatcgactgttaaagtggtgtcctgccccagattgccaccatgttgttaaagtccaatatcctgatgctaaacctgttcgctgcaaatgtgggcgccaattttggtaagcaagtgatttcctaaattgaaatagtgcacaaagcgtttccatttctcctgtttattcttggtagtaaaatagcagaaaaaaagtgtttaccttaggcagggagatgtttgatactggtttaaaatagtatatatctctttcagaattgaatgaaaaggtcacatcttaaaaaaatttttcctctttccttgatgttctaacttttttgaatttttttttatggagaaaatatacaactctaatcatatcttcctgtatgctccactgtaacttaatgggagcaaacttgtagatctgggactatacgtttttctttactctgccaaattttaaccttacttatgcaaaggaaatgtgcaggtaaattctgctgatggtctcctttttaactaagagttttcctgtggctcctctcgcccagctttcttggtaacttgggcttttggagttctatagtatactcttcagcctctgaattctagatttgaactgccaggaagtttccagtgccacatattaggggatgtcttaatcagttcaggctcctttataggtgttctagttttttccaaagtggataggctgaaaatttttcaaatttttgacttcttatttccttttgatgaacagtttatctctaggtcattcatctcttcttgcattttctataaacattcaagagaagctaagctgcgtcttcaacactttgcttagtaatttcctcaaccagatattcagtttcatttctctaccttccacaaaacaattcagccaacttctttgccactttatagcaaggatggcctttcctctagtttctaacagcatgttcctcattttcatctgagacctcatcataatggcctttactgtccatatttctaacaacattctgttcatggccatttatttaggttttctctatgattgaggcattccctgcacttctgtctttctgaatcctcaccagaattacccttaacaattcagttcattcacagtgatctaggctttttctagcttgcacttccaagctcttccagcctctacttactacctagtttcaaatcggctttcacatttttggttttgttagaacagcaccctcacttcttggtaccattttctgtcttaatgttcaggcttttataacaaaagaccataaactgggcggcttctaaacaacataaatttatttcttacagttcttaagggtgagaagtccaagatcaaggtgccaaaagatttgttgtctggcgagggcctgcttttctggttcatagatggtgcctacttgctgggtcctcatatggtggaaaggacaaggcagctctctgggccccttttttttttaaaaaggatgccaattccattcacctcctaaaggctccacatcctaatactgtcacattggttattaagttttaacatacacattttagggggacacaaacatttatatcctgctagaagttaagatgattttctgttcctttgagggtcttgaggagtaagaagccaatcaagtcaaggggctctagacccagcaaatagattttttgttttgttttgttttgagagagggtctcactccatcacccaggctggagtgcagtggcacgatctcgcactgtaacctttgcttctcaggttcaagtgattcttgtgcctcttgagtagctgggattacaggcgtgtgccaccacgcctggctaatttttatttatttatttatttgtttatttatttatgtatttatttttaatagagacagcatttcaccttgttggccaggctggtcttgaactcctggcctcaagtaatccacctgcctcggccctccctaagtgctgggattacaggtgagaagcaccatggccagccagattttcttttttgctgcggggtggtttggagggggaaatattttattggtattccatacctttctttttttcctccaaacatctatagaattacacttaacacatcattaataataaatatttccaaaaagagcaggtaagctcacagagattaagtatgtgtaaaatacatactgtttcgataaagattaattatgtattgttattttagagaaaaggtggataatacctactttccaatgtatttttagcgtgacacatttcaaacataaaagtatagagaatacagcagtgaatacctatatagctacaatccagttaaatcaaaattagtattttgtttttcttcattaagagataaaacatgacacatatatttgaagctccttggttccctgctccttcccattccccatctttcttttcagaaataaccatttatcttaacctgatttaaatcaatagtagtttgtttctgtctttagcaaaggactttttgccattcgtaaattacttaattagctaattaatctgtcattttattatttttttcttaagcatttgtgtttgttaattatacttcttttacaagtgtatatgtcatgaacttagaaaacaaaagtgaattactgattaacacatgtttagtgagtatttagtctttttgttttataccttgcccagtaccatttccctctacagggcggaggttcatttgtttaaataatgcaaagatgtgacctatttgcttcccatatattgtttactgtgtattagtactaaattatataagtaacctacaaagtcagccttttattcttcatttagggtgttaagtaaaagattaaaaatgcactgatgaagcatgggttgaaacttctcaatatagtctgaggcaccttagcaacaattattatgaaattgtcatcaaagcgtgtcttcatgcttatagtcattcttcacacatattgagtacccactatgtgctagttctactactaaattctaggtaattaactgtaaagcagacatgggttctctccttgtatttgccagtcactagaaactagtgacaatactgtggaactataaggcatgaaatgattggcttatttacttgcttacagtaggtaggccttaattctattaactctttgtgtcacttaacagctttaactgtggagaaaattggcatgatcctgttaaatgtaaggtgagtttgtctgacatttcaatttttaaataatggcacacttctaagacttagtgactaaaaatcatagctgatgattttgttatctatctattgatagatttttttttatccttttaatttcagatgatcattacatgtattcagaggtaattccttaggataagccaagtcagctcctgattgttattaggataaccatggctaaggcacctctttgtcaggctttgtaattaggggaatacacaccttgcagttgggcttctcttcaagctctaggttccccactcagcttctgccaaagaaaatcctgctttggttgattttatatatactggacattgtagctatgggatttccctggcttaagaggatgtgagcctagtgataatcttattcattggcttttacatttaagcttgactatagttaagtgctaaagtaatttgctatttttaaaagtcttttgttgtatcctaaccgttgttattttcaaacagtggttaaagaaatggattaaaaagtgtgatgatgacagtgaaacctccaattggattgcagccaacacaaaggttggtgttttccttcagtaactcttggtaataaaaatgataaggattggtactttggcattagcaaaagcaatgaggtgacctacttacaggctttgtttcatctttttctccattgagtctttttttttttttcccagaatgtttgcctgttatttcctttttctctttgagtttattttagagtattgagtactgtagtacagcatccacagttctctgccttaggtttcttctactggaaaaaaaattagtgttctgtagaggaaaaagctgataatttttcaagtgtgggatttgtgcttggctgccatttagtatacaaatgcattggagtttactccgcctagcttggttctgttaggctaatttacatttttgtttctaattttttgttttgaagtacattgctcttgatactagtttcaaaattcaatttcaaaattcactttcttaaccccagacaaatgtcttagaagtgtttaaatcttgagtacccttctcctcgatcactaatctaatgagcaagcatttgaatgccaaccgtgtacccagctagtcttttaatacaaagtcgtattatccatcctttatgtaattcagtcctatcctatccccatagtgagtgacttgggtaatgaatggtaggttggttcatgggctattcatttttagtattattttgtacatgtaaagatgatgctttaaagaatgctgagttgtttgacccatagtatataaagctatctttgaactgttgcctcagtcatcacaggacaatgagattaagaagtgtgtaaacaatgaaggccgacgcaggttgtctgtgtgtgtttaaatatacatcttacatacttatatataaaacatgaatttatatttctgtctcccagaaagtagtgaaacagtgaatcttgccacataaaacaaatgcccaagtctttaaggaatatatggtagaaattaatattttttgttccctccaaaaccatcacgataagcataactcacgtcaatcaaagaaaaccttactataaatatactgtaatgtcagaaagtggttacttgttttgttattaaaaaaaaattcttagccaagcattctttttttgaaaattgaagattttcccacaagaaatgttccttaagtcccagaattctttaatatgctctgaaaaactaatatttagaataaggcaattatattttcactaaattgtttaattaaatggtagccttttttctacatctagagaaattcctacttgtaagccccaaagatgtttaaaatagggagtacaggcttgaatatgtttggcttagtttagattgtagattaccaaggaagaatggcaatttgtaaaacaaatttagctgctcagtatttttgagagaaaactgaagagtttttctcttgaggttttagaagcttttaagattattagctccctaaacagatatgcatattgtcagtgatatcctaacattttggaggtttaatactattaggttaattataaccaagaaatgtagaatgtagaatgacgcatattttatgcctgaaatttgcttgtttggaaaaaatgtaaaatttcttatgtgggtgatttcaaaaatttgatttgaaatatataattaaaaagttgctatattggcctattttaaattgctatcattgatgggcagcatagtcaatttcacaaagaaggccaaattgtgcaaatactaatatagtgggtgatccctccttgggagagttacaaacctcaatcacaaatgcaaaaacaaaaaatccataggcctacagagcagtaattttggcttactagcaaccaagaatatgatatgaggccaggtgcagtggctcacacctgtaatcctaacactttgggaggccgaggtaggcagattgcttgagcttgagagattgagaccaacctgggcaacatggtgaaaccccacctcaacaaaaaattcaaaaattagccgagcatggtggcatgcacctgtagtcccactacttgggagactgaggcaggaggatgacttgaacccttgaggtcaaagctgcagtgagccatgattgcactgctgcactccagcctggtcgacggtgagaccctgtctcaaaaagaaaaagaaaatgatttggacttggaaaaaaacaatctaacacgatctctgtagcatacttgttaaggagtacaatgaaaagaatttaaaacatggttatttggtaggagaaagttggaaaatccagtagccacaaaatgaatttaccaatcaaggtctgatttcctagttacctgacactgaagtcagattgcttggatttggatcctgacttgacttatgtgaccttggactagcttctttataatttttctctcccttagtttattcatctgacaaatggaaataggaatagcaccactataagaattatgagttgatgcatataaaacactgagaacggtacatgggatatgggaagtactcaattatttctagatgacactagagagtatagtatatttatatgaatagaatgcttttatctcctatagtactgttattactatatatatgactaaaagtacttaaaatgatttgtctctcagccctacttaaaaagaaatcctaggaaggctgaagtggaaagatcacttgactccagaagtttaaggctttagtgacctatgattgggcctctgaatagccactgcactacagcctaggcaatgtagtgagactctgtttctaagtttaaaaaaacaagtccttaaattgttgtatgtcttaaaagccagtggtaataatggtaacagctcattttaaatagtgcttaagtgttcaacactgttctaagtgctttatatgtattaaccacaataaataaaatgtttaaaaacaaaccaaatctagaactggcttttccttaatgttagtaatgcaacctagtgtagcattgacaccaactttatagtttctcttcataggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtaggttggggaaattaagggaagaatgtgtttacataagtatgtgccatgtattatgaataacatttctacctcatagatatcaccatctaacttgcaagctaaataaatacatagtgtgtgattaatgttataagtctatgcaagacatagagggattagttagatatatttcataaaggaggtaacaatttagatgaactttaaggggaccaagagttcattagttataaaagtagtaggaaaaacatttagggcaaaagttgcaacatgagcaaaggtagaatgttgtgaaaatacatgactttttcagagaataactgtattatcaaatgtgcctctctaggccaaaattgaaaactcagatgctgttggcaaaacccaacctgcaggtggttttactctgcatatcattagacattgtggaatgctttaaagccttgctaaaaggctttgtcatattttttctttaaataagcatatatatgttgctttccttgttttattgatgacttacttgaactaatataagaatcttgggccaggcacggtggctcacacctgtaatcccggcaatttgggaggccgaggtgggtggatcacctgaggtcgggagttcaagaccagccctgaccaacatggagaaaccccgtctctactaaaaatacaaaattagccaggcgtggtggcgcatgcctgtaatcccagctactcgggaggctgaggcaggagaatcacttgaactcgggaggtggaggttgcactgaaccaagatcgccccattgcactccagcctgggcaacaagagtgaaactgtgtctcaaaaaaaaaaaaaaaaaaaaaaaaaaaaagaatcttacacagcatatgaagcagttttctcactggttaagggcataagcctccactgggtgacaggcaaaagtttaagctctgaaactctgtagttatgtgaccttaagtatgtttcccatcctctgtaaattttattcttcatcttctcaatgaagaaaataatgcatatttcataaaatgtttaagggattaaatgtgttagtacatttaaagtcattagccaagtgcatggtatatagtaagcactcatgaaatagctgctcccataatgtaggctcccataactgatgtatagtaaccactccaggggaagtgcaagtcttactcatctatgctctgagctgacctctctgggtatgttttccccttcccaccattctgtatatcatgcagttttaaatgactctgaaaaactgtaatagcaaagcacatagcacagcatctgttacatggtaggctgtcaactgttggttctctgtggtttataaaagagcagataaggtgaataatcctggaaaattagaaatatttggcttaagtaacagatggcctaagagataagattatctctttctcaaaaagttgagttaggaattcagacagtcaataaaggttctagaaggacagtgttttctaataatgataggtgagctgatttgaaatggactgcctcaggaggtggggaatttcctatcactggatagagaactaatttattatagagagaattcaaacactagatagggttagaacagttcctttcagcctgctaattctgtcattatagcagtagaaccctgggtgttttaacatctcaatttctctgttataaaagataacgttggtgttagataatctgtaaatccaggttaaaattctgattttttttttttccttttcattgattttttttttctttatggaatcctctttatttacttgaaggtacaactgtaaccgctataatgaggatgatgcaaaggcagcaagagatgcacaggaggtaagtatatgtataacaggacaatagttgactaagaatgcacgttgtatattcatattcattagagaataattttttttttttttttttgagacagtgtctcgctttgtcgcccaggctggagtatagtggcatgatctcagctcactgcaacctccacctcctgggttcaagtgattctcctgcctcagcctcctgagtagctgggattacaggtgcgcgccaccacaccctgctaatttttgtatttttagtagtcagtctagtctcgaactcctgacctcgtgatccactggcctcggcctcccaaagtgctgggattacaggcgtgagccaccacgcccagcccagggaataattgagtagaacttttcaattctgaaggatttgtgaaagacattccagtaaatattggatatctatttacatttagaaagggaatcttatccaaaatatttatcaagaacattcttatagtaagtttattttcttttcattaatgtagttacatagcacattttagcttttggtagagtcttgctttcaagatccctcctaccccaagaagaacagtagtgaacagcatttgttaaatggccctggtgctatttataggcaatatcttacttacttaaattttttttaaacctttttgttcatcaagaagcgctgatgattataggtgagctgatttggtatggagtgtctcaggaactgagaaattccctattgctaggtagggaaatgacccactgttatagaagggatccaaacactaggtgtggattagattctaaagcacttttcattcctttcagtctggtgattttattgtaattgtggaaccctggaatttaatagttcctacattcacccattccatattgaaattccccagttgtcccagaaatattcttttcaaatgattttcctagccagggtacaatctaaaatatggtttgcatctgtttcttatttacttgttaacatatcttcaaaatgtatttctaataaaaatatcatatatagaaatgagtatatatgtaacctagtctgtcatattgctagaagtgaaagttttgtctttccctttttaaaaagactgggaaatacggccgggcttggtggctcacacctgtaatccctgcactttgggaggccgaggcaggcggatcacctgaggtcgggagttccagaccagcctggccactatggtgaaacactgtctctactaaaaatacaaaaattagctgggcatggtggcttgcacttgtaatcccagctactcgggaggctgaggcaagagaatcgcttgaacccaggaggtggaggttgcagtgagccaagatttcaccactgtactccagagtgagactctgtcgctaaataaataaataaataaataataaaatgactgggaaattatattttgtaactataaatgatgtttcacagaccttcacaatgtttgggtccatttaaggggaaaaaatccctacaaattccaatattgatttaaattatatttattataatattatttaaatatgtataaacaaaaaccagctataaattcttgtgctcttgcacaattctacagccaaaccaagagagccacaaaatcagtgaaactcaagtaaatgttaatttggtagatactgttgttggggttttaaaaatgtattattactgtactgttaaatatcatgagataacttgttctcccaccaattttcttttctttcttaaatgatgtcccttaagtcatatcccactaactttctatatatttctatatttccaacattaatttttatgatgcattacttgatttgcccagaatgtattatggatatatgttcttatcacctttttttctccattaacctgatgtatttatttagccagatatgctgtttatcaacaaagaaaatatatgtggtttatccttgacctcacctggtctttatttggatgccggtagaatccctttctgagatctatagggagggtgggttatgtgcatagcttttgagccagagtctaatgtttagattctagatactaaaatagattatttttctgtttcacatctgttggactaaactagaatcttctataactgtgggagtacaaagaaagatttcctatcactccattggttgtttggttgattgactaattgattgggagccacgcctccctgaaaggatcacaccattgcatgcctatctggcctcctcatctttccccactcccaagctcttggcctagcatttactgggagttgtagtctgaaaaattactagaaggttgacacatattcaaaagatccttgatggtaccttgactgccctgcaaaagatgtacctgtgttatagaaaattgttgactcattatattgtaccacagtgccgacagttgtggatatttgaatcttcttgtcctctagactagggtcagcaaactttttctgtgaagaatcagatggtgtatatttttagctttgcgtactacataatctctgttgtgacggctcaactctgcctctgcccttataatgcaaaagcagccatagacttaaatgagtaggtataactgttccaagtaaattttatttactggctgggcatgatggctcaaacctgtaatgttagtgctttgggaggccaaggccaaggatcacttgaggccaggagttcaagaccagcctgagcaacatagtaagacccccccgccgcccccgcccatctctacaaaaaaaaaacaaagaaggtttttaaattagccatgcatgttggtgtgtgcctatagtctcagctatttgggagctgaggtgggaggattgcttgagctcaggagttccaggctgcagtgagccatgatgacgccacccctctttagcctggatggcagagaccctatctcagaacaaaaaaacaacaaagaaagcaaaacagttttatttacaaagacaggtggcagctggatttgtcatgcaggccagagtttgtatacccctgttctaagcagtcaagtttgttgtcttttccacgctccccaaactgctttcaggtcgctgattacatttctcattccagattctggcatttgattggagaatttgtcttgatcaggctcagtggctcacgcctgcaatcctagcactttgggatgctgaggcgagaggattgagtgcgggagtttgagatcagactgggcaacaactgagaccctgtctctacaaaaaatttattaaaaattagccaggtatggtagtgcacgctggctgaggtgggaggatcacttgagcctgggaagacttcagtgagccatggttgtgccactgcactctagctcaagcaacagagcaagaccctgtctccaaaaaaaaaaaaaaaaaaaaaaaaagtcttattagcagtgatggtatgggtgttcttttttcatgttgaattttagtgagaagcagtttcagaattcttagattaagtcaagtcccataacatcatacatgtcaatatggtaagggagggttttcatttcatttggggaacttgacaggcttggaaatattagtactttaggggaagataaaatgccaagcagattttccacatattttcagattggcataattttcctgttcataagcattggtttgatacttacctgactcttgaaataacatggctgtggttttgttgttttttcattgagatgagggtctcgcagtggcatgatcatagctcactgtagccttgaactcctgggcccaagtggtcctcctgcctcaacctctgcattagctggaactagaggcagcttgaggtgtgcaccaccgcgcccaacttgtgttggttttttgaagtgtttcgttgtataatgctggatcatgtggttagctaattatgtggctcagaattagtatttctaagcaagggaccaaccatagggccaagtagtatctgttatgtaggctttaaaacatggggagagaaagaggaggtaaggataaaggaaaagaacatacgtgtgttaggaacccctttgataggggccgggcgcggtggctcatgcctgtaatcccagcactttgggaggccgaggcgggcggatcacaaggtcaggagatggagaccatcctggctaacacagtgaaaccccatctctactaaaaatacaaaaaaattagctgggcgtggtggcgggcacctgtagtcccacctactccagaggctgaggcaggagaatggcatgaacccgggaggtggagcttgtggtgagccgagattgtgccactgcactccagcctgggtgacagagcaagactctgtctcaaaaaaaaaaaaaaaaaaaaaaaaaccctttgatagtggttgcatttagtaagcatttattaatggttttctgcaaatcaggtattggaaatactttatctttttaaaagtccattccctctagagatttatggtataatggtagaggcctcatatgaataattatatattataatgtaataatacaaaacaaatctaaactagatacattgttgctttgataacaatatactttacatatctctaaagacagactctctttacataactgtaataccattacagttgactcttgaacaattcaggggttagggacactaacccgccctacctccgcaatggaaaatccacataccacttttgattttcccaaaacttacctgttttaatagcctactgatgaccagaagccttaccgataacatagtcaattaacacatattttgtatgttacatgttttattatactgtgtgcttttttttttttctttttttgagacggagtttgctcttgttactcaggctggagtgccagtggcaggtctcagctccctgcaacctccacctcccgaattcaagcgattctcctgcctcagcctcccaagtagttgggattacagacatgcgccaccatgcctggctaatttttttgtatttttagtagagacgggatttcatcatgttggtcaggctggtcttgaactcctgacctcaggtgatccacccacctcagcctcccataatgctgggattacaggcgtgagccactcactgtgcctggcatatactgtgttcttaacaatgaagtatgctaggaaaaaagttattttaaaaaattgtgaagaagagaaaatgtgtttactttttattaagtagaagtggatcagccgggcccagtggctcacgcctgtaatctcagcactttgggaagctgaggtgggcagattgcctgaggttgggagtttgagaccagcctggccaacatggtgaaaccctatctctactaaaaatacaaaaattagctgggcgtggtagcaggcgcctgtaatccgagctacttgggaagataaggcaggagaatcacttgaaccctggaggtggaggtcgtggagagccgagatcgcaccattgcactctagcctgtgcgacagagtgagactccatctcaaaacaaaaaacaaacaaacaaaaaaacggatcatcataaaggtcttcaagttgagtaggctgaggaggaaagaaaatacaggagggcttggttttgctatatctcaggtggcagaggtagaggaagtcgaatgggattcaggagatgcaggcacacttggtgtaactttacaggaaaaccttacgaaccgttttgcattttcatttctctaaaaatgtttctgtatagtaacaatcctctttccatttgctttagtttcagtgctggtataatagaagggtccattcataaaggaagtccaaagcagtcttaagtaatcagaacccttctgccaaattgtctaatgtcaatttattttctggcactgcttctttagtgtcttcttcctcatcatctggcactggtttggaagcagctcatctccatcaagtggtcttttaattcctctggtgtggtgtctgttagctaacccttcaccttccacgttttctttgccatatccacagtctctttcgtgatttccttgatgggctctgttgtagatactgcgaagtcacgcgcaacatctggacacagttttctctaccaggagtttattgtttcagtcttgatgatgccatggttttttctataacaacgatgacatcttcagtggtgctctccttccagacttccatgatgttctgtgggggttctcttcgatagcattgacagtcccttccagagtaccgtgtgcatctttacgtttgtttacatttctctcaatgtgaatggtaccatatacggtctgtaagagtttgtgtgcataagttttgataaatctcaactttttattaatagatttatgtatattttatcgtagtaaatcataagataggctacatatgtcttatgcattcatgacaactctttttcttaattttggtttgtccgcaagtgttttcaaattgttggcaaacctccaaaaaatatttcaatatatttattgaaaaaaatccacatataaagtagacttacagtttaatcctgtgttgttcaagggtcaactgtatatgttttaaagcaatactctgttggtatcaactatctattgttcaaatatccccaattatcttaaattttgcttttttttgttttttggtgttttgtttttttttttcagaggtagagtctcgttctctccccaaggctggagtgcagtggtgcaactcggcaattctcctgcctcagcctcccaagtagatgggattacaggcacatgccaccacgcccagctaattttttgtattttagtagatacagggtttcactgtgttgcccaggctggctcaaactcctgagctcaggcaatccacccgcctcagcctcccaaagtgctaggattacaggcatgagccaccacacccagcctatcttaaattttcttttatagttggttcaaattgggatccacataggtccacaaattggatttaattgatatctcttgagtctcctctacctgttgttccttctcttcccccctccttgcttttttttctttgttgaagaaactagatcgtgttgtcctgtagagtttcccacattatggattttgctggttgcaactgcatggtgtcatttaataggttcttctatccctgcattttctgcactggtgattaattcaagaaacttgatcaaattcagattcagtggttggggggggagcccagaatacttaattgattatactttctattgtattatatcaggagttacatggtatgtagttgccactgtagttttctacttaaaaatatctctgctttttgcttgttttacatcttgtggcatactgtagaacagtgccatccagtagaacatttttgtaatgatgtaaatgttctttatcaccagtgtctaatttggtagtcactaagcacatgtgactattgagcgatgaggaactgaatttttagtttcttaaattgaattttaagtagtcaggtgtggcttgtggctactgtattggaaagtacaattaataggacatttttcaagagtattaaataacaaaagtagcagtagatgtctattcctgattttagcctagatcacagtactgtttcatcagtaaatcagctttttaaattattaatatttttaatggacaaatcataattatacacatttatggagtacagtggaatgttttgaaatatgtaaacaatgcaatgattaaatcaaactaattgttgtattgccttgccttaacatttttatggtgagacatttgaaatgatacttattttgaaatatatattattattgactatattcaccctgttgtgcaataaatctcaaaacttactcatccagtctatctgaaactttgtactctttggtcaccaactccccattccctcccttcctacccctctatccccgcaagcctctggtaaccgtcattatactctgtatgtctgtgagttcaacttttttagtttctacatataagcgagatcatgtagtatttcttttctgtgcctggcttatttcacttagtgtaatgtcctccaggttcatccatgttgtcacaacagaattccttttttgaggctgagtactcgtgtgtgtgtgtacatacatgacgttttctttctgtgttcatccattgatggacactttacatggattccatgtcttggctattgtgaataatgctgtagtgaatgtgagagtacagagatacctttgacatactgatttcaattccttttcatatatacacagtagtgggattgctggattctgtggtggttttgttttcagttttttaaggaacctccccataccattttccataatggctatactaatttacattcccatcaacagtgtatcaagagtctccttctttctttatctttgccaagacttatctttcatctttttgataaaaaccattctaacaggtgtgaagtgagacttcattatggttttaatttgataatcagcttttatgtacagtttatgtgttataattatatcacccaatttttcttaatgggacagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgaggtaggagtagttctgggtgaggaaaaagcccaccttgtatcataggtctacctgatctttcatatataagatacagagttttcagggttcttgtttgttcagaacatgtaggtagacgaatgtatttattacaaagatacaagaaatttctatttcttgtcctaaattatattcagatcgatgtggtttagccagctagtgattaggtatgcaggttctggagtcagccctagattttaatctttacttcattatgttttagctctgttgatttggagcaaattccttaacctcttatttgtccattttaaagtgaggatagtacctttctaggttgttatgaggtttaagtgagacaatttgtgttttatgtgagacaatttgtgttaattgctatacggcacctggaacatcataagttctcaataaaagcctttattcaggctaaactaaccctgcaatattagaagttaatgtggtggttatctttagtggagaaataatgactaaaaagccagcttttagcagtaaaggttttctcaagtaaagatgttcatttaaaattgatgcataaaacattgatatctgtatatgactagacaataagactgactagcagatgggacttcagttgggtaacaggtacaaaactagccatagtggtaaaggatgatacaatttgaatcttccatacagtgttttcttataagaaataagtatagccagatgtaagcaataataggtttctattttttctcatttacctttgagttttcagcaaagagcagctctcagaacgagaagattccaaaagacattttaaatcctttcaaatggtcttcagtattcttccaaaagtaatgggtgaaatctttcgttcttttaacatttaaaaaattgttctggaaaagaacaaacaagttattagagatgaaagcccatagagctttacaggtgcagttaaaccacctatgaaagttacagaatgagtgttgagagcagtctgtagtcaacaaaacagtgaaaatggtttatcttttagctttattttgaagccaaaatttactttcattcttcttacagaataaccaagcagatctagagaatgccacagaggtgctctcgggctaccttgaacgagatatttcccaagattctctgcaggatataaagcagaaagtacaagacaagtacaggtaatttttttttaagctgttgaataaaactttctgccagtgatgatccttactggtaaagttcagtgatagtgaaactgggtttagcatatccagcaactgagcttttgccatgtttctcacagattgcttctgtccgttgggcactaaattgcaggtaatagtattggtgaagcatacatagagaaggaattcagccatttattctattggctaattccacttctgttcagttatttagttgctaccttgcaaggaagaaagaatccaaaaaggccaagtggcctttaggatgagagtgagaattgaatgttggtcttagcctgagaatcctatgtatgggtcatggctattcacaaatgagctatggaaacttactttttagagtttttattacatatatatatatatatttttttaatctaaggagatacttgtcctaggagtcgatttttcaagatgtgccgcctcttaagctagagatgcaaaatgttttatttctcaacatgaagctctttctcccaaagtgacaaatgctagtgtcttttgaaagttgtaggaaacttggggagtttggaagacttggagatttagtcctaaccaatatcttcccttcccttagccaattttagctaccatattttgtttacagtacttttacagttgacagagattttaaggacgtgaataaagaacccatgaaattatttctgaacctgtttatctgcagaactgtgggattgaattatgatttctaaggtccatcagaacttgtaacactttattgctttaaaattaattcccatggaatcatggctttcagaaaataccattttaatattagaagcagtttgatgtgtctgtacatctagacctgaacatgtgcctattaaaataaaaaataggtgcttggttccgagtctggataaactatagggatgccttaaaaataagtaaatgcctctttttttattattagaggctgacaacaagtttttttttttttctctttgattacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccaccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttgttattccattagttacttatgtttatttttatagttaaaaaatgactaaaggtggctaatagccacccgtattatgtgccttattcactgttcccacttaatataaaatgtcaaaaattggttgtttctttgcagggaactgtgaatgagcccattcccccaacatttaacttggttaatgaagctttcagagcattttctgaaagatttccaatttctgcatctcagatattgaatttaaattgtttgtgttgtaacagtgatacaaaaatgttcaatagctctttgaatgccactttttttaaagaaaatactttaaaagtcattcttagctaacctcaaaactcctttacattactttcattttagctcactcttaaagctgatactgttatatagggatgaagggagagttttcttaaagaaggtcccaaagttgaagatcgtttgtcattgatactctggccaagtccaggttttaggacaatttaatttactcttatttggatctgtaattatgggagtttatcacttttcctcttcaaagcacttcaacttactgtctaaaacaagtggagaagaaattgccattttttataaaggaggaagataaggctcactgaggttaaataactccctcaatttttcatttccttctacctgaaacttaacatcatgctacctctttgtatcatattttgttattctggtcacagaatgacctagtattctgtaccagggaaggtagttcttaactatattgtacttttaaaccacattaaagactattataaatgcctatcactgctactgttagaggttgctctatactatctctgatctttcatttgttgcagtttgcaacacagtagttgagaataagtggtttagtatgatttgcttaatagtacccaagtaatttgcagttgttggtttagttattcaaatgaatttccattgtaaagaattttggatagtctgcaggaaattgttacaggatgcacagaacatcccatatccattggatctcagcctttgaggctttaaaaagatgataagcagtgagttttatgagaaaattttggctccttcagaaacaggaagataagtgggcccctcagatttttcatatatctttggggataaagttggttatatctggtttattttagggattttgcttctgtagttacccaagatcaaatagccaactcagaaatactcagttggatatcaatcaaatagtgcctaccaggggagtaaacagacaacttttaggtttttagtttttgcttttgtgtggagttgagtccaatttttaaggcaactattgttgacctttctctaggcggtagcatttaggatgggaaaaaataatatgagttatgtgcgaaaagcagttttcaggctatcatttagggccacagatatgcttatttaggactattttcagggtaggagccagttaaagtttgtatatcagtcacacattgatatgtagcagctctatcaataccacaacaaccttattaccatagtaattcaggggtctcaagtaatccaggagtctcaaactgaaatgtcaacaagagccaagtaaatattttagaaatagagtaccctggagtagatgggctctgagaggagcctgtgaaatccagacttcatgtgaattctcttaattaaatgtgggccaaagaaaacccggccatgggcagtttttttttcccagcttctactagtcttggcttgcaacaatgccactgtccatctggcattacctagaccagtgatacttaaacttgactgcgaattggaatcactgagaagctttaaaaaatattagtgcctgagtgttactttatggagattatgatttaattgctttgggtaggcatcagtaatttttgtaaagccctttacgcattctcacccctaattccagccggtgattctcacatgcagactaggttgagatccttgatctagactgccttctatagttgcaaaaagagaatataggcgagcaactccagatcataagggacaaaatgattcaaggcaaattgactggctcagaatagggcctcactggaggccctagttgagtgggttttgtggaatggtgcctcccaagggtctggtgtgcagtgcccaatttggttttttgttggttttctggtaagtggtccaccttggagaaaatcacaaaactaaaagtcttaccaagaagtagaactgacaagcagccatgttgattggcagtacattctcttaccaagggggagaaatctatctagggaaaataatacagagtctgagcaaaggaagttgagtggttataagcaaaactgtcattaaagctagttgcgtcaagtctgcacaattccacgagcacttaagagtttacaagtttctcatgtctatcattcttttgataatcttgtatttttatttcaagtgtggtatagtagtaagaatattggtatttctcagccatagatttcccttttgtaaaatgggaatactaataggaactgtaatttgttgagtgctttttgccagatgccttacttttgtctgtatcttccaagcagccctaaagcaaaatgggcattgttaccctatttttatgaggaaagacactcatatactactaacttactcaaaagttacacattgagtgtataacagggccatgcttgtctgattccatatgttcattctattatgctgctgttgtctgttacataggaatattgtgaggatcaaagaacatgtgaaaacaaaacctagttacaataataagcacaccagtgctaacttgggcaaaagataaggatacagagctgtctcagagactcccaaaggcaggatgagattgggaactagaaaaccattttggacccctaaagtggtattgtctactatctgtacatcattctcttacagctcttactgctgcttttcctgtcagttaccccatagctccaggtattacatgttaactgttcctgacacatgtagacagaaccaatcagatccatggggcaggatcatcaatacaaacatgggtgttgagagcttaacttaatcgggaaggagatcttggagatcatagttcgctgggttcacatcatggaaatcgtctttgacaaaactgaaatgccctgaagttttaattttttaaatacatgtaatgaattggtatatggtagatactcgtggctacttagtatttaccaaatgctttgtttccatctcgtttatttttattttttatttttttaagagacagtcttgctatgttgcccaggctggacttgaactcctagtctcagccaaccccttctgcctcagcctcctgagtagctgggatcataggcatgtgccactgctcctagctcttccatctcagtcttatgatgtagttactattttcattttataaataagaaaatagaagctcaaataaaatgggtagtttccttgaggtcatcctgttagtaagtggtggaatgaagttacaaacctaggttttattggtcagcacacacagtgccgggcactggcagtacagcagtgaacaaaaggtctgttggtttgtctgaagctctcaaccttgattctgcatagactcggtggattgcccaaggccactcaaccagttaatatcagagccagctctgctgtttgaccagtatattattttcaccatgctgtatctgcttctcagtcaccaaaagcaccagctaaaattgtatatagactgattaggggacttccaacctaagattgtcctggaaacttaattcttatcttggctcatctcttcaaaacagatgcctctttcgttggtgacctcagatacactgttcagaagtactcaaagtattccttttttctcacatttgagagtcactctagcattttaatgagttaagcaagccagccctgcatttccaaacccttcccagaagtctaaccttactttgatctgatgacatgggctttttaaaagattactatttttttagaggtggggtctcactatgttgcccaggctggaatataatggctattcacaggcacagttagggtgcactactgccgtgaactccaggactcaagccatcttcctgccacagcctcctgagtaacctaggactataggtgcatgccaccatgcccagctgacaatggctttatatacataatatttcctcagcaacaatttatgtcttatttggcacctgtaaaaccctcttcactgattatgcctgtttaaaggtttggtatttactccaagtcacctgcctttagccatggagtattcaagtttctttcagaatgagaatttggagggtgctcatagaaatataaaacaaggctgggcatggcggcttacaccttgtaatcccagcactttaggaggctgaggcaggtggatcacgaggtcgggagttcgagaccagcctggccaacacagtgaaacctcatctctactaaaaatacaaaaattagccaggcatggtggtgcatgcctgtaattccagctgctcggaaggctgaggcaggagaatcgcttgaacgcgggaggtggagtttgcagtgagccaggatcacaccactgcactccagcctgggcgacagagagactctgtctcaaaaaaaaaaaaaaaaaaaaaaaagaagaagaagaagaaatacaaaaccaactctttatagtagacagtttatcccccagaaagctttttaggctgaaaacgtttctatagattttggatttccttctgatagctaaaatttgtttctgtataacagagtagtgccctataagccagttcagtgcacattaaatggctgttcttagaattatgaatctgaggcttatgcagtgaggctctagctctctggagtcagttggtcaagtgggattcctgaggactgagcaaacacacacagagcaggattttgtcctaagttttcttagggatcctatccaaaaacaccattacttgaatttcccagcttccttttacagggagacttccttgctatgtgtactcccacctcggtatgtcaaatcattttctcagaggaagtacagcataaaataataaccagcatttgtagagcacttcttgtgggccttcttgggcaaatagacattctcatggaatgctctaaaattgttaagttcttgcacttgctctcaagtcatttataatctaattgctggtcttcctggtatgaacaaagatgtttgcttgttaataaattcctaccacatacccagacttgtggtttatttctatctaactagggaaagcactaaagagttttccaataaggaagaatgatctgagtgtctacctgctttggaaaagatgtctgccatggataggaaatgattttgtatcccaaaatcctagtactaatttggagtgttgtaaaggtcagggcagcaaatgctagagagtgggattaatgaaaagttatagtgttctgcatgcctttgaataattaatttttactccatttttactcgcttgcaataaagtaggttaagtgctgtactttaaggaagtccatgtacaagccagtgccttaacaatggtcaaatggttgctcactaaccaatggaaataaatgactgttgtttccacaaaattgctttacagattctaaatgctatctctgggacactggattgtgtgctctttaagataaattccataatcaagggcctggccctgaatagattggagcccaaaaatctcactgaagcaaagagataataggccagtaaagagtgggagacaaacactcctggaataggaagccactactcacctttattttaaattgatatatagaaattaatattacaaaatgcacacatcttaagtgtgaagtttgatgttttgacagttgtatacgtctgtgtaataactaccaaaagaagacataatatgttacaattaacccagaaaattctcaagtacttttaaatcacccctgagcacctccccactccagtgatcacttcttgatttttatcactaaagatttgttgtacctgcttttggattacatataagtggaatcatataataatgtactcttttgcatctggcttctttcactgataatgctttaaagacacgcatactgtatgtattaggacattgttctttattgctgagtagtatttcattctataaatataccacaatttgtttattcattctcctattgaaggacctttaggttgtttccagtttggggcaattatgaataaggatgctatcgatattcttacacagccttttgtttttgttttttgtggatatacatcttcacttgtcttggataaataagagtagaaaattactgggtcatatggtaagtgcatgtttataagaaactgccctcttattctccaaagtggttttaccattttgtactcctatcagtgatgtatgagagttacagttgcttcacatgtctgtcaacatttacactgtcactgttttttatattagccattttagcatatatgaaataactgattttaatttacattacatttccctgattaatgagttgagcactttttcatatgcttatttttcatttgtatatctttcaagaagtgtctttcatgtcttttctcattttaaagttgggtgtctttttattgtaggtgttattctttgtattttgaatataaatcctttgatagatatgctatgattttttaaagactctatgtattcacttattgggatctttcgatgaacaaattttttttataaaatccactttatcagttttttattttatggttttatgacctcaaagtcacaaagaatatattttcttctagaagttttatggtttgggattttatgtttaggtctgtgatccatctcaaattaatttttgtgaacagaatgaggtttggtttttttccaacatggatatacagttgttccagcaacatttacttaaaaagacttttctttacccattagattgacttggtagcttggttaaaaattgatcacgtgtgtgtgtatttctacattttctgttctgttccattaatctatttgtgtatccttacatcagtaccacactttggattattgaaactttctagtaagtctttaaattagtaaatccttcctttttgttatttttcaagatcgctttggttattgtcgattctttggattgtcataaaagttttacaattagctcatcttgtttttcaaacgtagatgtgctgggttagctgtgttcatgccactgcattccagcttgggtgacagcaagaccctgtcaaaaaaaaaaaagaaaagaaaaaactgctagaatcttgatatggggttttgttgagtctataggtcaatttagaatgaacattttaatagtattgagtcagctaattcatgaacatattaagtcttgtcatttatttaggtattaaatttttttctcagcaatgttttgtagcttcccttgcgtaacacttgcttatcttacattagactttttcttaagcatttgatttttaaaatatttttgattttcttttctttttctttttttctttttttttttttgagacggagttttgctcttgttggctaggctggagtgcagtggcgcgatcttggctcactgcaacctccgcctcccgggttcaagcaattctcctgcctcagccttttgagtagctgggattataggcacacaccatcatgcctggctaatttttgtatttttagtacagacggggtttcaccatgttggtcagcctggtctcgagctcctgacctcgtgatccaaccaccttggcctcccaaagtgctgccattacaggcgtgagccaccgcgcctggctaattttcatttttaagttgtttgctgctagtatctagaaatacaattgattttttgtttgtttctttagagatgggtctcactatgttgcccaggttggtcttaaactcctgagctcaagggattctcatgcctcagccacccaagtagctgggactttattcacgtgccagtgtgcctggctgatttttgtatgctgatcttgaatcgtgccaccttgctaaattcatttattctagaaatagttcttgtagactccgtagagttttatattaaatagatacacaacagtgtagtctgcaaataatgtttttacttctttttctgattttatgccttttcttctttttttttttttttttttttttttttgtctttctccactggctacaatatctagtgcaatgtttaacgtgtggtgagagcagacaccttgccttgttttcttaatcttagggataaagattttaatgtttcatcactaagtataatgttaactgtaagtttttcacagaccagcccaaagaagttcctttctattcctaatttgttgataatttttattaggaagggttattaaattttgtgagatgcgtttttagcttttaataagattattatgtatttctctttttattttgttaagatggtatgttacaggggttggcaaactgtggcccatgggccagatccagcccatggacagttttgttgttgctgttttagagacagtctcactcttttgctcaggctgccaggctggagtgcaatgacatgatcatagctcactgcagccttgagctcctggactcaagcgaccctcctgcctcagcctcctgagtagctaggaatacaggtgcatgtcaccacaccaggcaaatttaagaaattttttgtagatcttgccgtgttgcccatgatggtctcaaactcctggcctcaagcaatcctcctgccttggcctcctacagtgctgggattagaggtgtgagccaccacacttggctctcatggactgtttttgtttttgttttgagacagggtctctgtcacgcaggctggagtgtggtggcatgaacgtggctcactgcagcctcaactttcttggctccagcaatcatcctgcctcagcctcccgagtagctgggaccacaggtgtgcgctaccacagctggctaatttttctttttcatttttgtagacatggagtcttgatatgttgcccagattgatctggaactgctaggctcaagtgatcttcctgccttgcactcccgaagtgttggcattacaggcatgagacacagtgcccagcctattgcagtgttttttgttttttctgttttttttttttttttttcatctttgtttttgtttttttgagactgagtcttgctctatctcccaggctgtggtgcagtggtgcaatctgcaacctccgcctcccaggtttaagcgattctcctgcctcagcctcccaagtaagtgggattataggcacatgtcaccaagctcagctaacttttatatttttagtagaaacggggtttcaccatattggccaggctggtcttgaactcctggcctcaggtgatctgcccaccttggcctcccaaagtgctgggattacaggtcactaggcgtagtagggctactacgcctggccctactgcagtttttaataagagatgagttctctcagcttttgtctataagagaatgtccttacttttatttttgaggggtattttagttggatataggactctatgttgaccttttatttcttctttcagtactttaaagaagttattttattgtactcaggcctcatttgtttctggtgagaagtcattcatcattttaatttttatttcctttccgtaatgtgtggttgttctcaatggctgcatctgtgcattatatttacttttcagtagattgactagggaatgtctaggtatgtttttctttgtatagagtttactgaacttcttggatctgtgttgatgtctttcattaatattggttctttcttggccgttatccgtttacatttttctcttgtctcatactctcttgcttctcctcttctttggagattctagttacatgtatattagatgatttgatataaacctacagatctcagatgatttttcccctgccctgttttctttttgttttcagtttggatactttccatttaaccatctttaagttttttgatgctttccaatgttaacctgttaaacttgtttattgaattctccatttaaaaatttttatttttagttatttatggatacatagttgtactgaattattcatttctaatatttttatttctagcatttcattatatttgtatagttacaattttctgctgaaatttcctatttcttcatgcatgttttccacattttccattctactttttagcattttaatcagttattttattgggttttttctgttttttctttcatttttaatcagttattttaaggatccaaactgataattcaacatctgggtcttttctagttctgcttctattgagcccttcctctcccttaccatgaatcttattttcttgcttttgcacgtcttgtatatttgattggatgatggacgttttatgttgaaaaaaaaaagaaattgaagaaaatgtttacttccaaaacagagcatgccctttgtttttttttcaggccacttgaatggtggctcaatctgatgtatatgaattctagactggggcttcactgcagttttagtttgattcagtttgcctctagcttcaaatatttgaaggaacgtagaatcagaactctcatatcaccagggcctgagttttgggcattggcaagattccagagatctgactttgcttcatagctaagccaccagcttttatcaatgtgggagatctttccctactttacaaccttgctgccaggatttttttttttaatcaatgggctggggataggaggatctttctcagctctcatgtgtgccctgcccttttgtagaggaatgcccacaatgcctaggggatgggtttctcagcatttctgaccccatttaggctccaagagtgcctctgttggatttcacaacaatcctgcctcccctttcatttttaaagggtattttgcccttgggagaagtcaagctctctcagcgttccttctattatccacacctttagtgtactacaccttcctgtacctggttatcatctaaggggtaagattggtgggaagccttcctctgtggatttgggtcatctaggttctaatgtcaaaccagcctccaaggggttgtgaaaatgttgttaaatttcagcaggtttctcttttctcccccctgtagtattcctcttcctaccatagttcaactaggaataacaacagctagggggtctcttctctcctatgaaggacttggcactttctggagtttggatcatttaggtttctttggtttttgtttttattttgagacagggtctcactcttacccagcctggagtacagcctgtagtgatctcagctcactacaacctctgccttcctggctcagttgatcctcccacctcagcctcctgagcagctgggactacaggcgtgtaccaccacacccggctaatttttgtattttttgttgagatagggttttaccatgttgcccaggctgatctcaaacttctgagctcaagcgatctgcctgcctcagcaccccaaagtcctggggttacaggcataaaccactgcacccaacctagatttctttgtgtccttagctttctgatgaattaaacatatgttttattttctagctcatctggccttttgttgttgtttgctagagtgggaggtatattccttgtgactttgttcatatcactagtgaatttcagaagtaggagtttatttttttaataaaaaatttttttaggtcaggcacagtgtctcatgcctgtaatcccagcactttgggaggccgaggcaggtggatcacctgagatcaggagtttgagaccagcctggccaacatagtgaaaccccaactctactaaaaatactaaaattagccaggtgtggtggtgggcgcctgtaatcccagctacttgagagactgagtcaggagatttgcttgaacctgggaggcggaggttgcagtgagccgagattgtgccactgcactccagcctgggtgacagagcaagactccctctcaaaaaaaaaaaaaaaaatttttttttaaacacgtctcactgccacccaggcttgagtgccatgacatgatcatagctcactgctggcttgaccttctgggctcaagtgatcctcttgcctcagcctcttgagtagctgggaccacagtcatgtgccaccatgcctggcttttttttttttgtagagtttgggtctcgctatgttgcctgtgatcctcccaccttggttttccaaagtgctgggattaaaggcatgagccaccatgcctggttaggaatgggagtttaaacaatggttttatttacatatttcattagctagtatttttttcttttttgagacagagtctggctctgttgcccaggctggagtgcagtggcacgatctaggctcattgcaacctctgcctcgtgattctcgtgactcagcctcctgagtagctgggattacaggcgcccgccaccacacccagctaatttttgtatttttagtagagacagggtttcaccatgttggccaggttggtctccaactcctgacctcagttgatccacccgcctcagcctcccaaagtgctgggattacaggtgtgagccatcgctcctggcctcattaactgttttcaaaagtaaaagtacatggataatacaaagttaaattttgtagaatcataaagaaaagcaacaccttcccatcttaactcccctagtgcctctactccctccacagagacaaatatcttaccagttggttgtgttttcttttccaaactgtatttctaaaatgtgtcaatatctcttccttttattttttattttttgtagagacaggggtctcactgtgctgcctaggctggtctcaaactcctggcctcctacctcgacttctcatagttctggcgtgagctactgcacctggcctcccccttattatttttttaaacatgaatggaagcatactatattttctacactttatttgttttatgtaactattttaacaacctgaggacttttacaggctgcataatatgtcttaatatggatgtatcttagtttatttaaacagttactggtgatggacatttccatgtttccagtattttttctcacaaacaatgcagtattatgcctttgtccacattcaccattgattgctattgagtatatctgtagcatcaagaataggcatactgaaaatcctccatgaagtccagtgaagcttcatattattttgaagtgatatttcccagtgttggctggactctcaagcgtttgtggtataggttttgggaggactggacacttccaaagagaaataagatgttacagacttgtccagcaggtggcatcagaacaaagctggctatggaccttgtcagtacaaatgataaaacattaaaaatgtaaaaactcaactgtagctccttgtttatacatatattgggggtgttgaaaagttaccgatgcctgattcctcttctatgtcctcagcccccaccataaaaatagataaatgccattttttttgtatgcccagcacagctatatgatttgaataatcttgataagcagggtcacatttgaggagatttgctaagggaaatgaagatccatctgtgacacaagaaacatgttctatgtgatttctgggattttcctgtgaacatacttcttgtttgtttgttttacagtggatctcactctgtcacccaggctggagttcagtggtgcaatcatagctcactgcaaccttgagctcctgggctcaggagagcctctctcctcagtctcccaagtagctaggactacagacacatgccatcatgccaggctcattttaaaattttttgtagagacgggtctcactatgttgctcaggctggtattgaactcctgggctcaagcaatcctcctgcctcagcatctcaaagtgttgggattacaggtgtgaaccatagtatccaacctattatgtttttttaaaaagagattgttctaattatgtatataattaaagtacattaggtttagtgattgcaatttgagaaaccaatgtcctttcttattgaaaaaggccctggtacagaaagtgttctatcttcctcacaagatctgaggtcaaaggagagattttgaaacattatagcaatggcttctagttattgaataaagaatgtcatttgctcctcacaggacccctttcagggagatttcacatattgggaaacagcctcatgagctttctacaaacatctttgtccttaagtcttcccatttcagtaattggctgtaccactcatccagcagctttcaaagtaagaaacctggcaatcttcctttaacatccatttccctttccctcattcccccatatccaatcatgtgtattggaggtttttccacctctaaacttgagaacccatttactttttctccatctcctttgccatcacactagtccaagtgaagtgtttcatcatctcatttgcagcatcctttagtttaccctagattatcaatttttgtccccctcccaattcagtctctactcatgagctaacatgagtttattaagtgttcattctgaccatgccattccttgctcaaaattctctagtgccttcccaatgcccttaaaataaaattcctcatatggcctttgtggatctgcactcctacctcttctcctattgcaaccaaccctgttacctttttctcttttcacactggtcttcattctgtgctgcaaactggctgagattcttccatcctcagggcctttgcacaagttcttcctttgccttagaattctttcctggcctgcacatgtcttcatcccctttccctaagctaatgccttaccctttaggtctcattttaaacatctcttacccaggaaaaatttccctgtccaaacaagtctagattggctccccattgtttgttctaactgttctatatttctccttcttagcatttatcacaattcttggtatgttgtgcttttcactttcttagtcgctattattggagtaggtaatacatccatatagtacaaaattcaaaatgtattaaaggtatagagtaaaaagtcttctcttccctgtccccccgctacccagttctcctctttagaaccacttttagcattttgaatatccttccagaaatattttctaagtatacaagcaattatgtatataatattcctctttatttttgcctttttattaatacagatactatatgcattttctgcactttatctgttaataatatatcttggcaattattcaatattaatatgtaaatagttgcctctttctttttcatgcgccatataatatggacttataatttatttaacctctatctaggttggttttaggcattggttattacaaataatgctgcattgaatacctttgtatgtaaagtcatttcccacatctatgcctatagaataaattactagaattgaaataattcagttaaagattatgtgcatttttaattttggtagttattgccaaactgctctcaatggaagttttatgaattcccactagtgaatgcatttgtcctcacaattatgtcagtgaaatttttgttctttgccaatgcaagaaatggaaagtatctcttggaaactaatttgcatgttttttttccttgcacagttatattttcatatgttaaagagccatttgtatttcttggtgaattgttcataaactttgcttacttattatctaatgtctgactaatttgctacactctaaattcccaattcatacttaagtctcgcccttgcaatttagatgtacaatctgcctcttcagtggtttccacaccaaaaaatccacaggctcctgaattttatatgggcctaagagtcttactgaaaattggaagtcttaaggtgtagtctattttatgcagtgtgaggcctttcatgctctgaaatgtaccactcttgactgactttttcttcttcaccctgtccggcactgtgcccttattagccagagaaatgttccccctttctcccaggaaacgttctgaccttaccctggtccctcaaggactctccttctcccccaaattaactttcaaggagtttctccaacccaaaatggcacccttcctgaaaagatttctagtggatactgttttctgtacctcactacggatgtattttgctgcttggctccccgtctccattttgctatggcaaacatttttttccagaaatatatcagataaaatgaacatgtggtcccttttgttgatttttgttgggatccatggtattgatttcttctagtttagataattccaccgtggcaagcttttattcctagcatagcgctcatgaggagaatgttagtcacttggtgttattaatgctaaaatagtaaacaagaacacaaaatttgctagattagaagtggattttttttccaggctgggcacagtggctcatgcctgtaatcccagcagtttgggaggctgaggcaggcagattgctttgagctcacgaattcgagaccagcctgggcaacatggagaaaccccgtctgtactggggctaattttaccaaaaaaactagccaggtgtggtggcacacacctgtggtcccagctactggggaggctgaggtggaaggatggcttgagcctgggaggcagaggttgcagtgagcctagttagtgccattgcactccagcctgggtgacatgtctcaaaaaaaaaaaaaaaaaaaaaaggtaaggaatgaattaacatgaatgaaaaaggcatgatctgcagtcagtcacccatggtcaaagatagcagataccaattcattctcagagcgaaacgaaatcagcccaatgcttttggcaaactgtggttgcctccctgtcatcatcatctgggctcactgtggctcgcccttctggccttgcttctgaccttgccatctctggggaggcttctttgcaagcccaagcttgggctccccttctcagaaccatgtgcatacttgtcctggaactgtttttttttttttttttttttttttttttttttttttgcctgtgcctcttggagggcaggggccatctggcacaaacctgcatccccgcagttgctaaattaatgaacaaacaaataccaagtctttcacaatgtaacttgagagtggaggtagtggtagtggcaactccatctgggggatgagagaaggtggaggctgagttttggggatggcttgcaacagaagaggagagattattagcagctaaaggagtggccagggtgaacaccaagcattttcctgactggggagctgtgggtttgtttatggctgggtaaggggtgaaaccagtgagcaggagagatagctagtactggactggagtgaaaggcatctgtagaggcaggagacaggatggggaggtagaggagttggcctaggacaggacagcacttatttgaagactggtgggcaggaggaaaggaaggagagggattgagaaatgacctggaggtcctcagtcagctgggagaagacctggaagagggggattggctgctgttgggatggagaggagggccaggggaggcagtgactcacacggagggaggctcggggatggggactttggcagtggggggtgggaaagacatactcgcaggggatcggaaggccccgtggcaactttgtgtaagtcctggttcagtcaaggagaggaatccgagggaaatgcctgattggacccatggcccactctgagagaaaggggtactgtgggtgtgcaggaggaagagcagctgggaagtaggagtgcctaggactggatccaactggaaagggggcagatatgctcccaggatcagggtagggaccctctaggaagggggcgttctgagagggaggttgtggggagcactgtatgggggtccttggaggtgatttctgggaaggggaagtctggggcagggctgtgaggagtcaggaaagaaactgtggagtccgttcctcacccacctcctgagccctggggtctgaggcccccaggaaagagggttcagtggcacaggagggtccagggcaggagagagaaagcagcctctcaggtcttcttggaaaggaactctgaccaccagtgtgaatagtcttgcagaaagctaagcggacaccaagtgaaagctggcccctcccctctcccagagtgggaggggccagcggttgcatgggcagctttccttgtgatgccacagtcctctggacacactgctgccttgccacacctcctttccctttcatctttctcatcaaccaatgggcttggcagcattgaggccatgcccctattctgtgttctagtgtggccctggttatccctcctctgactcagttgcacagctacctggcaggtgaccggaggtgtttagcagtcttgcctggattgcgctgatgtggccccaaccccgcctccctccccacaccaccatgtaggaagaaactcaacagagcaaattggctgcagccaagaaaaaggtaaaaaccaccaggtcatagcccctgacccacctgcagacttcctctgacggcaggactactgccagagtctgtgccactcctgaggcacaccgggttaggcccccctggtgcctctgcactccccctaccaaaatattgttagccagcgctgttccctcagcagcccagcccctgccctcaacagtcaccccagggtgactactggggcaggtgactcctggggctccctgctccagactaggccctgacctcctgccccctcccaagcctgacctccctgggctctttggcctggcatctccaaggactaagacaaccacttctggtggttgccactcacctggggatgtgagttttggctggccaggctcctggggacagggggcccaaggggcagtagagggtaattgttaagattgctgggtactggttaaaaattctgggtttgaatcctgcctctctgtctgctggggatatgatttagggcaagttacttgagctctttgggcctctcttttcatatctgtataatagaggtggtattgtttgacttccatttgtgaagtttaaatgaaatttgttgttgtttttatgtgaatccctagtacatagcctgctgtaaacacacaggacacccaggaaatggtcattgctgtttgattttcctcgccccagtctcaaggggaagccaggccaatgagaaaagccacttgccatcagcctatccctttagaagtcactgaaagggccccacgtgtggtgtaagagaagatcttacttgccaccagcttgctgggtgaccacagaaaaatcactatttcccctgagcctcagttttctcctctataacatgatactggataagatcagtgtctttcaaacttgtttttcacctggagtcaccttagctcaactgaacccttactcagaagtctggttttttttttaacagaagtggaggtctggagctctaccacattcatcgcccatgtcctgggcctgaggagaggggtccagtgagcgtattgagaggtgcattggtcagctgactccactctgtgactgcgtcactcaggggacttttccatctatttgttcctgcccctggcaaggcagcaggtggccatttggaagaatggcacaggccatggttttaatctcctctgctcttcttcagcgtttcctttccctgaatccacatctttctcctaccctgactttcttgcttctctctaagccacttctgtctttctccccctgcccttgtttttcccttttcatctcctgtagattcaggacattccgaaggtgctggtgtccaaccttaactactccaatggggtagcactcctcgactggacaagtggaaggtgaggcagtgcccagacccctctctggcttgctgtctccagctatgcatgttcctgaggcttctctggtttgggggatactttgcctctggcttattttatgttgctgccattaaccttcagcctgtttatgtctgcttcttcacttgcttgattgattgagtttttttcctttccagcatcttttatcatcttggaaatggtgagacataccttaaagtttaaaagtaatttgggaataatgtacaaagcaggaatatgggatttggggctttttttttttttttgagacagagtctcactctgtcacccagactggagtgcagtggtgtggcacaatctctgctcactgcaacctctgcctcccaggttcaagcgattctcttgccttagcctcctcagtagctggcattacagacacctgccaccatgcccagctaatctttgtatttttagtagagacgaggtttcaccatgttggacagactggtcttgaactccttacctcaagtgatccaccagcctcagcctcccaaagtgctggagttacatgcgcaagccaccgtgcccagtcccttgctgtttttatactttctctatatccataactgtttcccatggaagtttttgtttctttgaatttctcatttttattacccctgcatcatctgctaccctaaaggatctggaggtaagaggccctaggctgaggtgcagtgaccctgcaggccagccctccaacctcctctcacagtgggggctgggtgcccctctgccagctgagacagcccacacacaccccagccctaatgattgttctctctacctctccctgcagtcctcctccaactcctcctctctgtatgcacctcagagccggtaccaagaactagcagtagccctggacttgagctctgcaacaatcagtcaactcattgaaaacatagtcattggtaagagtccagtagagtcccctgattccactctgccaatcctgggctccagtttccccttggggccctgaataaaggggctgggggcccctggtgccaaggacaaatggagagctggggtgcccatgcctcacctagagggaccccagagcaaggagcatgcagcatggctcttccattgctgccctctttgctgactctctcttcttcaggtacccctgctccagtccttgccacacacgccctggggttgtcacctctcagggaagcgctagcctgattggttgtcaggggccccatatttctgccctgactcagtctctaatttgcccttgagtctggacaagccacctctcctccttgggcttgtgtttccagaggaggtagagagtatcaaaggtctctgttagctctgagagtctgagatttaaagtcccctagaatggaaacctcagggcgaaggcctcctgtctgtccttttctgtcctgtatctctgttgtgaagaactgtacctggcctgtgtgtgctcagtaaatgttcattgaatgaacgcacctttctaaatcacaagctggcagaagggtgggcctttctcagactccgtctctggaggtttatgttactgtccttttgagagaatccagattcagactttgagttctgtggctgtgggcaaaaaccaacaaagacccacatcctgtgtccttgggagcttgaggagagttgaccagtttgtgttgccattgggtctgagaactttgcctttaaaatccattcctggcccctgcctaccgcttcctggtctggggaatagagctgagggggccaccctcagtcacctgaatttgactctccccacagaaacagcagaagaaacaagtggaacatcagctggaagaagtaacatgatttctttctttgctcacgacataaatgctgggtttgggggacaatcagatgtagaggtgccagtctcgtgtcgcccacttccagcctggggaagaaggctcacccctcagattccaccccatcctcccaggttatcccgataacctggtcccatgggtgggcctgtcctggggcattggtggcattctgggggcatgtctcttgctgtgccatctctgcctccccctggtaagagctctgtcttcctcttcctgtaggaaaagaaaaccaacaatgaaatacacaaagcacaaatggagcagttagaggtgagtggagggtggggagttttctcctgtcctctggagaatgtttctttccttctctttcagcacttgcttggcttttctcccaaaggttcaattccagacaatcaacatcctcatgttggaaaaagcagacttgaagaccaccctttaccatactaaacgtgctgcccggcactttgaaggtgggaatctgggcaccccatcatccttcaacctggcactttgacaggtctttagggggagtcctttgggccccatctcaacctctttcattacagcagaatctaaggatctggccagccacctgcaatattccttgcagtgtattggagagttggagtgggctctctgtgctgtgtctccatgcagcagcaggaggaggacagggtgagtccaaccagctgccccatcccctggcagcctggcttcccagatagaggagtgagcctaaaggtcccttctgcaggatggagtgtcctgcccagaaggcagcatggtcatttctcgctgcttttgtgtatggttgttagaggcagcctggggctgagtcagctgctgtgggtgagttggggggcactgtggggagcgagcactggatgcagagctcagaggccacacagcagctccagaactggatggtgaagatgagaagtttatatctggggagcccaggccattctacacagtgccccttaaaagggcaaggggtaggctcaatatacaactcggtcggtaaagatcaagtcatttccaagcctgtggtctggtttttaaaagaactgttccacacagtcctgaaacaggagaggctgcgggagcaggaggagaggctgcgggagtaggaggagagactgctggagcaggagagactgctggagcaggaggggctgcaggaacagggggagaggctgagaaagcaggaggagaggctgctacagaaggagaggctgctggagcaggaggagaggctgcaaaggcaggaggagaggctgagggaagaggaagagaggctgtgggagcaggagcagaggctgagggagcaggaggagaggctgctggaactggagcagaaagccaagctctgggacgagcaggcagagacacacatgcaaaccatgcggaatgactgcaccaccatcagccacatgctctcgcagaaccacgagcttgataagcagctgggcgagccacagtacgacttccaggagctggtgggttgccccacctggggagcctgccttcctccctagccctccaggcctttgtttccccacctgtaaaatgggcatatgtagccctcacgtgaaatggtacttctaaaggaacctgtgagccagagccctgctctgatggctgtgagagagagggaatgatttttctaacttgcctccacccttcccggtgacatgggaggcagacatcaagttctggggtctccagctgcagtgggtgaccgctgattgcttctctttgtccagaacaaagagagcaagggcgcactgcagttggagcagcaagtaaagttgctgcaggagaagctgggtgacctgaaggagacggtaacctccgccccatccaagaagggctgggaggcgggcaccagtctctggagaagggaagtgtgaggccaaaggcagctccagcctggaggcaggtgacgccagcacccttcagggcagtcctgtgactgtttcttgcttcctgccctctgacttttagaggtaggtagccctgggctcctcccaggtctggacatcatcatcccagctagaggcatggagcccccaatcataggggaagagacagtggtataagaggctcctttgctgggggcagtagctcacgcctataatcccagcactttgggaggctgaggcagtagaatcacttgaggtcaggagtttgagaccagcctggccaacgtggtgaaacctcatctctactaaaattacaacaacaacaaaaaaaaattagccaggcatggtggcgcatgcctgtaatcccagctactcaggaggctgaggcacgagaatcgcttgagcccacgtggtggaggttgcagtgagctgagattgcaccactgcactccagcctgggccacagagtgacactgtctcaaaacaaaacaataaagcctccttagattcaaactggattctggcctgggttcctctggtcaccgttcaactacttttcatctctaagtctctgtttctttaacttcaaaaggaagttagcattttccttgcagaggtgctgaggattgaatgagagaatacctggaaagcattaggcatgtagcacacttagcagatggtggttggctccctctgcttttccaccagtctgtggcctacagtttaaatggtgggaagaaggacatgagatttgaggctgaggaaggaggcatggagttctaggcaagggaggaattctctaaggcctggagcaagcggccaggggcctgggcaggtgacagagccccacggtgccctcgctaccctattaatgggcccagaatctggaagccagccaccatgtgccctcacgcccagggtcttcctgcaagtggagctgaagagccaagagtctcagagtctgcagcagcagcgagactagtacctgggtcacctgcagcagtacgtggccacctgtcagcagctgacctctgagaaggaggcgctgcacaggcagttactgctgcagacccagctcgtggaccagctgcagcagcaggaagcttggggcaaaccgatggctgagatggcccaccaaaaactgcaggagactcaggggagggagttgctgaggacggggccccaagagggatgacctgcatcttctgtgccttctcactctctttcctggccccttaggagtgcctagaagctgccagccagcagaaacagcagctagaggcccagttgagcctcatggctctccctggagaaagtacaggagatcacttagaggaagaagagagagccccaggaggaaggaggggggattgttagcagcataggactgaggagttggaacagacctttagaacagctagtcattatgccgaccgggtgtctgcactaagtttggtatcaatatggtgacctcctggggagcagggggccaccaggttgcctaaggatgggtgaactggcccagatcagaaagggagcaggtcagaactcccacactgactggtagtgggactgtgcctgggaaatataacaagatcttggttcttaaaagtaaaaataaaagtaaaaaaatagtaaaaaaaaaaaaaaaaaaaaaaaaaagaacagcagctcatttccctctggggaggggctggctcagggttacacagtgagggtgggggcagaggtggccccacagtacctcccttgttgggttgtctgaagacccctttggccaaaccctacagatggaggaggacatctggacagtgaggaggaggaggtgccttagccccttccgagcatcctggaggacctggagagccgggaggccatggtgagctgactccccctgcacctcctttgccaccttcctctgtggtccctcccagacccccttatgctcttcatctccccaccgtctgatttctctggaccctcaccccttccgggagccagtgatcagacaccatttcacctgtgaccaacaggtgcactctctgaggccccaagggaaggggctgcactccaccaccctgccctgtttgttctgtgtatgcccctacaagaagggcatcagggtggccaggccatgcagccaggctccagacatccccaggatctcagcccctccaagggtacctggaacattgaggcacagggagaagcaactggccagaacacacatccagctccccacatgctctagagggtttcaggtctctgcctctcgggaccttgggctcccccgattcagcctcgtcttagttctgactctagtacccataatttgcctccatttcccaatccagaaattggaaaggaacatctccatgtcccttgcttgaagacctggccagagctggtgccaggctacagatgcctggcaggaggcaagaagggcacactcactttccctttgtcctgggaggcccacataccaacattgccaccactgctgccacctggaagcacaaccaaactagacacaggaaaaggggaagggttgagtgaacctgggacactgcaccccaactttaatgtgttgttggattcaatttgctaatattttgtggaggatttttgcatcaatattcatcagtgatattggcctgtagttctctgttttggatgtatctttggttttagtatcaaggtaatactagccttgtagaatgagtttggaatagtttgggtaaggtctctagttttggaatagtttgagtaaggttgatatgagtttttctttaaacgtttggtagaattcagcagtgaagcaccaggtcccaggcttttctttgctgggagactttttattaccatttcgatctcattgtttgtcactcgtctgttcaggttttggatttcatcatggttcaatcttgataggctggatgtgtctagaaattgatccatttttagttggttttcctatttctttgtatatagttgcttataatagccactagtgatcctttgaatttttgcagtatcagttgtaatgtttccttcttcatctttgattttattcacttgggtcttctctttttcttaggctaaaagtttgtcaatgttgtttatcttttccaaaaaccaactattcttttcattgatgctttgttttcttcatttcaatttcatttatttctgctctgatctttattatttcttttcttctagtaattttgcatttgctttgctcttgcttttctatttctttaaggtgcattgttaagttgtttatttgatgcttttcaactttttaaaagtgggtgtttatagccataaagttccctcttagtactgcttttgtcgtatcccataggttctggcatgttgtgtttccattatcatttaagaaatgtttcaatttccttcttaatttcttcattgacccactcgtcattccagagcatattatttgatctccatgtgtttgtatagtttccaacatttctgttgttactaatttctagttttagtccattgtgatcagagaagatgtttgatattatttcactcttttgtaatgttttaagacctgttgtttgacctaagatatggtgtatccttgagaatgatccatatgctgaggaaaaaaatatgtattctgtagcccaagggagaagacacctgcccccactctgctgcaacacacagcgctctgctcagggatggggcagtggagtgctgttgttacacaaggggctctctgtcggggagggaacagaaatctgttctgtagtgtttgccatttttggtggtgcaaatattccatggctgatttcaaactgccaccgtcttctcagcctgggcttgtttgtacccacccttgggaaggctatccaagtatttgaaaggatgtgggtgttgtgatctaaagtgtatctttattagatacactccagcccagttatgctatggttcttgcagactcatagaggaactgccttgttggtctcagataagatctggaagaattctctgggctaccaggtagtagagacccttattctgtacctgtagtttctctccaaaaaacagtctctctctctccctctctctctctctctctctctgctgagccacttggagctgggtgtgggctgacacaacatccctatggccaccaccaccactgggactgcactgggtcagacctaaagccagcaaagcactgggtctcactcagggcccgctgtcaacactacctggctgtcgcctatgttcactcaaagccaagtaactggggctctacagtcagcaggtggcaaagccagcctggcttatgtctttcccttcagggcaacgagttctctcaggccctggtgggtccagagatgctgtctgggagtcagggactacagtcaaaaaccttagaaacttacctggtgctttattctaaggcggctgggctgacactgaaaccatgagacaaagtccttcccactctgcctttcccttttcacaggcagaggagcctcaccctgtggccaccaccacaggcccacagggagtgctgccaggctactgtcgatgttcacttagggcccaagggctcttaagtcacttgtggtgaatgcttccaggcctggggctcacccttcagggcagtgggcccccctctgtctcagggcaggcccagaaatgctgtttaagagccaaggcctaaaatcagtgaccacaagagcccatttagtgctctaccccattgtggccaggcaggtacctaagctgcaagacaaagtcccttttacctttccctctgcttttctcaagcagaagaaatctctcaccacagccaccaaagctgtgaatgtgctgggtctcacctgaagccagcatgtcgcagagccttactccaggcctatagcacattacctgggtatcactgttggctattcagggcccaagggctcttgagtcagcaggtgatgaatcctgccaggactagaatcttttctttaaagcagcagattcccttctggcccagggtgtatctagaaaggtaattcaggagctaggtcctggaatgggggtctctcaactctgactggggctgtatcctactgtggctatccaagacgtaagacaaagtcctctttactcttccccctcctctcctcaagcaaaaggaaagagccacttttgttgctgcaagctgcactgcctggggttgggggaggggtggtacaaacactcccttggctgtcctggctggtgtctctctaggtcgtgtgcctcttgagtccactggctctgagcccagcatggcattaggatgtgcctaggagttgaagtccttatggactagactgctttcaagtttatttaggaccctggggcataatagcctgccatgccaaggcttgtcaaaacccaagcctcaagcctcctaactactgggatgggtgaacccctctgggtagggctggtctaaatgctccctccatgggcaggtgtcacgtgagttccacctggtttcgctttctgctgtgacagggcagcactgagttcaaggcagagtcccacagttgctgcattctccctcccccaggtgcacagattctcagcaccacagcgaccactgctgggggagggggaggggtgatattggtgtttcaaggctgtctctcctaccttttcagtgcctctttcagcgacatgaagttaaacccaggtactgtgagtcctcgcctaatttttggttcttatgatgatggttttctggtggaaacagttgttaaatttgattttcctgcagggggaatgattggtagagactactattcagccatcttgctctgctcctcctccctcccttcactttaattacctcctaatagccctatttttaaatacaatcatatagggggttagggctccaagtatgaattttgaggagacacaattcagtctatagcatttggacttgggaagagggaggaaaagaacacgcacaggaaagtcacagtgtaagcaacagtatggaggtgggaaagttcagctcatggataggaaaaattgatccaagttggcagggcccacagggagatgtggtggggtggtgagtggcggccacatcaaaagaaccttgaatgccaggctgaggtgggaggcatttcctgttgtgtggaatgtgccatgaggtggtggggagggtaacgtgatgaaaggacatttgggaggatggatctggcatcagtgatgggtgggggtaaggagtgaacaaagctggaggccaggaaaccggacacatggcccagagttcaggcataggctgttcaaaggcagtttccacactgagttccaatgtggatccaagcatgcagcggatatatttggaaaagcaaaagcattcccttcccattaccacacagtttcccagctgagttcatcaccagagtcctacacatcagacagtcaacctgccccaaactctgtccctagaagctgtggcccagagggagcccttgtccagctgtagcccggggacgctgcagcctgagcaggactgcacctgttccctcccaggagcctcatctctgtccggcctggctttggcttcagatgccctcagctttggcttcgaaatctgttgggtcagattcacgagagctctggccttctttgggttgggaattttaaatagttttttcaagcaggcagtagatcaactctacttgcttacttctgggtgcatctcctgttccccggccccagatcttctttttccttggtttatcctctcattgtgttgcagcacatcttccagtggcttccagagaaacagtgaatggaagccaagctttctgaccctcacatattttagaatgtcattgttctaccccaattcctgattactagtttggctggatgtaatgctctaatttaaacataacttctcttcacattgggaaatattgctctattattttctagttcccagtgttgttgggaagaagtcagtgtcatgcggagtcttggctctttacatatgacctgtcttttctctctggaagattttaggattttctatctttgggttcttggaatttctcagtgatgtaccttgttataggtctttctacctatactgtgctagtcacttggtagactcttgaactagaaaattatgtgcttctgtggggggaagccaccagcatgtttgggtcctggtttgggtcccaatggggcacatgtgggaaagaccatgaatgcccatgtctccgactagtttccccatcagaagtgttgttgcaccaatcatcctcctccattaaaactggacagactaagggccactttcctaatggatgggtcttcttggttcatctcatgctcccaacagagctccctcccggggatgggaacgcgccatgccaggagagccctcttgatccagcctccagccaaagccagtccccctgccaaacaggccctagagttacactggagggtgacaggcctaacctggaaatttcttgctgaaaattgtcagtttcccacacaagtacagcctggcagttaattcaaattcaaaccagaagactgctgcttcagtctcgactgcttgaaaattaggttgtgtagagctttcatttgctggaaattgtgcagccagacattgtgcagattgacccagtagctacagcaagtacacacatagggcgccaagcaaggacaagtgtgcacatgtgcgcacgcacacacacacacagcagaaaatctagaaataaactattttaatgtcagctgtcatggaagttttgtgtcatttccccaaaaaaacacaaattttattttatgatttagtctagtatttatttagaattacttaaggaaaaggagacgtgagtgcagtggctcatatctgtaatcctagcactttgggaggctgaggcaggaggatcacttgagcctgggagttcaagaccagcctgggcaacatgatgaaacgccatctctataaaaaatatgaaaattagccagatgtggtagcatgtgcctgtggtcccagctacccaggagactgaggtgggaggatcccttgggcccgggaggcggaggttgcagtgagccaagatcacatcactgcattgcagcctgggtgacagagtgagatcccatctcaaaaacaaagagaaagaaagaagaagacagagaaagagaagagaaaagaaaaagaagagaggagaaaagaaagaagagaaaagagaggaaagaagagataagagaggagagaaaagaggggaggggagggaaggggagaggggaggagagaaggggaaaggagcaatgggatcctgatatctggtatgggaaaacttaagtggatacatctgagaactttgaacctccagtttccactaaatgctctgatctaaaagaagaaatgctctttccttgctaagagaagggcagctgccccttgcctggaaactaggcaaagagcctccaacaaggccttacagcaggatgaagtgtgtcgtcattgctgccccacattgacaccaggctatggtcattcctcatcatggcctaaggtcacaagcacaatctgctctgggagaataatatttttgccaaaaatgtcacaaagtatgtactggcagaatctgagagaggaggtggaggagtggacataagggtgttggaccagggggagactaaaggctgtatacacgagaatacagtgacctgggagcactctcaggatttaatggcttggcaaagacacctggggctccaacacactgctgagtggctccttgaaatgtggacagaacagttgcttcagtgaattaggaggagattatagaactgcattcgcaaagcatcaaagaagcaggaaagtacagggaggtaggaatgttggaatggttcattatatgccagcagattcggaatccaccacttgactgtgtgcccttggagggctcacaggaactcccctctctaggctaacaaggaaggcactagtgagaagggcacctgaatctttaagagactcagtggcactatccttggtaggccaggatcgacaagaggagatgctgccatgagaccaggcttcgtggtgtcagtgggaacggtggaaggtgagaacagcggatgccaggtggtggcccttcaccatcatccacaaggtggatgtaattaacttaattggtaggaaggctagagtgacagccaggatgccttgacctccagggagctgttgtgttagctacaaactgatggcattccaggggagagttacataggcagttgattagggtattttgggtttttttgagacaggatcttactctgtagcccagtctggagtgcagtggcacaatcatagctctctgcagcctcaacctcctgggctcaagcgatcctcccacctcagcctcccaggtagctgggattacaggcatgcaccaccatgcctggctatatttttttctaatttttagtgaagatgaggtcttgctatgttgcctagactggtctcaaactcctgagctcaagcaatcctcctgccttggactcccaaattgttgggattacaggtgtgagccctaggatatttcctgatttgtgtattcaggaaacaacaacaacaagatctggcacatggaaggctgcaacaaaaaattacaatttcctagccagttttcagactgagacaattgagacctatagctcatggattgtaggggaggctgggtattcttggaaaaagatcctgcaacattaccacatggtattcattaattattctccaaagggatctggggtcattgatgaaagtaactgtagctgatgaaaagggaatacccagactgtttgagggccatttatataggattagagctgaccctgacaccataagatccacaatgccaccatgtcccctccccaacaagactgaggacatgtgaaatctaggtaataaatggatccctggatgaagaggccacagccccatccggttgtcatttctctgtccctaaatatgcaattgatatgagtatgcttagaagctaacagagctctcactttactccctgacctgtgggtatgagccactatagtaggaagagcccaggggaagtctctgaaactacctcttcccacttccgggagcaatgcagtattccaggtggaatcacagagatttatcacctccctcaactgtgaccgccaccttataatgatggtattcttacatttccccacctgtcccttgtgccattctcatcatcattttacttccacacgttataaaccccacaatgttattacttttgcctcagtcaattatttctagacatcaaaaaatgagaaaataggatcttttctatttatccatgtatttattatgtcagtggtcttcattcctttgtgtagaaccaaatttctatccagtgtcatttttcttctgaccaaagaactgcttttaacacttcacagagtgcaggcctgctggtgattatcctggcttttgtctgtgtgaaaaagtctttattttgtcttcattaaattttttaaaaattttttattctgttttttgttttttgttttttgtagagatgaggcctcactgtgttgcccaggctggtctcaaactcctggcctcaggcaatcctcctgcctctgcctctcaaagtgctgggatgattacaggcatgaactaccacacctggcctcactgactttttaaaactgcttttaatcccttatctgcagagttaactttttcatgtccagtaattcttttttgttttattttgagacaaggtctcactgtgttgccaaggctgcagtccagtggcacaatcacagctcactgcaacctcgacctcctgtgttcaggtgatcctcctgcctcagcctcgtgagtagctgggactacaggttcatgccaccatgcctggctaatttttaaattatttatagagatatctcttcttatgttgcccaggctggtcttaaactcctgggctcaagcaatccttgtgtctaagcctcccaaagcactgggattacaggtgtgagccaccacacccagcctgtgttttttttttttttaatacatcttccatttctctcttctcatcatgttcagatttttctagccttcttgaacatatggagcatatttataatatgttttttaatgtctttatctgctaattacatcatctttgtcatttctgggcctatttccattgatttatttctctcctggttataggccctattttgcctgtgtttttcttttgttttgtttgtttgtttgtttgtttgtttttggagacagggtcttactctgtcacccaggctggagttcagtgatgtgatctcgcctcactgcaatctccatctcccaggttcaagtgattctcgtgtctcagcctcccaagtagctgggactacagttgcataccaccacgcctggctaatttttgtatttttagtggagacagcatttagccatgttggccaggctggccttgaactcctggccttaggcaatctgcacgccttggcctcccaaagtgttgggattacaggcatgagccactgtgcctggccattgcctggtaattttttattgactgtgtttttgtgttgtgactgctggattttgttttgctttaaatagtgtgggactgtgttccagcactagttaagttatttgaaataagttggatctacaaaggtttgctttcaatctttgttaggacagtttcagagaagtctttactccagtgctcatttagccccactattaaggcaatagttttttaaagcttctcttccatttcctaagtattatgaggtattttcattctgactagtgagaatatgaattctctctagcctgttgtgagctctggggattcttctgtctgctttctggcagttctttccctgggtactttcttctcacatatgtccctatcagccctttgccaaaggcttgagggcatcttccatagctctccagagttcacgcgctctcttctcccacctcctccctggtactctacctcacaaattctaccggccttgaagatcttcccaagctctgatctctgtctcctcaatccaccaagaccaccggactttggattcccctccctgtgttggagcctgtaattgcttccggcagtaaaccgaggacactctagggttcaccttcttttagggatcatagttctgctcgacctgttctccgatgtctgaaaactattgttttatattttgttccatttttctagttattaaaggtgggaggcaaatctggtccctgttatcagtcatggccacatgtagaggttgcaggatgttgtttacatctgtatctttttttttttttttgagacaggatctcactctgtcaccccaagtggcaccatctcggctcactgccacctccactttgtggcctcaaatgatcctcccacctcagcttcccaaagtgctgggattacaggtgtgagccactgtgcctggcctgaaactgtatctttcttattaccagagaagttaaacattttttcctgtgtgtcagcagcatttgtgtttctttttctttgaattttcatttttccagtttgaactttccatttttcttagaatttttggtctttgtcttctctacttttagaatagaatgaatatgatattaatcatacttcgaattgtggccatgatggagtacctgtattgatgatggtctcccagcataaacaactacaaagctggacaaagtacatgaagaaattgtcttcagccattgggcaataggcagttccaggtacaatctgagagaagggaatcacatgaagttactgctacatttttctggtggggaaagtttcaaaaccctcaatgacagcacgaggaagcagagtccaggcaaaggatcagtcttgtttggtggaggaaacggagactgctgctcagggctgctaaaatgtgtgtggcagggtatcagaaaggatggagttgcagagaaggagccccagaaatcttatagaggttgctgcaggtccttggccaaatcccaaactatgaatgtgtggattgagactctgcaaggcctagcacagaacagccgatggggagctgagagctaaacagcgatttcagtggtcacagagtgctggaaacacatctgaattctggctcagccagcatctccactcttggaatctcaggacttgatgaatatcccagacattcacaggagggcctagaaggccatgccttgggattaaggaagattctctaggaataaggtcaaaactaaaaaccagctcacgctaacaaaacctaaaatgtagccttgacacacgtgatcaagttaacccatcagtaatttaattccctgccaaaataaaactcaacactggagtaggataacataacccacatctctacaatgaaggttcacaatgtccaacagctcaagaaatacttagaagacatgagaaaaagtgagaaaatatatcctacaattaagagaaaaccagtcaatacgaactgacccactgtgcatggtggctcacgcctgtaatcccagcaatttgggaggccaaggcaggtagatcacttgagctcaagactttgagatcagcctgggctacatggcaaaaccccatctctactaaaaattcaaaactgagttgggtgtgggggtgtgcaggggcccataacccccaggctgtggactgtacccgtcggtgacctggtaggaaccaggctgcgcagcaggaagtgagtggtggacagcgagcattactgcctgagctccgccccccgtcagatcagcaggcattagattctcatagaagcgtgaatcctaatgtgaactgcacatgcaagggatctaggtttcacactctttatgagactctaatgcctgatgatctgaagtggaacagtttcataccaaaaccaccacccctgaccctgtctgtggtaaaattgtcttccacaaaaccagtcaggactgctggtggcacatgcctgtggtcccagctacttggaaggctgaggtgaaaggatggcttgagcctgggaggtggaggttgcagtgagttgagatcatgccgctgcactccagcctggacaacagagtgaaatcttatctcaaagaaacaaacaaacaaaagggccgggcatggtggctcccatctgtaatcccagcactttgggaggctgaggcaggcagatcacctgaggtcagaaattcaagaccagccaggtgaggtggaggttgcagtgagccgagatggcagcattttactccagcctgggctacaagagtgaaactccatctcaaaaaaaaaaaaaaaaaaaaaaaaaaaaaaaaagggggcccataaatggctcacacattggaattagcaggcaagagctttaaagtaactgcatacatacatcaaagattttagagaaatatcaacacctgtgaagatggtgaaaaaagaatttagagaaataatttttagtataagtatgtcctaaatatgcatggtacatacttactaaaatatagtttattttttaatcagaaatctaaatttaactgggcatcctatattttatctggcatctctaccccaaagccaagaaagagagaatccagagtcctatcttttagcaggtgacctagcctaggacagggcctggccaggggcaattgtgcattggatggattagagatgccagtcattcaaaggtttgccagacctgcatacaatcaacattatttttatttaatatttttgtctaaagcaactttaaaaatgttaaccctttatttggaaatatagattcagaggaaatttcaaagatggtacagagaggtttcatgtactttttactcagtttcctccaaaggttctattttgtataaatgtaggacaatatctaacaatgtcacatgactatgtctatgccattttatcacatatgtagactcctttaaccaccgctacgatcaagatagagaactgttccgacaccacgaaaattccactcctgctattactctgcactcattcctggctcttcccctccactattcctactcctggcaaccactaatctgctttctgtctttataatcttctcacttcaagaacattataaaatgcaaaaattagccaggcgtgatggcgttagcttgtagttccagctacatggaggctgaggcaggagaatcacttgaacctgggaggtggaggctacagtgatcctgccattgcaatccagcctgagagacagggtgagactctcaatgaatgaatgaatgaatgaaagaagatctggcatggtggctcacacctataatcccagtgctttgggaggccgaggcaggtggaaccgctgaggcctggagtttgagtccagcctggccaacatgacaaaacgctgtctctactaaaaatacaaaaattagccagcatgatggtgcgcgcctgtactcccagctacttgggaggctgaggcatgagaatcacttgaacccaggaggcggaggctgcagtgagccgagattgtgccactgcactccagtctgggccacagagtgagactttgtctaaaaaaaacaaacaaaaaaaacaaaaccaaacaaagaaaaaaagaacattatataaatggaatcacacagtatgtggccttttgagactggctttttattttttgtactcagcaaatgccctttgagatccgtccaagttgtgcatgttcctttttattgtttttttttctgtttgagatggagtctcgctctgtcacccaggctggaatgcagtggcatgatctcagctcactgcaaccctccacctcctgggttcaggcaattctcctgcctcagcctcctgagtagctggaattataggcacccaccatcatgtctggccttttttttttttttttagatgaagttttgctcttattgcccagtacataggcatgatctcagctcactgcaacctctgcctcccgagtttaagcaattttactgccccagcctcctgagcagctgggattacgggtgccccccaccatgtccagctattttttttgtatttttagtagagatgggattacaccatgttggccaggctggtctcaaactcctgacctcaggcaatccacctgccttggcctcccaaagtgctgtgtttataggcatgagccatcgtgtctggccccctttttattgttgaatagtatttcatagaatggatgtatcagtttgcttaaccattcacctatgggggagtatttggttgtttccaatttggggctatcacaaataaacctgccataaacaatcatgtatgagtttttgtgcagacatcagtttatttattttctggtacaaatgcccagaagcaattgctaggtcatatattgaggtgtatgtttaattaaaaaagctgccaaactattttctagagagtctgtaccattttatattcccatcagtgatgtatgagttagttttgtctgcatcctcgccaatatttgatattatcactatgtttgatttgagctgttctaatagatatgcagtgatatcttactgtggttttaattgcatttccccagtggttagtgttgaagatctattcatgtgctttaagtcaactcatttttaaaacctaaataaatgtatttaaaaaggaaactttcgctttgggaggccaaagcgggtgaattgcttgagcccaggagttcaagaccagcctgagcaacatggcgaaactctgtctctacaaaaattacaaaaatatccaggcatggtgacgtgagcctatagtttcagctacttgggaagtgaggcaggaggattgcttgagcctgggaggttgaggctgccgtgagctgtgatcgcaccattatactccagcctgggagacagagcaaaaccctgccttaaataaataaatgaataaaaggaaatttgtgattagtggttctcaaagtgtggtccctgagccagcagcatcagcatccccatcagctgagaacttgttagaaatgcagattctcaggcgccaccccagacctcctgaatcagaacctctgaggcgtgggttcagcgacctgtggtttaacaagccctcccggtgagaatcggtctcattcactacagatagaaggaaatggtaaaaatcaattcatccccgtatcgcctaaaatcctcctgtgggccccaggttggcacagcacacttttgggcaggagccccactcacagaggccgtgacaagaatgctcctgcccctggggttgtgcagtgacagctcacacagctccacgtggcggttctgagtttgggaagcgctgatgtagtcctactacagcccttcctgcccttcactggactgagaaaatccaggctctgaggagggagagacttgcccaaggtcacccagcaacatggtcagtctcctttcccagggccctcacaatgcgtggcctgtttaaagcctgcctctattcactgctgagtgaaaaatccagctccaaaacagaatatggggaaggatactatcttgtgcagcttatgtttatagctgcagatacgtgggaaaaaaagtcagaaaatactgttgaagcagttacttagggagaaaaggtgtttgctggtcttttgtgtttttaacttttctatatttcataatttttatcacaataatgtttagttacataatcaaaatgtattaaatgttaaaaattgacatgaagcctgatccagccacggcctattgttggcagagtcaggaagccttccagatagagcagccccgcacctgccccaggtcacaccctgggcctgggcacatgctaggtcctctgtctggacaccctcaccctgtggtggcctccacgtccgtacccaccagcacctcctgtgggcgaggccctacattacatccagccctgggcacccactagcccagagggcacctcatggtctgagagcccgcctgtctgtctctaaagagaggaaaactccttgggacatgtgttccacttgacccatcacccctggcctggtacagaaaggtagacagtgggtatttggtgaataaatgaatggatgattagaatgaattcccaaaatggcaatttcctgaggcccttctccagctggcccaggtggaaccagttccacttttcacaggaaagccaggtgggaggagtggggcaggtgtgtgtgaggggccagattcttgagggctgcatggacatggggctttggcgggtctgggggcggcagtgcttctgtgggagcctcagggagggctcatccttggaatccaccagggtatcctggtacccccagctgctgcgtggcgtgagaagtcctggctggtggggacacacaggtacttgtttggattggccacctggtccagcccaaggagctgtgcctccagccccttggggaaaaactcacttctgatgtgtgacaacagctgcaggcaaggggagggagaggtgtgctgggcctcggccttagaagccagaagccctaccttggtctatatgggaaaggcatgcggcctcagctagatctagggtcctgggttatggtcagaaccctcccttatggactcagtgacttgggctgaccccgcccctccctgagcctcatcagtgaaaccaggatggggccagggctctcgacacctcccagctcagacctctgactttctcccaggagggcaggagatcagacagaggtgacccgggctctcctgtttacctcaacctccttgtgaagcctccctctttctgcctgtgaggtgggtggggccggaaggaggggcattcacctgtaggcctctgacttctctgcccaggtgtacctggagagcctggtctatacccggtgctctgctacaccccatggcctggccatgacctccctgcctccagagcagccctggcccagggaagaagctgtctctgcatcgaatgataggtggaaaatggaagtggggatgatagctctgaaaaggagtcaaggaggaggtgccttcccaaggatgctgagggtttttccagaatggaacttgactggtgcgggcaaacatcaggaggtgggaagggtggctccctctgtgggagccagggtgacttgcctggatcgaacagtggtaggcagtgggtagggcaggcagagctggggtgcccagagcctggggtccctgtccttgcagaggactggattgcaaaacaagtgtcccctgccttctggctgggggacatcctctacttccaagcccagacatacacctgctgccacaagcccctgaggttcttcagaggaccaatgggcagccacacccatgctgggccagcctgctgggcccacctgcaccatggtcagagcccatgactgaggggactctctggggacaatgggggcagtctcatgctgccctcttacaggtggatcagtccctgggatctggtgttgggccggggtaggctgagtatgttctctgatggggtgccttgtggacagcaggtagagcaacttcttcttggctttcttggacctcaggacatagctgaacactgcgctttaccctggatgccttcagattctcaggggaccctgggaaggaagaggggctgcccctgcaaagggccagggccctggcccatggttgcttcccccagcaggtacctcctctccagattgacatcacctgattcctgaaggcctgagctacagaccagagccccaacaccctcaccaaggcctgttcttaatcagagcagctagtatatgattccggagctgaagcgggcagagagagaatgcggggctctgtaagacttcttggctccctgctgcggtgggccctgtagaaggccccccagaaatctgcagctgctgtaagtcactgggaggaagctgcagcagacatgtgtttcccagcctggtagatggagaagggtttccgggtctccgagtgggaggcccaaacgtggccttggttgtagcagtgcaggaattctagccagctctggggcccagggcaagtcatttaacctctcagaaccccactcctggtcaccatgtggctcttgtgtggttgtaaagaacacccctggccacttatgtcccatcagtggaagcctagcatgggtggagacccccgagactgaactcagtggcaggatccagcctttccagctctcctacatagagcccagagccagcagggtgggtttcctgaagaagcaggcactcctgtgggctggagagcatgattaaaggtccctttgggaaggtggaagaggctgcggtcagtggaggccataatgaggcagagcttgggcagaaggggcatgattgggggatctgagacccaatagagactggactgaggacactgtgccactcaggtggtggaaactgagctagggctgggccccctggtcccgagtgaggcctcaccagtcttggaagctgtgccaaaggtggcttcatgtaagggtgcatctgaacactttttttttttttaagagatggggtcttgctctgtcatccaggctggaatgcagtggcatgatcatagctcactgcagcctcaaactcctgggctcaagcgatcctcccacctcagcctcccaaagtactggaattacaggcctgagctacagagcctcgttttaaatcttaataaatatctccccctggtctgcttccctggctgacacacatgctggcaacttgcccctagacagacatgtttctggacttggttccatttgttctgatgggctcctctctctcaatgaccgcacgttatattatgtggccattcttacacgtttctgtatagacctgagggttagtgtattaatgtcaaagttctactggtttttcgaggctgggtggaatgtttgggttaatttaggagtgggcatcttgacaatataggcttttcctccgggaatggtgattctgggacgcaggttttgcacattctggtttattgcttggctcgctgccacagagggatggcactgctccacatgccatgcccaagagatgtcccaccttatctttctaaatcaagctgaatgttctcagctgacaggatatcctatcagtgctgcggggactcacaccttccaaactgagatgaagtgaggtggagactatggagcagatccgtgctgactgcattcgcccttcctgacccacactgctgctggccggggctatgtctgagccatcagagggcattgatttggggacggggcggggggcggtcctggagagatgcccctcacctccctcagctcctcctgtccacctaacacttggccaccaaggtccctgacttccaggccccagtcaccactaatggggtgctgcatgggaacaaagtgtaggcccagaacctggagctcaggtcactcctccttccattcgaagcctctgcccctcccaggtgattccaccctcattcctccatgggccaaatatcctaaacaaaggcctggacaggggtctttatccgagtactcagaaaacacacacggaaatgctttgcatgccccctgtggcctgccaggggtaagagcctgcccgtcaaaatgcacagtcctggttcttgcagggaggtgaggagcggaggaagaaaagatccatctcattctttcagcaggatcctaaacttgggaaagccagatgcagtacatttcttaatcctgatacttttataactggttatagcggggtcacatgcgcaactgttttccaacatctttcaacgggccacataacatcctgtaacttctttttttaatttttattttgtaaggccaggggcagtggctcacgcctgtaatctcaacgctttcggaggctgaggcaggaagactgattgaggccaggagtttgagaacagcctgggcaacatagcaagaccccatatgcaacagagaaaaaaaattttttttttttgagtacagtggcatgatcacagctcaccatagcctccaactcctgggctcaagcgatactcccacctcagcagctgggactatcagagcgcagcaccacatctggctgatgttttaatttttagtagagatgcggtctcactatgttgcccaggctggtcttgaactcctggcctcaagagatcctcccaatgtgacctcacaatgcactggggttacaggcatgagccaccatgcagcccctgcaaaatctaactgtccttcaggtgctccttttggacctcctagctagactgccattggcaaatgccagttgattatccacccacatttatgttaatggatttcccatgttttatttgtctagaccaggctttctccacagcagcactgttgatgtttagggctggacagttctctgttctggagctgtttgcgcctcgcaggatgtttagcagcatccccagcctccgcctgccacatgccagcagcactcctcagtgtgacagccaaagtgatttcagatactgtcaaatatccccagggcggcaaaatcacctccagttgagaactgctgacctaaaaccctctggaacaatgttagatcatggtaatgatagcgcatactgctcctgaccttaatgggaatacctctagcatcaaagtatagtagtacctgtatactactgtctgggctgttattagtacactgtattagtccattctcatgctgctatgaagaaatacccaagactgggtaatttataaataaaagaggtttaagttgactcacagttctgcatggccggggaggcctcaggaaacttacaattatggcagaagacacctcttcacagggcagcaggagagagaaggagagccgagcaaaggggaaagcctgtaataaaatcatcagatctggtgagaactcacttactatcatgagaacagcatgggagaaaccacccccatgattcaattatctccacctggtcccacccttgacatgtggggattattgcaattcaaggtgagatttggatggggacacagaaccaagccatatcatatcctttatattagcatactgtatcaaagtataattttctttcttttttttctttgggacagagtctcactctggctctggctggagtgcagtggcacaatatcagctcatggcaaccttggctcactgcagcctcagcctcctgggttcaagcaattcttgtgcctcagcctcccgagcagctggaactacaggtgtgtgccaccaatgcccagctaattttgattttgtttttagtacacatggggttcgacatgttggctaggctggtgtcaaactcctggcctcgagtgatccagccacttcggcctccagaagtcctgggattataggcgtcagccactgcacccagcctgaagtataattttcacaatatgaaaagcttgactttcatacaaataatgaaggaatacgtataagatattttctttaatttacaagggagtcagcaacacggtgaagctagttcaaggagcgttttgagagacagtgtctgtagtgctccaggaagggcattccgaaatgcattctgagatagagacaaaacttgttaatatcctaaagggaggccgggcgtggtggctcaggcctgtaatcccagcactttgggaggctgaggtgggtggatcacctgaggtcaggagttcaagaccagcctggccaacatggtgaaaccctgtctctactaaaaatacaaaaattagccaggctcaatggtgggtgcttgtagtcccagctactcagaaggctgaggcaggagaattgcttgaactgggaggtgaaggctgtagtgagccaagatcatgccactgcactccagcctggacaacagagcaagattctgactcaaaaaaaaaaatcctattgggaaataaaactgtcatctttgggagttatcttttctactgtactgaaatctgtaagttaacatatatacatattctcacatatattcataacatattctctagtatatttccctacattagtggttttcaaaccatggtctcaaattggaagcaccagcgtcacctgggaacacagacatgcaatgcttaggccccacctcagtcctattgagttagaaactctggtgtggggcccagcagcccatttcacaagccttgcaagtgattaggatgcactctaatgtttgagaaacactgctctaaatagtcaatctttaatagtaaaacaagtatctatgaaacaatgctcagtatgacattaaaagggcgcaccacccaccttttaactttatttctgaatttaaatattttgtctgtctaatgttaaatttgctgttttgtttttcaaatactcttaagataagacagttttcatctgttcctaattttctttttaaataaaaaatggtcccaaaactatccatttttctcttctttaacctactgacagcatgaaataaaagttgaaccattcctacatctttttttttttttctcaccttgttgctcaagttgactgaaatgcagtggtgcaatctcggctcactgcaacccccacctcccgggttcaagcgattcttgtgactcagtctcctgaggctgggattacaggcacccagcaccatgcccagctaatttgtatttatttatttatttacagtagagacgggttttgccatgttggccacactggtctccaactcctgacctcaggtgatctgcctgcctcggcctcccaaagtgctaggattacaggcatgagccaccgcacccagctttttttcttttcctttttttgttttgagatggtctcattctgttgctcaggctggatggagtacagtggcgccatcatggctcactgcagcctccacctcccatgctcaagagatcctcccatctcagcctcttaggtagatgggatgacacgtgtgcaccagcacaagcagctaattttttgtagagactggggtctccctatgttgcccaagctggtctagaactcctgggctcaagcgatccactggccttggcctcccaaagtgctatgattacaggtcttatgttcttaaaatttttctttgacatggtataggatagtctagtaacttaacacactgttgctttcaagaggatagtgcttatgatttgtaaaataactcttcagaaatgagttcaattttaccatgaattgggacactttctatttctattctatagagcagtttacttgtcatgaggtctgtcttttgaaaacttgaaagcctgcaacaataaaaccagctgcacctggtgcatgggataggcatggaattgaggagagagctcaaactatggtcagccttctgtatcctcgggttctgggtccttggatttaaccaactgtgcatcaaaaatatttggaaaaagtaaaacaataaaaaaacacaaaaatttaaaaatactttatatcagctatttacaaagcatttatgttgtattaggtattatagcaatctagagatgatttaaagtatacggaaggatgtgcataggttatatgcaaatactatgccacattatatcaggaacttgagcatctgtgaattttggtatctctggggtcctggaaccagtatcttgaggttactaagcgacgactgtattcaatttcttctttggttattagtttattctttaatgtatttttgttgttgttttgtctttttgtttttgcctcttcaagtcaacgtcggaaacttagttgttctagactacccattagctcaaagctaccagtaatcagactaccactgcaatctaagcaaccgattttttttttacccatcagactggcaaaaattaagataagatctattgatgttgaagctgtggggagttttcctgagcatgttaattatgacagccctttttactaggcacctagacgattcatcaaaatgaaataaaatacccatgcacttgaagaagttacctggttatttccttatctgggtgctggttatgtgaggtctacagttgatgaaaacttattaagctttatatttctaataggtacaattttctgtatgtgtaatatatttgaaaagtttttaaaatgttttttgccacagcccgcagctgtgtataatgctattcgcttaacagtggaaaacatggcaatgacctgaatctccctggctcccgggatcctacccccttaagttaacgaaaataaaagtaaaagaaataacttccactgtctttcgtaatgccttaaatccgtcctcagttaaaccggcggttggcgctggttttttccagggcaggattctgggagacggaggagcagacgccagcatttcgcccccggcacctccagcgggctgcggtccgctcccggcctcactcgagcaggccccgccccgccagaggccgttagtccaagtcacgtgatcgtcgactcagctgacctggcgggaccggaaaaagaaattcccgggcgatgatgaggcaccaggggtgaagcggacatgggctgctggagcgggaatgagggggcgccagtggctccggaaacgggttgaggttgtctgcactggccgctccgcaaacacagtgtgtgcgggcgtcagggcagcaggtctggtagagaaaagtccaccgccatccctctcccgagtggggcgggtaagacagagcaggccggccggcttagagttccctgcttccctggcggaaggaagggcccctgactcctggggcaggaactagggcttgtctggagctgggagtcctttcaggtcttctctagctccaaaaggacctcccaaggacacccccttccccagccctgctgtgggacttggacaggaaagtgctagaatcaggctcactcttgcacactgttaggaagccactccgctcttttcagatccagaaagtagtagttttggggctgatacttatccatccattcatccaatccatccatccataggttcaaagtgcctagtctataccatgaattgtactaggcactgggaggacttgagctgccgcgggaaggggaaatcagaggcttgaattggcagtcatagttaaggctccaggggcagagacctaactgcgccttgtgtgtagtgctaagggggcttcctgaggatgccttcaaccttaaaggcgatggcaggagttggctggctgaagtacagtttgtgtaccaggggttgggaggcaacggtgggaggcgtgtgtcttcagacagggaacagcatgtgcagagacttcaggtgagagagagcatggctccccaggaatgaatgcatttcccgtagctgggagagtatcatctggaggttagggaaagatgagtctggacaagtaaaggccaaatcttcctgactgttggatcaccacaatcaagataacgaatatatccaccggcccccaaaatttccttgtgttaggggctattttaggaagtatgatcaagaagggctggcctgccagggtggagtggctcacgcctgtaatcccagcactttgagaggccaaagtgtgcagatgacctgaggtcaggagttcgagattagcatggccaacacggtgaaaccctgtctttaccaaaaatacaaaaaagttgggtgtggtgacgcatgcctgtagtcccagctacttgggaggctgaggcaggagaattgcttgaacccgggaggtggaggttgcagtgagccgagattgtgccattgcactccagcctgggcaacagagcgagactccgtctttaaaaaaaaaaaaaaaaagaagggctggtctgatgaggtgtcacttgagcagagagtggaatgaaataaaggatagcaagccacatagagagtgcagcggaagcaaggctggtgtccctgagctgcagcagggaagctggagtggctggagttgtgtgggtatggggaagaagggagagagttcactcgtctctgtgaggcccaggactttgttttatcccatgctgtacccccagcacttagagtgggagctagcacagagaaggtgctcaattgatgtttgctgagcagatgaatgcctggagtagacctcagagcagggtttggtggcagggtgggtcaggtagagtttactcaacagcctggtgataggggagaacaagtggccagagggtatccatctatgtcggggaccaggggtccctgctgggcagcagtgtgggagacacagggatcctggccacacctcagtcttctttccagcctgattacctgcctccctcccttgcagaggtttcggttctgtggtgatctggactgtcctgaccgggtcctggcagagatcagcacgctggccaagatggttgagtgcacagggtctacactgggtggaggaggggtgttgggctggggattgtggctgtagaggatggtgaggtttctctggggctagggcctcagtgctctcagcctgtgctaccatgctttgtgaccttgatcagtggctggcctgctttgagccagtccccaggaagaaggggtgaggtttgccagcctggctgatgtaaggacttcctttccagtcctctgtgaagttgcagctgctctgcagccaggtactaaaggagctgctgggacagggaattgatgtgagtacaagatccagcaccccattgtcccatgaccttatgaccaccactgccctgaaactctgcactaggcccggggagacgggtgagccagcctctcaacctctctgggcacctcccttccttctttccagcctgtctgttccttattgcaggatccaggctgggggtgaggggctggtgagcagggacctggcaccccctgaaggtctcctttccccatagtataagaagatcctgaaactcacagctgatgccaagtttggtgagcaccccgctgagttcacaggccccaggcaaccctgggacctcggcctggtgcctggtacagagcccgccccccacccccccgccaacacacacatcccagcagtatccttaacctgccttccctagtggaggagcatgagggaaagaaagacattgacagtcccaccttcctgtcctctgccagctcctggtggagcagtagcagtgcctatggctccaggaggcctgggggctttgagctgaagttaatagggcaacagggaggtggctgggcccacagtgacaccccctgtcccatgcatgggtccctgagagtcaggcgatgtgaaggccacagtggcagtgctgagtttcatcctctccggtgcggccaagcacagtgtcgatggcaaatccttggccagtgaactgcagcagctggggctgcccaaaggtacgggttgtgggtgggcagctgggcagcctgtgggccaagggctgctagagagtgggccaggccctgtgaccctgaggtgtaccctgccctgtctgggccaggagcccaagcccagcccccacctgctacctccagagcttctccattctacccccagagcacgcggccagcccgtgctgctgttatgaggagaagcaaagccccttgcagaagcacttgcgggtctgcagcctacgcagtaagtatgaggccagccagggtccgggctcatcctagaaggtgcacgcagcacacaaagtgcgtggagagtccagggagacaatttaaccgcagtcacataccgagcagccgcagagccgggacgtggccctcggtctcctgaccccgcgcgctctgtgatgtgtacgtacaggatcagaccttgccctttcctcctggctgacccttccttagtcccccgtgccccatgtgtgagcacccagctcactctcattcctccctctccaaagcgtggtccctggcagcacgagtggcagaagggacagcagagactgtggacccctcagctgcacctaagacctctgtgtggtctagccgtgtgtgctgggggaggcttttggccaccatttccccctctgtaaatgagaccgatacctgtggcatggaggacaggaggctggtgtgagtgccaagcacttggagcagggccctgagtgagcatggacatgggaacaggggtgtttctcgactttgtgcaccttggggatgggagtggggctccctgcatgggttgacaaggcattgctttcccccaccccacctctgtcccagccctgcaagtccagtccttgggggtctaggaaggaagaagcccctggctgtttggcctcaggctggtgcctggccctctctggctctgagttcctgggaaagtcagcacccaaggcatgccctcaagtttagcaccttgacaagaagggcggggacactgggatcaggcccaactctttggccccaaatcccacggccccagctggaggatgaggagacgctgggcttggatggggaaatcaggggtgtaaaggggcctgctcacccctcagcttggctcaaaggctcaaggcgtcaaaggctcagcctgccactcaggaaggagccctggccaagccagacactcaccaggacaagggcaactgtgatgagcaggaggcccaggatgaggagagccatggcatagctggagataaaggcatccagcaggctggaggctttggggctaggactgcctagagcagagcaagaaggctatggccaggcggggctctgcctctcagacttctgagaagacagaatctgggcccagaagttgctgcgggaccagagagctggggctaggagcaccttagagggctccatgaggaggggaggcaggcttcagatcagggcatgtggaggcagcgagcccaagggaggaggcagagggacagagggaggcagcctgcagagggaaggaggtactgaccgaggtctaggatgaccatgtctaccaagacgcccgctgcctcccacagggtgtgcaggccctggcgtgcacagtgccacatgacggcctgggctggcgccaccctgaagaaggtggcacccactctggcggtcagtgggtccagcctgctgagaggattatcacagacttcaggggtctgtgcagccttgggggactaggggaggtcatctcttccagcctcctgtcctcaaccccagaaccccggtatgagccctgggtcacccagggccaccccggacccactggaattcctccaccaccgcttggtcaaagttctgcagagatctgaggacaagggtcagctggggggtcagaagaggatgaagagggtcacagctctaccaaacaaagcttcattccttgtggcccctggcccacccctctgctgccaacctcaggctggcccagccctgcagagtaggtgcccaaaggcatcgtagcagttcctgtcatgctggtctccccccggggccccctctggagcctggtaccacagatctcagggtagggggtacagctcagtctcccttccctctcatccccctcataggggcttagtccaccaaggcccctgactgctaggggacccacacccacggcctccttctttctgactgctggcccttccccagcctggatacttgagccctgggcagaggggtaacaatcccaggactgtcttcataagcagagaggccacttggcaccaggctcttactccttgggctgagctcagcagcaggtgtgtcaccaaggtcccctgggcagaaggggctcagccctgagggcccatcactcgccatgcctgcacgttcctgctaggcatccaccctggggacccagctttcccccttcccccagctgctggcaggcctgtcttgattcatccagggtccttcaggccatgccgggaagcagccagcagctgggaggagcacttggggtttctgcatctttttttatggagctgacttgggtgggaggggctacagactcaagggagactgcaggccaccccttccccactccctggctgggtaggcttccagctcaggagtctgattggaaggatgggaccgtcctgtcacagaggcaggtctgagtagtccaggcccagttttaccctccagcagggcccctttcattcatttgtccagctggctttgcccaaagcacaagtaatgtctatgtgtactgtgtcccctgtccccaaggggagtatggctccagtcctggcctggaactcagagaccttagaattagaggccacatctggcagggtggaccagcatggtctgcccacggccagggcaggtaccatgttggcagccccagacctgacaccacggctcccgtctcccctctccacttccatcctgcacatcacctacactacgcgctgtccctgatgaatccaagctgtcagcttctgtcagcttggctgggaagtcatgctgaccgtaaggggaatggtgcagcctgagttgggggctgagtgggaatgggcctggtgtggggtgggggaggtgggggtgaggcgggtgtctggcgcctctctgcttatcttcctttctcctttgtccacaaaggaggcatcttttccatgtccctctgccaccctggggacataaaatactgccccacttctgtcttcccttggacatagcccacctatcttcctgtgggactcagggctttgttttgtcctgtggcccacatgagaagcaattatccctgctctgctcagctgagagaggacaaactgaggcagagcaggggaacaactctgtcatagtctggctgttaatggcagagtaaagaccagcccttccctgagtgtcaggtccagtagacattatattagtccgctttgcattgctctagaggaatacttgagactggcttatttatttatttttgagatgaagtctagctctgtcgcccaggctagagtacagtggcacaatctcagggcactgcaacctctgcctcctgggttcaggctactctcctgcctcagcctcctgagtagctggaattacagccatgcaccaccatgcctggctaattttttgtatctttagtagagacagggttttgaaatggagtttcgctgttgtggcccaggctagagtgcaatgttgtgatctcaactcattgcaacctctgcctcccagttcaagcaattttcatgcctcagcctcccaagtagcttggattacaggcacgcaccaccatgcccgcctaattttgtatttttagtagacagggtttcaccaggttggtcaggctggccttgaactcctgacctcaagtgattcacccgcctcagcctcccaaaatattgggattacaggcatgagccaccactcctggcactgagactggttatttataaaagaggtttatttgcctcacagttctgtaggctgtacaagcatctgctaggcttctggtgaagcctcaggaagcttttacttctagtgcgaggcaaagagggagcagacatgtcgcatggtgagagaataagcaagagagaggaggcatcaagctctcctgtgaactaatagaaaactcactcattgaatcacttgaacctgggaagtggaggttgcagtgagccaagatcatgccactgcactccagcctgggctatgagcgagactctgcctcaaaaaataaaaaaataaaaaataagaaaactcactcattaccatggggagggcactaagccattcatgagggatcccccaccatgacccaaacacctcacactataggccccatctccagcactggggatcacatttcaacacgagatgtggatgggacaagtatccaaactatgtcagaggcctccccctccctctcatcagaatcttctgtcctcagttcaggtgcatgctggcctccatgcctggcttcctagaaagtcatcttggcgccaaggggttgggcagggccactaggctgagggttggagccctatctctcctagtcccagcctgggtctccatcactgggtaacccgtactgctcgctgcattctctccacacctgctccctacagcccaggggtcagtctgggtgcaggcctgggtagaggtccaggagcagattctgccccccagctcatacttcctgtgcaccatggcagaaaatgcaccagcatggccaggagcactggcttgtccctgtagtctcagtgttttgggaggctgaggtggaaagatcgcttcagaccagcctgggcaacatagtcagaccctgtctcgaaaaaaataaaattaggcatggtggcatgcacctgtagtcccagctactcaggaggctgaggtgggaagattgcatgaacccaggaggtccaggctgcagtgaggtgtgattgcaccaccacaatccagcctgggcaacagagcaagaccctgcctctgaaacaagaaacaaagtgcaccagtgtgtggattccagcttctcctggtgtgtggacctgacctcactcagccccatcagtgagtaggaggcttcctgctgtcttccagaacactctcaccactacacctgtgttcctcctgcattctctggcaggctttgtgaggagacctgtcacctgcctctctggctgccctaaggcccagctcaaaccttccctgaccctgagaacctttttctgaagagtctttcccccacccataggccccctcatttcagagcttttggtggggtgagtacaaggatcgactctctgctaccagcctgggtagggtccctagggttgggtctctggatggcatatgagggtctagaccaggatccagatgcctgtaacctgaagggcaggccctcagctgccccaacttcatggagcccctcgtccagcctgaccttctgggataggcccagcccctgcatcctttggtcttggtccctgcagggaactctggttaccctggcttacctactttgactccaaaagtaatgctgacatcccccgtgagacacagtgacagactgagactaacgtagggttacgtggctcagagtcaccatggccaggcagagctcaggtcctagcactgttcagccctgcctcccgggttcaagtgattctcctgcctcagcctcccaagtaggtggaactacaggtgcatgccaccacacccggctaattttttgtagttttagtagagatggggtttcactgtgttagccagcgtggtcttgatctcctgacctcgtgatccgcccacctcaggctttcaaagtgttgagattacaggcctgagccactgcacccagcctccctaacactcttctagctctggtgccctgcagggtctcccttggagcacctggagcccaagaagctgtccctcacctttgcaatcccagggactcgccccctgatcatgatgaaggtggacccaaacccgctgaggggcctgaaggagcaaaggtcagcctctgcctcccacggcctctctgatgggggggatgttatcccagcagcatgagctgggagcagaattgggaggatggggggttttctctgtgggtagctctgggctccaaggtggagccctcttaacctggccgctcccctgtgactctccttagccccaggcaaagaaagcagcttgccggaggtcacctgtcagatagggaaagagtgggacctgggttctttctcacccagctgcagctctcccttcccccagccccttcccccaggtgatagagaacctggcaggctgtgtcccatagaagagttcactttccttctggtaagggatgggaaccagcttgggatgggagggatgaggggtctgggggctctcccagccctgcctcacatttgaaggatggcatctgggtgtcagcatggtttaggctagacggggcggccccgaggtttatagcctggcctcgggcaggatgctgccatgccaccttctcttctgcacgtcctgacctggcatcctacctaaaggtcctcaggtctcctgccccctgggcattgcccccactccctgcccagacacagctgtccttgtcctggactaatcttcagagattcttgtccagcccacagctttgctggacatcgcaggctgggccaggccccctgcccagcactaacatctctgtgtgtctcaaccagactgagctgcagcttcagggtcagggtaggctctgacttaattgacgtgacccaggacaaggggatttattgatggtgtcacatatgcttaagctcttggcctctatgatttctttggggcatgatacccctctgtcccatgcttaggtgcccacctgtggccacaagtacctttcttaccaccatccctacttgagatcggtgtccaggcacctgtggctccacgcagaacgctgagcacagagccaggcctgggcggatgttctgcaggggctgcaggagctgacagtcctgaccacccagcccgtggccatccattccctttcaccgtggctggctcttcatccaccatccttccaggggccaggcctgaacccaaactgacttttacctgccctggtcccccttgtgcctatcaggttcttggctgagcatgatgttcttgcccatttccttgattatcctcaaaaggtttatagaaccacttggggacatcacatctgtctaccaggtcctcaccagagacatgactgccttgggccgggcctgggatagtcaggggtcacactcacctgttgggacctagcttcagtggcttcaatctgggcaatggcctgatgggcggctgccccttctcctctgcttgggggaggcaggagaggaaggtcagggaggagatctgcttcctgcccacctgacactggttggaagcagggcgcccacctgtgcctgtctcaccttgctgcaggtgcatcggaggccgaacccctctcccgatctcctgcaggtgcagattccaggtttccagtgggtgtcagtgtgggctccagagctctcctggtcctagggaaccctgggctccatgaggccttcgcctagccagattgtttcccacactgtcacctccccaccctgtcacctccccaaacatggggctgcatgctctgtgccctgggtgggacattggaaggagtgccaccttccaggtttggatcacagtaaagcctctgccatggggatgtgctggccgagacagatggggttgaaccagtcatgatatgttggccttgggcaagtcatctgtgccttgcttccctttccccagcagccagaagggataatagcacctatttcacccatactcaagtgttcatttgttagcaggaactgagtcccggaggaggtgcaggtggagccattgaggcagcactgcagctggacctgggtctgagtcccagctcctggctgtgatatgcatcactctctccatttatttatctgaaagacagggctgtgctgttctggggtcactgtgagaatgcaactggcctgtgtgagttggtggtggcctcctgtgatagcttgaggtgggctggaggtgtgtcttgaatgccccctcacccccatggggaagacccacttagggaagactcaagtgtctgtatggaggaacccacattccctgcccctcagctgtcctctgtcccttcctagccccctctgctgtcctgcaggctctggcggtggccatccagcttggtggccatctggctgatccactcctccaggtggaccctctgtcctcatgtggtgcaggtcccattgtgccacctccagacaggccatgctagccccagggcctccgttccctgttacccagcccccacccccaggtacgtgccacctccctaaagcccactgtgtccaccagctgtgtttcaactctgtctctgagcaaggcctaacgcaaagcctgaaacagcctggcttgtagagggccaggagaccaaagcttgaagagagagtgacggtctcccagagcccacttagcctcagccccagggctgtgtccatgctgttcctggctccagtgagccaattctctcccctgacgcccgtaagggctccagtggtgatggaggtagctggagagaacaaggctgtcttaaccctccctccctgagaaggcccaacggggaacgttttaggcatcagggcattctggggggcatcttccagggacccctcctataccctgccctgccctggctctctagtgagaaattgcagttgcttggacagtggggctgacccaggacaaatgcatatattgggctggtcttcagggtgctggggtaggggcaggggcacttcagggataggaaggaggggcctgtgtgttccagaagtacagaggaacctggtgccggccgccgtcaacccctatgtgatgatctttctacccgccctctttcgtgtcttggtgctggctgctgtctttggccaggtaagctcatggtctgggctcctggggtccactcactgggcctccacactgcctgcaggtaggggagcctttgggccaggactatccttggctccccttccaggtggtgggttcaaagaccattcctgggttccaccaccgccaagcctcaatggtgtctcgatggtcacaggaactgctggggctttctaggttaagacccttgcctatcccggtgttcctccctgcagtagggggctgcaggggtcagcctcagtctctgccttgggagcctgccttaccttgcctgaactcaagcgatctgcctgccttggactcccaaagtgctgcaattataggcgtgagccactgcacccagcccagccttgactttgaaatatatgttgtacatccagacagcagtgaactctgggggaacaccaaagatgaggagaatgagagaagagatacctccaattaaaggagttaggaagagatgcttgaacttatgttttaaaaagtcaatgcaggttgggcacagtggctcgcacctgtacacacagcaccttgggaggctgaagtgggtgaacggctggagcctagaagtctgagaccaccctgggcaacatggcaaaaccccgtctgtacacaaaatacaataattagccaggcacggtggtgcctgtggtcccagctactcgggaggctgaggtgggaggtcgaggctgcagtgagctgagatccaccactccactgcagcctgggcgacagagtgacaccctgtcttaaaaaaaaaaaagtcactgttttggggttttctgggtgaaacctctgtttccataaaaaaagaaaaaggtcgagacagtgtgtattactgattcaaaatcataacctgatgcttagagtaaatcattgtatctattgtttcaaaaaccaacgtcaggattattaaaagttaattttattgggtttttctttaagcttggctgattcactcaggtctgtcacttccaagcccatgttttactactttgtaaccctatttggaaggaaagctgcagctcacattatgatccatcctgagatgaagagtttcacacatatacaccacatataccccccaccacagtatgacgacacagcaacccaaccttgggcaaatggtaccactgccagcaaatttttttctttattttaaatatttttactgtatttcttctaacagcagcaaatgcatttaacactttattgagattctcaacagctgccatttggtttgtatagcaaattgtttacaaagtaacttttttccatttttgatattttaatgaaaattatgttcttcagttttaaagctctgtccctctcccaaagaaaggttaataactaactaccaagtaatgattatttgggaaaagaagaaaagcaaaaccagcttgtaaacacttctggaacgtgggtaaggggccaaagtcaagaccttctgggcccagtgcaggtgctaggcttgcctcgggacaccatcagcacttccccatccacaacatcctcaacagctgggagccatgtgcagaccccagggggcttcctgttccacaagctcccctctctttttcctctccacccttgctgttgggcctcccttccaaatctgcctaacaaaggcagcaggatctttaatactgttcagctttgtcaatggagacaggatactctagaaagttgagagattccctggtccagtctgggggaggaaaaaatatgcagtgtagcatagatggttttacttgtccactcagacacatgctcatacttattagatggatgtatcagatgcttcaaaagtcctgatgtgtagtagcacaaaagctgcttgtaaaaaggaagttgcaaaatgataaaaatttctgcagcagttcaggctcctgatgacaaagctggttctgataagtagttcttttgacatgcacagcagctttcactgttaagtcctgtgttccagcggtttcatttagaccataggaagttgaaagcaaagtttaaatgttctctgctgacaaaatgtggtatatatccatcaatggacttctactcagtaatgaaaggaacaaactaccaaaacctgttatatgtcatggaccaacctcaaaaaccttagctaagtaaaaagccagacatgtgaccacatattgtataattctgttgatttgaaatgtccaaaaaaggcaagttgatagagacagaaatggtctgatttacctcaagaagtagggattcaagctcttagggtacatgtgatacatacattagaagaaataaggaaaagaaaagaaatttatatgtaaataaatgaaaataatacttctccctgattataaagaaaattgcattctttttgtaataatttggaagacaaaatatgaagaaaagtctttaattttgccactgaaagcattctggtttgttgctttttatatttttttatgcatatgaacattttaaaaagtagaatcgtaatatatagtcttttgtcactatgttttgggcatatttctatggcagtaaatatatccttggcatcatctttttaaaagctcgatgtgtattaagttaatcattgccaccccagaagtaaattttcttatatatatattttaatggacgcaagcaagcattttggggctgaagtcatagaagtagaatttctggagaaaaataacataaaatagttttaagatttttaatagaaattttcaaattatcctgcagaaaaattggttcagtttatactcccaacaggggcagagctccagtatcccgtttccatttgtcctctttgctgatatttaaggagaaaatctcattgttttcattgtatttctttggtttctagtgcttttgaaacttttttttttttttgagatggagtcttgctctatggcccaggctggtgtgcaacagtgcaatctcggataactgcaacctctgcctcctgggttcaagcgattctcctgcctcagcttcccgagtagctgggattacaggtgcccaccgccatgcctggctaatttttgtattttttagtagagatgggatttcaccatgttggtcaggcccgtctcaaactcttgacctcaggtgatccacccacctcggcctcctaaagtgctgggattacaggcgtgagccacggccctggccttgaatcatttttatgtgcttattggccatttttattcttgtgggaagtgcctgtttctccattgcctattttctggccaagctcccaagtcacatttcacttaatttttatcctgctgattgaaagcattttaacataaacaggagcaggacagactgtaattatctagatcttgctctgtcacccaggctggagtgcagtggcatgatcatagctaccacagcgtcgtactcctgagctgaagcagttttcatacatcagccttccaagtagctaggactacaggtgtgtgccaccacccccagctaatttttaagattttttgtagagatgcgaattcactatgctgcccaggctggtcttgaactcctgacttaaagtgatcctcccaccttggcttgccaaagtgttgggattacaggtgtgaactactgctcctggccgagggctcattttgtttgctagtggtgatattggtatctgtttatatttgaggctttggtgctagtgctgatgtattacactcaccatccgaggtttgcaggacttttgttttaatattgaatagatggaactgtttacttctgcatctttgcaggcatacaaaatgtgcctaccaggactctgctttatatctatcgaaagcaagaagtaatacagtaaaactttgcctggctagaggctttggaagaatggagtattctgatttaatgctattgaagtgtgaaggtgaaaagaatgaaaaacttacatttcctgttgaatgcaacttgaaaatacagccagtgattccacttttcttctctagtaagtttggacattctgatctacttggtgttttattatagaactgctagtgtgcccgagacttacattgtgaagacactttttaaaaaacttgagaggtaagagggtgtaaatggtattgtgtgagatcaggctggatgagaactgacacttgtaaacatactttttaggctgaatctctgattgccgtttgttttcttatttaactcataaaaataaaacacattggatggagggtgggagcaggaaggagatttatgtcttttaattgcatgccattgtttcatatcaagacagaacatatggtatccctggctttggacctacagaaggaaacacatttttctgcctgctgtatgccagaggttcttgaacacctggagggatgactgcagcacagattgctgagccctactccagagtttctgattcaccatgtccagggtggggcctgagaatttgcacttacaaaaggttctcaggttctgctgctgctgctagtccagagactacatttttgagaaccactcttgtctactaactgtaaattgtagaactctagaacaaagcttagtttggtgtaggaaaagaagctcacaggttatggagcaaatcatgaaagattcaacccttgatcccagcctagtgtggaattcaggtaacaatcaatacacagtgacataacacaattcttggttttcatgattgcaagtcatagccaagtatcaagtgagaaattcagtttcatttgcaaggcttagagaggccaggtgattctagaaaaataggccttgtatttgctttaaaccagtaaagagctttgagtgcttattaaatggaaagctttgtgtttttatttatttttgactattttattttatttttttgagatggagtctcagtctgtcacccaggctggagtgcagtggcgtgaccttggctcactgcaacttccgcctcccgggttcaagtgattctcctgcctcagcctccccagtagctgggattacgggtacccaccaccacacctggctagtttttgtatttcgagtagagacagggtttcaccatgttggccaggctggtcttgaactcctgacctaaggtgatccacccacctaggcctcccaaagtgctgggattacaggtgtgagccaccacacccggcccaaaagctttgtgtttttaaagatattagacatgtttcttgttttttaaaaaatcttaataatgtaggagaataagagaaatgttttttccaaagccgagaaatcattgtgattattttaccttattgggatgttggataatatagtccacttcattcattaatcatcaaacatgctatggattttccatttttataggatttgtgtcttaactggggtaatactggtaattcttatactccctctgaagatgaaaaatgtaggccaaaatcatagaccatgcatagaagctggataatgaagacagctctggaggaacatgtagacacacacacactgacacacatatatataaagtataaatacatatttttttaaagtttatttttaacattttaaagcaaaaaccagccctcccctctcccggagtaggcaggccccgcccctctccccaagtgggcagggacagcagtcgcatgggcagctttccttgtgatgtcacaggttcctctgggcacactgctgcctggccacgcctcctttccctttcatctttctcattgaccaatgggattggagcattaaggccacacccctattctgcattctagtgtggccctggttacgcctcctctggctcagtcacacagcagccttgtaggtgactggaggtgttcgctgatgtggccccaaccctacctccctccccaccccatgatgttagaagaatctcgacagaataaattggcagcagccaagaaaaaggtaaaaagccaagaaaaaggtcatggccccccaacctagccagagatcccctctgatgacaagaccactcccagagtccataccactcctgaggcacaccgggctgggcccccctaccccggcgcctctggactccccccaccaacgtcttgtcagtcagccccgccccttcagcaagcagcccagcctctgccctcgccaatcaccctgcggtgactttgggcggatgactactggggatacctgctccatattcagccctcacgtcctgccaccccaagcccaacctccctgggttctttgggctcacctctccaaggacctgggtcccccagccccaaccccccagcatcgccagtcatcccggggtgactttgggctggtgactcctggggttccctgagcagactctgctctcccctcctgctgacccaagcccgacctccctgggctctctggactggcatctccaaggacctgggtcccagccccacgtcccccctcccccatcgtggatcggcaactcagccattgcactgatgaggtttcccccacccccaggaggagtggaatgtagtgatgtcacagtcctcctaggaactgtcattactgctgcaagaccggcctttgatcttataacccagtcccctaagcattctcaccccatttctggttcctctggtcacagcacaaatttccagctagaagggaaatggggaccatgggacctaggagcaagaggtttcaggctgccttactcccttcacatagacatcgacagtgtgaaaagcctacacttcccctgtgagctcaaaacgttgacagtatctctgggtggtaatgggagaatgggtttggtttggttttctcccaggcttctactctccagagagactttaacatttttttccgagttctccacctcatattctaattctccacggttctgggaccagactgcccttcagtcagtggtctctgaagtgagatttgctcatcttctgtggaataggtcttgggaaactgaacttgacagcttgaatcttcctcatatcatctcaacttagggtacattgagtgccacaggataaatgtgggagatctttctgaagcatcagtttcccttgagtctcttgagagagaaaaaacattaatgtacttaggggtgaccctcacataggtttctaagagtataccagacttctctctgaaatgagacttgggttgtcctctttctgataaattcccagatttaacaaaaaagctgccttctgccatgaggacacattgatataaaagtttgagagatactggtgcacttcttcacactaacagacatttgaggatgtatgactctaaaccacacagcgtgtagttcatgcctatgtaatgtttacttttctacctctgcgtctggttttggtccccggcagctgctgattcatggcaaaaccccagagcttggagtcagaagactgagtttaagttccattattgcccccccacacttttttttttagccataatatccatccctctcagtcacttaagtgattgtgacaacaccttgtacagttgttggtggcattaaatcagatggtgtataagagtattttgcaaaaactgtaaggagggtgtggctgtaagggctggtagttctcatgagtattactgctcttctttcccacagctaaaagaatatcagcaaaggaagagccctggtattccagcaggagcaaagacaaaaaagaaaaaaactgacagtagccctgagacaaccacttccggtggtggccactcacctggggatgtgagtcttggctggccaggctcctggggacagggggcccaaggggcagtagagggtaattgttgagattgctgggtactggttaagaattctgggtttgaatcctgcttcttcatctgctagcgatctgatttatggcaagttgcttgagctctttgggcctctcttttcacatctgtaaaataggggtagtattgtttgacttccatttgtgaagtttaaatgagattccttattgttgttgttttcatgttaacccctagtacgtggcctgctgtaaacacccgggatacccaggaaatggtcattgctgtttgattttcctgatccccactcgcaaggggaagctgggctaatgagtacagccacttgccatcaggctgtccctctaggagtcactgaagggggcccagggtgtggtgaggagagcccaaggcactaggagcaagagaaggtctaacttgccaccagcttgctgggtgaccacagaaaaatcacttcttctgctgggcctcagtttcctcctctgtaagatgatactggataagatcagtgtctttcaaacttgttttttagctgaagtccccttagttcaagtgaactcttactcaggagtctgtttttttttaatggaggtggaggtctggagctctaccagattcatcgcccatgtcctgggcctgaggagaggggtccagtgagcgtattaagatctgcattggtcagctgactccactctgtgactgcgtcactcgggggacttttccatctatttttttcctgcccctggcaaggcagcaggtggccatttggaagaatggcacaggccatggttttaatctcctctgctcttcttcagcgtttccttttcctgaacccacatcttcctcctaccctgactttcttgcttctctctaagccacttctgtctttcaccccctgcccttgtttttcccttgtcacctcctgtagattcaggacattctgaaggtgcgggtgtccaaccttaaccactccaatggggtagtgctcccccattggacaagtggaaggtgaggcagtgccaagacccctctctggcttgctgtctacagctgtgcatggccctgaggcttctctggcttgggggatgcttggcctctgccttgttttatgttgctgccattaaccttcagcctgtttctgtctgcttcttcacctgcttgattgattgggttttttccttccccgcgtcttttattatcttggaaatggtgacgcctaaaagtttaaaagtaatctgggaataacgtacagagcaggcatgtgggatttgggctctttttttttttttttttttttttttttttgagacagagtctcactctgtcactcagactggagtggagtggtgcgatctcggctcactacaacctctgcctcccgggttcaagtgattctcttgccttagcctcctgagtagctgggattacaggcacctgccactacgcctggctactctttgtatttttagtagagatgcagtttcaccatgtcggccaggctgatcttgatctcctgacctcaagtgatccacttgtctcagcctcctgaactgctgggattacatgtgtgagccactgtgcccggctccttgctgtttttatactttctccatatacataactatttcccatgtaagtttttttttaatttctcatttttattactcctgcatcatctgttaccctgaaggatctggaagtaagaggccctgggctgaggtgcagtgactttgcaggccagccctccaacctcctctcacagtgggggctgggtgaccctctgccagctgagacagcccacacacaccccagccctaatgattgttctctctacctctccccacaatcctcttccaactcctcctctctgcatgtgcctcagagccagtaccaagaactagcagtagccctggagtcaagctcagtgacaatcagtcaactcaatgaaaacatagaatcattggtaagtccagtggggtcccctgattccatgctgccaatcctgggctttagtttccccttggggccctgaagaaaggggctgggggcccctggtgccaagggcaaatggggagctggagcacccaggcctcacctggagggaccccagagcaaggagcacgcagcatggctcttctgtcactgccctctttgccgactctctcttctccagacacccctgctccagtccttgccacacacgccctgaggttgtcacctctcagggaagcgctagcctgactggttgtcaggggccctgtatttctgccctgactcagtccctaatttgctttgagtctggacaagccacctgtcctccttgggcttgtgtttctggaggaggtagagcatcagagttctctgttagctctgagagcctgagatttaaaggcccctagaatggaaacctgagggccaagggctcctgtctgtccttttccatcctatatctgctgtgaagaaccgtagctggcccgtatgtgttcagtaaatgtttgttgaatgaaggcacctttctaaatcacaagctggcagaagggtgggccttcctgagactccctctctaggggtttatgttactgtcctttcaagagaatccagattcagacttcgagttctgtggctgtgggcaaaaaccaacaaagacccaagtcctctgtccttgggagcttgaagagggttgaccagtttgtgttgccattggttctgagaatgttgcctttaaaatccattcctggaccctgcctaccgcttccaggtctggggaatagagttgagggggccactctcagtcacctgaatttgactctccccacagaaacagcagaagaaacaagtggaacatcagctggaagaagtaacgtgatttctttgctcacaacatgactgctgggtttgggggacactcagatgcagaggcgccagtctcatcttgcccactcccagcctggggaagaaggctcacccatcagattccaccccatccccacagggtccctgataacctggtcccatgggtgggcctgtcctggggcattggtggcattctgggggcatgtctcttgctgtgccatctctgcctccctgtgataagagctctgtcttcctcttcctacaggcaaagaaaacaaacaatgaaatacacaaagcacaaatggagcggttagaggtgagtggagggtggggagctttctcctgtcctctggagaatgtttctttccttctctttcagcatttccttggcttttctcccaaacgttcaattccagacaatcaacatcctcacattggaaaaggcagacttgaagaccaccctttaccatactaaacgtgctgcccgacacttcgaaggtgggaatctgggcatcccgtcatccttcaacctggcactttgacaggtctttagggggagtcttttgggccccatctcaacctctctcattacagaagagtccaaggatctggctggccgcctgcaatactccttacagcgtattcaagaattggagcgggctctctgtgctgtgtctacacagcagcaggaagaggacagggtgagtccaaccagctgccccatcccctggcagcctggcttcccagatagaggagtgagcctaaaggtcccttctgcaggatggagtgtcctgcccagaaggcagcatggtcatttctcactacttttgtgtatggttgttagaggcagcctggggctgagtcagctgctgtgggtgagttggggggcactgtggggagtgagcactggatgcagagctcagaggccaagtgcctgccctgccctttcctggctgtggccttggccaagtcctaggtggggtattgggtagttgttctgtgaaggtacagaagagcacctttagtatgttaccatttctgtagagagaggaaaggggtgtgtgtgtgtgtgtgtgtgtgtgtgtgtgtgtactatgataatatacaaaaacatgtctgcaagcattcataaaaaactcaggagagagtaacagggtgcctggagacacctcccttctgtaccttctgagttttggactatatgaatgtatcatcctttcaaaaagtgaacaaaagattaatttcccccttcctatctgtgtccccacccccagcaagaaaaatgggcttagagaataggatagacctgggtgttcaaatcccagctctgtctaagtgatcttaggcaatcacttaaccttgaacactcgatgtttttcatctacacaatagaggtaatcctagtaactgtctcatatggtggttgtgaggattaaatgggatcgctagcatggaacctggtgaagcactccataacggttcaaacagtggtagtaataacagtaataacaatagcaatattatctgatctctctgggcctctgttagccagctgtaaattctatctctttccctctcccttccaactttactgagttcttttaataaccaggccacgggcttggaaatgccttgacctttactgaccgagttgtatattgagcctagccctagcccttttaaggggcactgcctgagctccccagatcaaaacttctcactcttcaccatccagtcctcgagctgcagagaagcggtcctccaccggcggttacagcagaccataaaggagcgggcgctgctgaacgcacacgtgacacaggtgaggctttgcagagggagggatgtggaaggaagatgaccccaggtggccaggagcaggtgaggaccagtgacagcccttcctaacttctgtgcccatttcttgcaggtgacagagtcactaaaacaagtccagctagagcgagacgaatatgctaaacacataaaaggagagagggcccggtggcaggagaggatgtggaaaatgtcggtggaggtgaggtctgacccttcagcccccactttagataggtcactggatctttctgggcatctgtaaaatgggaatagtacagccagaggtggtcatgggtctgggctttgtggagatggggacagagaatgagatggtagcctgtccagccaccagcccctctctccagggccctttcccctgtgctttgggcaggctcgaacattgaaggaagagaagaagcgtgacatacatcggatacaggagctggagaggagcttgtccgaactcaaaaaccagatgggtaagatggggctggtgtgacctcggagcaggactggcatcagaggtctgtgggggtggcttagaatgccccagggaggtgggtgggtggaagggctttgaggcagagggaaagaggtctgtgccaggagacggcaagttttgtcatctccatgagcctcagggtccccatcagcaaagagggaggagtgcccgttgtcagccacccacagtgctctctatgtgaaagtggcttggaaattggctaccattgggtgcgaggaatgattagcagtgaggccaagtttgggaagcctgagaggagctgtgcatcaagaggaggttttttttttttttttttttgagggggatgtgggtagaggggttggggaatccagaggcccttattgtctgcttcatttctcagctaagcccccatccctggcgcccccagcagtgacctctgtggtggaacagctacaagatgaggccaaacacctgaggcaggaggtggaaggtctggagggaaagctccaatcccaggtggaaaacaatcaggccttgagtctccttagcaaggaacaaaagcagagactccaggagcaggaggagatgctccgagagcaggaggtgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctggtgggttgccccacctggggagcctgccctcatccctatccctccaggcctttgtttccccacctgtaaaatgggccagtgtagccctcacatgaaatggtacttctaaaggcacctgtgagctacagctcatcgggctctgctctgatggctgtgggggagaagggatgatttttctaacctgcctccacccttcctggtgatatgggaggcagacaccaaggtctggtgtctccagctgcagtggatggccactgattgcttctctctgtccagaacaacgagaaaaagagcgcactgcagttggagcagcaagtaaaggagctgcaggagaagctagacgaggtgaaggagatggtaacctccaccccatccaagaagggctgggaggcgggcaccagcctctggggaggggaggtgccaggccaaaggcagctccagctgggaggcaggtgaccccagcaccctccagtgcagctctatgactgtttcttgcttcctgccctctgacttttagaggtgggtagccctgggctcctcccaggtctggacatcatcatcccagctagagacatggagcccccaatcataggggaagagacagtggtacaagaggctccttatccaggcacggtggctcgcacctgtaatcccagcactttgggaggctgaggcaggagaatcacttgaggtcaggagtttgagaccagcctggccaacgtggcgaaacctcacccctactaaaattacaacaacaacaacaaaaaattagccaggcatggtggcgcatgcctgtaatcccagctactcaggaggctgaggcacgagaatcgcttgagcccacgtggtggaggttgcagtgagctgagattgcaccactgcactccagcctgggccacagagtgacactgtctcaaaacaaaacaaaaaagcctccttagattcaaactggattctggcctgggttccactggtcaccattcaactactgttcatctctaagtctctgtttctgtgacttcaaaaggaagttagcattttccttgcagaggtgctgaggattgaatgagagaatacctggaaagcattaggcatgtagcacacttagcagatggtggttggctccctctgcttttccgccagtctgtggcctacagtttaaatggtgggaagaaggacatgagatttgaggctggggaaggaggtatggggttctaggcaagagaggaagcctcttaggcctggagcaagggaccagggtcctgggcaggtgacagagccccacggtgccctcgctaccctattaatgggcccagaatctggaagccagccaccatgtgccctcatgcccagggtcttcctgcaggtggagctgaagagccaagggtctcagagtctgcagcagcagcgagactagtacctgggtcacctgcagcagtacgtggccacctatcagcagctgacctctgagaaggaggcgctgcacaggcagttactgctgcagacccagctcgtggaccagctgcagcagcaggaagcttggggcaaagcggtggctgagatggccggccaaaagttgcaggagacccaggggaggcagttgctgaggacggggccccgagggggatgacctggcaacctccgtgccttctcactctgtttcccgtccccttaggagcacctagaagctgccagccagcagaaccaacagctagagacccagctaagcctcgtggctctcccgggagaaggtacaggagaccactcagaggaagaggagagagccccaggaggaaggggggactgttagcagcataggattgaggggttggaagagacctttagaacagctggtcgttatgccaaccgggtgtccgcactaagttcagcatcaatatggtgacctcctgggagcagggggccaccaggttgcctaaggatgaatgaactggaccagatcagaaagggagcaggtcaggactcccgcaccgaccggtagtgggactgtgcctgggcaatatagcaagatcttggttcttaaaaggaaaaataaagaacagcagctcactcccctctggggagaggctggctcagggttacacagtcagggtggggacagaggtaggcccacaggaccttccttgttgggttgtctgaggacccctctggccacctccctacaggagatggaggacaacatctggacagtgaggaggaggaggcgcctcggcccacgccaaacatcccagaggacctggagagccgggaggccacggtgagcctgactttccctgccccgctttgccaccttcctctgtggtccctcccagacccccttatgctcttggtttcccaccttctgattgctctggcccctcaccccttccgggagccagtggtcagacactttgtcacctgtgaccaacaggtgcactctctgaggccccaagggaaggggttgttctccacctccctgcctcatttgttctgtctatgcccctacaagaatactcacctcttgccttcaagtggcatttttcacctctgctggagccagttcccaggaggagcaggcacggctatgtgggcagcggaaggtgtgaaggctgtgctgcctgcacctggctcatctgttggccttggcctggaaggagccagaggcagaggccccagccccagggagtgggggtgagtttgtgtgtggggagagctaccgggccctgaaggaggccatggtgaagctgaaagggagtgagtcctggcatgggccaagaaaagtgggggcggggcagaacaggtcactcccgagatgtgaccccattattttggctccagagcagctttatggacctcccgaaggagaaggcggacgggacggagcagtggagagacgagagcttggattcgtccagccttctggagtgacagacggcatgagtgagcgggaggccagggcacgggcacggggagctgcagggccgtcggagggaccctagtgtctgagctgtgtcctctcacaggagagtccttcaccgtatatgaaagccagggggcagtgccaaacacgcggcaccaggagatggaggatgtcatcaggctggcccagaaggaggaggagatgaaggtagggcgtgcaacatctctgcgggggtgggggtgggcatgggcgctggtgcaggctccagggtgggagctgagcacccctcccttcaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatggtgagtagagctctcaggcggggtgggcaggcaggggcaggggaggctcgcactgtgctcagacccccgcctccctctctctgaagatttttatgaagtgagcctggacaacaacgtggagcctgcaccaggagcggccagggagggttctccccatgacaaccccactgtacagcagatcgtgcagctgtctcctgtcatgcaggacacctaggagcacccaggcttgcccagcaaaccctgcgtgccattcttctaccaggcagccgagaacagggagataaacatcatcatcttctaagagctgatcaagaaatttaaaacaacaacaacaacaaaaagttacggggttcatctcctacacaattcatttactccatttgaatgctagagccactcacatttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctatgacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgtactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacatgagtatatgtcccagtacacaaaagggcactggttggcattcttcttaaggtatttagtgaagatcataagaaatcctttaagagtttaaatgtccctggaagaggcatacaggctctagtcaagaatgaattcgagtgaaggaaagctgtgtgacacctggccttcctctatgttcatggagcttctttgaggctagaagattgattttatcatctagacctctctggctaatacctattcttcagccacattagttactctgacgtaggaatttacttcttttctttgaatggaaaacactttaaaaataataacaaccattattataaaccaatatatgtgagagtacttagttgaaacaaaaaggagttttagtagacagtattatactacacatgaaaatcaaggcgaagtttatgcaacttaaaatgtttacaagctgcagtgcaatctaatgtttgcgaatgtccaagtattatgagaaaaagtgtctatacaatgacagacttacgtttcctcacaaagttcttcacaaagagtgaaatatgtttttatacctctcagtttcagttagaggcatattttgtgccatatttatgttaatgtgcctatacgtgatgagtgaattatttcagtcatacattgcctaaatcataactttaagatgcttgggaaagaatcaacagctaaaagttcatgaagttctaatgtctgtgttccaaaatacgtcacagtattaggatgcagggagagatgtgtgtgcgctccctggggtgggcatttctagttactagaccatctccatttttagcatttggcatcctcatgatacttttatacatatgacgttaataggagagcaataatacgattttacagatggaataacagatgtgcctgcattcagtgaaagagtgcaaatattaagtccttgtgacttcaactgactcttccaaattgtatgaatttatcaatgtattagataaactcagttccagaattataaagaaaaactgttagaccaacgaatgtggctaattaacagtaggacgatttctagcccgagggtttaaaatggacttcaagtcctgttcttgccttttattttctgaacttgccacttttgcattctttgagttcagtttaaagacagtttgagtccaatttagaccctcgggctagaaatcataccactgttaattagccaccttatttggtctaacagtttttctttataattctgaaactgggtttacctaatacattgataaattatttcaaaggtatttttatagttcaaatcacttcacttttaccctgataaatataaatgactaggaatgatcttcagctagcctttagcacctgcaaccaatcggacaataatgtgttcatcaggtacctgtggattaaatcacacaccggcatatttaagctgaatgtcagtctggaaaatgaatgtactatattaactgaaataccactctttgtgtaggtattctgtcatatatttaagaaaaattaaatagcatgtaaatcatataacaacaacttaagtctttcttcaaagtgcatgtggtcctttgcaatacctcattcagccaagtatttgttctcttcctcattcagtttaaggcagctttcaatttgcttagaaggcaacattagaagggtagagtttaatcagaaacatagaattttaaagtgtgggttcaactgaataaatttgaatttctgtaggaagtaaagaattaaaaatctatttaaagattgcaatatataatcatttttaaagtatttgtttaacctgatgggttttccagaaatgaaaacaagtcagttctaaaaccaaagctgatatttagaaaatgtgaaaatgtaaatcagccctatccataatatagtttctctaaaactttatcttaaagagtcattttaaaagaatataactattcataagtgtaactgctatcttaatgttttgaaataagttaaaacactttaaaatatgaatactgtagtttgaaagaaagaaactgggggaaggaaaagtagagaaagaaatgccaattccaatgcaaggctttatttgccaagttttcttagaatgacttttaccagtttatgaattcttgtaaacagaatgtataatagaaatactgaaacactgttgcctaaagtggcattgttgactgctactgtgatgctactgtaatgtaataaattattaaatggttgcaaagtgctgtttttgccttaaaattttgtgtgtcttgaaaactatagtattacaggtattgagactgtgcaaatgctgggcacgcttggcatgagataatcagtttttatttttacaaaattgtaattaactatgcaagtgtgtttattaaaagaatacaaactaaaaagaagttatgggatttagaaaatgttgtaggatgaaaaagttatgggataaaaaatgtggaaaagtcgtggcaaaaaaagttgtgaaaaaagtatttaaagttttatgaaaagtttaaaaaaagtattatgaaaaagaagttacgggattaaaaaataagtcatgggatataaataaaaataaataaaagcaggcctctgtcagcataagcctggagaagtggggctggagtctctgccgccatcgtgtccctaccatcccttcctacccctttatcattagggtagcaagacaagacccctgtctaatggggggagacaaacagaccctttgccaccttgaccagggctgagtccttaaatttctggatgatgatgattgttatttaagagccagaggctggtggagtcggtttgtttggaggcggcctgatggcctccctaccctcaccaaagcaacttttccctcagggggctcccatcttcttattcagagaggcagctgaggcagggacaatggggctaactgtagagcaggtgagggcacgggctgctgggaaggccccagtgtacatatagtatctgtgtaacattttgtatattccagggggtagggccaccccctgtatcgtacctagcagaggttggagctggcatatgaggaggaggttctaatcattatttgtggctgggaaacttatttattgatagcatggggcagaggaaggaggcggggatggggttgtggctccctggtgatgcgactcctgtttattttgcctttcattttggaataaatggatttagccatactgctcagcctggtgtgttcctttttccctcactgggtcctggagtttgtgccactgaatgaggagccccagagttgtctgagcatgtccagctgggctgttggtgaccttccaggcctgttacctttatgctgcctagtgacacctggtggatttcattgggactgccatggcgcctatggggcacagtccagccctgacagccaacaggctcagaagcctgatctagcggtggccgggaagacagatactagcacccaagggcactgacttccattcaccccaggagtcttccattccgtccccctccctccttctcctgtctgcactgggtggcctgttctgtctgtccctccagtgcacctggtgacctgttctgtctgtccctccagagtgccagctgccctgcaggctcctcgaggctgagttcatggccctgcccctagtggccagagccggcttcacaggataacagccagctaagctccaggggctttccaggaaaagtgtcccttgaaaagggtgtggctttttcactgctcccaacagcaccctagaaatggcttggccttttccctcccctgagttccaaaaagaacacagccagcagaggacacattccctgacatacgagggactggaagactggtagagatgtcaggtcacaggctgccagcacagcacccccatgattggccacgggagtgctggaggaatggtgggggttggctgtccactggctgggcatgacagggagactcactggaggtggtgcactttggaggggcgatgtcagggatgtatttgggtctcagtaaagagatctgttctttttaaatttctgcatctagttgcctatacgcgatgatgacacatagcaacttattttttactttctaaagacaggatatcatgcaaagagatcaagctgcccttctataaatataactcaattgccttccagccataggctgcatgcttcaagttgttttcagaaataagaaatgggttgagctgaaccacttatagccttacatggagagttcccactgtgacctgtagcacatgtgaattgacttgcttaatgtatgaaaccaatggaaatgagatgaaaagtcctattctcatgcaagcccgttgggttatgcagagacacagtagcagagacacagccctaactacagcctgccctccggaaaacatgtgtctgttcatatggaaatgacacaagtctagtgcttgtctgaaagtcatgcagcaaaacaaaaaaagtctctgcaaaaccggggagagttttttacaatgactttaactttgagggtgctctttagcagaggcttttgataaaggaagaattctatcaaccaggatcactgaggaggaatgaatttataactactctttttaaggctagaagagaccttaattaaattccttctatttacaaaggagggaactgaagtccagaaatgacaaaaggtttggcagctttagaaataaggcaacattgagtttcagtattctaaacttttggaaagtggtaaaaatgaaggatattgaacaaaaaatactagttgttttttttctatcttgttcagttagtgtcaacatgctgtaagttttcataatttttttttttttgagatggagtttgactcttgttgcccaggctggagtacaatggtgcgatctcagctcactgcaacctccgcctcctgggttcaagcgattctcatgcctcagcctcctgagtagctaggattacaggcatgcaccaccacgcctggctaattttgtattttttaaatagatagggtttcttcatgttgatcaggctggtcttgaactctcaacctcaggtgatccacctgcctcagcctcccaaagtgctgggattacaggcgtgagccactgtgcccagcctatttttttttttttttttgagacggagtcttgctctgttgcccaggctggagtgcagtgacgcaatcttggctcactgcaacctctgcctcacaggttcaagaaattctcctgcctcagcctcccgagtagctgggactacaggcgtacactgccacgcccggctaatttttttttgtattttagtagagacggggtttgactgtgtggcccaggctggtctcaaactcctgagtttaggcaatccacccacctcagcctcgcaaagtgctaggattacaggcatgagccaccgcaccctgcctggttaatttttatgataataaaaatattctcataaaatttgggaaattccaaaacctatggagaagaaaatttaaattattcatcatcccacaatttattcatttgcttatttgagcaacaaataaaagtgcacaccttattaagagcagggcatgttccaagactgactatccagaaatgattgatagcctctaactgattcccttccaacccatttctcagtgcactactactaataattttaaaatcagattatttagttttgaaatctccttttcacctaatatatcataagccttttcccaggttatcaaataatattccaagctatgattttaacagctgcataacgtcacatcatataaatttacactgatttattaaaccattgtacttgggacataataagatgatcaatttttcaatattataaataatgttgcatgtaacattctttggccacatgcctgattatctttgaaaacttccctagaattcagattgttagatcaaagccttaaatatttttaaggtcttaaatacacaatactcaactgctttcttgaaagactgtaatagttttacttctaccagctacaagagtgtctttcagtcatgcaacaaagcccacacctcaaaacaatgagtattagctttaaaaaagtcattgtcaactgagttcaaatggtttttcctttaatttgcagttcttacttggcaatggttaagtcaaactttccaaaaaaaactttgttctcttttttcataaattatatatgcatgctttttgtcattttctatggaactgttaacatttcttcttagcattctagtcttaatatttctcagtgagggatttttctgactgcattctgagatctaggctcctggctggggcagcaagaggtgggatggagaaagggcggggagtcagagtcaggcttgttctcttagtccttccacaatcaccaaggtgtgacctgggccaactcttggtatctctgggcttcagtttcctcctctgtaaatagaagggtcttaattaaggtcccttccagtcgtataaaagggagttagagatccgtagtttcaaagcttctttcactatcatgatttgtgatcagctttgaaggaggtagtgctagtgggtaaacatcaaaccataagcttgtttgccagttctaacctaccactaccacctaccactgagaaaatcatttcaaggctcttagtttcctgatctgtaaatggaaacctcgttttacagatttgttgtaaaaattatgtgaaataatagaaatcaggccaggtgcggtggctcacacctgtaatcccagcactttgggaggctgaggcgggtggatcacctgaggttgggagtttgagaccagcctgaccaacatggagaaaccctatgtgtactaaaaatgcaaaattagccgggcatggtggcgcatgcctgtaattccatctacttgggaggctgaggcaggagaattgcttgaactcaggaggtggaggttgcagtgagccgagatcatgccattgcactccatcctgggcaataaaagtaaactccatctcaaaaataataataataatagaaatcaaagtgtatagagcataatataccacagacaggcaggatgcagtggctcctgcctgtaatcccagcactttgggaggccgaggcgggtggatcatctgaggtcagcagttcgagaccagcctggccaacatggtgaaaccccgtctctactaaaaatacaaaaattagctgggcatggtggtgagtgactgtaatcccagctacttgggaggctgaggcaggagaatagcttgaacctgggaggtggaggctgcagtgagctgagatcgtgccattgcactccagcctgggcgacaagaacaaaactctgtctgaaaaaggaagaaagaaaggaaggaaggaaggaaggaaggaaggaaggaaagaaggaaggaaggaaggagagagagagagagagaaagaaagaaacaaagaaagaaagaaagaaacaaagaaagagggaaggaaggaaggagaccatattcatactagtagctgcttatgactaatagaagtaaggatgaggattagaagggatttcaactttataatacattctttcctttatataataataatgaaaaagacagccagtcacagtagctcatgcctgtaaccctagtgctttggctaaggtgggaggatcatttgagctcaggaatttgagaccagcctgggccaccgagcaagactccatctctacaaaaactttaaaacaattagccatgtatggtagcctgtgcctctagtcccagctactagggaggctaaggcaagaaaatcatgtcagcccaggatgtcgaggctgcagtgagctatgctagtgccactgcacctgcactccagcctgggtgacagagtgagaccttgtctcccttttaaaaaaaaatgaagcaaatataacaaaatattaacaacagtcagtgttgattctgtggtaggaacatagttgtttgcaagatcatgctctgtacttttccgtatcttaaaaaatttcctggccaggtgcggtggctcatgcctgtaatcccagcacttagggaggccaaggcaggctaatcacgaggtcaggagtttgagatcatcctggccaacatggtgaaaccccgtctctactaaagatacaaaaaattagccgggcgtgatggcgcgtatctgtaatcccagctactcgggagactgaggcaggagaattgcttgaatctgggaggcagaggttgcagtgagccgacattgtgccattgcacttcggcctgggcaacagggccgaagttgcactccagcctgggcgacaagtgcagcccatctcaaaaaagaaaaaaaaaattcccccttcccatacaaatatgcctagctcataaaagcaatcctaaaagattacatacagtatgtgtgtaattttttacttttttcttatttttagagtttattaagcaggggagtggagggaagatgtggcacaaatagaaatatgtaacattcaaacaacagaatctgggatttttgaaaaaatctttcagttatggttacaggaagggtcacttcctcccccaacgacacagggacctctcaaaggagaggagagagtaagtcccatggtagggccagtggttgctcctgggttttggaatgatttctgcagagttttcaagaccctgggctcagggtggagacttcatagcggtggcagctagacccagcaagatggctgcaatggtgaagccctgggcggcgatctgggtgtgcatcataagccgtgaacattggctgttgccctggtggaagcagtagaggccgttggtgaggacggccgccgtgcacaggaaacctatgggtaccaccggattctcgcgggtcttgcgaaggaacttttccttgaaaccctctggattgctgtaaacagtggggctaagcccctcaaagatggggggcttcgatgattcaaagggggcctccggagtcacaaagccgagagtcgccatgcctaggccacagctgcaggagaaaatcctttgtttttttttttttttgagaaggagtcttgctctgtagcccaggctggagtgcagtggtgcaaccttggctcactgaaacctctgcctccctggtcccagttaaagcaattctcctgcttcagccttccaagtagctgggattacaggaacatgccaccatgccaggctaattttcatatttgtatttttagtagagacggggtttcaccatattggccaggctggtctcgaactcctgacctcatgatctgcctgccttagcctgccaaagtgctgggattacaggtgtgagccaccatgcccagcctacatgttttatataatgttatttgatataacaacttggaaaggacaaaattatagaaatggagaatagattagtggctgcaggggttaggaatggggaggtggtgggaaggaggtatatgtttattaaagggtaatgacagggaggcttatggtgatggaactcttcgtatgttgactatggtgacagataggaaaacctacacgcgtgacaaaactgcacagaactaaatacacacaaatgaagtaaaagtggggaagtctaaatcagattggtggactgtatcaatgttaacattctggctgtgatattacacaatagttttggaagatgttaccatgggataactgtagaaagggtatatgtgatctgtctattatttcttatgactgcaggtgaatctacaattatctcataagaaaaagtaagaagaggccaggggtggtggctcacacctataatcccagcactttgggaggccgaggcaagcagatcacttgaggccaggagtttgagaccagcctgggcaacatggtgaaagcccatctctactaaaaatacaaaaattagccgggcatggtggcacactactcaggagctacacaagaggctgaggcaggagaatcgcttgaaccccggaggcggaggttgcagtgagctgagatcacaccactgccctccagcctgggtgggcaacaacagcaagactgcaagggaataatgttctgtttgggaaagagactgcatgtaaatagggggtctggtaggtgggcatggtggctaacacctataatcccagcaccttggaaagctgaggcaagaggatcacttgaacctaggagttcaagaccagcctgggcaatatagcgagattctgtatctataaaaaatgaaaaaattagccaggcatggtaatgcatgcctgtgatctcaactactcaagaggctgaggcaagaggatcaattgagcatccagaagttgaggctgcagtgagccatgatcatgccactgcactccagcctgggcaacagggcaagactgtatctctaaaaattaaaaaaaaataaaataataaatagaacatataaaagtaaataaaaattaaaaatagggatctggagctggtagggaagaaacagagctgtatgggagaaaagaatacttttccttgttgatatatggtctgtgtcccctttttctcctcttattttcttttgcattcttgctctgattgacttctttctcaagtgcctcttctctctgactttccctgtgtcattattttcctcaactcattattttccctctttgctttgctaaaagactctatccctgcatcttattcagagcacactgactgcactggacaggagttacaagagggaagaggtactcatagaatcctggatttctaaaacacttaagctacaaaggttggtgaatatcagagtccaatagtcacatattacacagaggaaaactgaagtgctgagaaaggaaataacttgtgtcactcacagagggaatttttggtaaagttggaatataagcctgggatccactagaacagcttccctaattttcttttcttttttttttagacaggttctcactctgtcacccaggctggagtttggtggcatgatcaaaactcactgtggtcttgacgtcctgggctcaagtgatcctcctgccttagcctcccaagtagctaggaatgcaggagtgtgccaccatgcctggctaatttttttgtattttaagtttgtagagatggggtctggatatattgcccatgctggtctcaaactcctggacacaagtgatcctcctaccttgtgctcccaaagtgctggaattagaggcgtgagccactacgcctagccctagtttctataattttcaacagacggagctcactagttggagaaaaagagattcctgggggcagccaattaaaacatagagaaattagagcaacatggtgagagaaataatctgatcaggtgcagtggttcgcgcctgtaatcccaacactttgggaggtcaaggcaggaggatcacttaagccttggagtttgagaccagcctgggcaatatggcaaaaccccatctctacaaaaaataaaaaattagctgagcatggtggcgcatgcctgtagtcccagctactcaggagtctgaggtaggaggatcgtttgagcctaggaattcgaggctacaatgagccatgattgtgccactgcatttcagcctgggtgacagagcaagagactttgtctcaaaaatagaaaagaaaagaaagaaaaagaaaaggaaggaaggaaggagggaaaagaaaaaagaaaaaaaaaagaaggaaagaaagagggcagccaggcgtagtggctcacgcctgtaatcctaggactttcgaggtgggcagatcacctaaaatcaggagtttgagagcagcctcgttaacatggtgaaacctcatctttactaaaaatacaaaaaattagccgggcatggtggcacactcctgtagccccagctactagggaggctgaggcaggagaatcgcttgaaccaaggaggcagaggttgcagtgagctgagattctgccattgcactccagcctgggcaacaagcacaaaactgtgtctcaaaaaaaaaaaaaagagagagagagaaagaaagaagaaaaagatgcagagaggggaagaggaaagaaggaagggaaggaaggaaggaaggatatagttattaagtagttatgagccagaattataaactagccagatggttttgtgataggatttgggtagaatgaaaatctcaagaggttaaattcctaagaggcaactcttctctcttactaactatggattattttaaatgcaccagatacccctcctcaagatgtaatattataccataaatgttatggggagaaactgcccaaatgaacagaccagcgctcacactgagaacaggaatagggagtagcctattttgagcctacctttttaaaaaacacttgcattttgggaaaatataaaaaaaaatgtccaacagggttgtcctgttggtaccaaaaaccttcagaaatttcagagtataggatgttggtaagaagcaccaaagcagaaagtacctctttctgcatgcgagaaaccatcatttatctgagagtgatgttccctaacacaagaaagggtctctgttaagcaagtgaggggtggaaggagctgttgccagagcccgccagaagcatcctggtaaccaactgctggtccaaacatttcctacttacatggaacagtggaaagtgccaacagagttctcccgacgaatgtcttcatattcctcatagattccctgcttttgcctgggcaaaatagtccatcaaccaaagtttaggttttctgatcttcttcccattcttacccagctggtggagtctacagcctatttcaggtttgacctcagtagctagaggaaaagtggttaaacaaaataaagaagttagaagctgatttacctttaaaaataacaaacttaagttcttgtctacagtaagttttatggatcaaaaactattctgacttcttatctcaacagatatcctacacatatctcacatcagcatatatatatgccttttagaaaattctgttattaaaactcgaaggaaaaatgagatcatgaataaactgaacatttttaaaaaattatctttcataacttttcaatctaatatctgtgtattataatcatttattgtttcatgtactaattcatctatgtatttaccaatcaataaatataatctgatatgcactatgataaatgaggtcaaaaaaaaaggagataccctgatccacacaggatataaagatgaagggctgggtgcgttggctcacgcctgtaattccagcactttgggaggctgaggtgggcagaccacctgagctcaggagttcaagaccagccaggcaaacatggcaaaaacctgtctctactaaaaatacaaaaaattagctggccgtggtggcagatgcctgtaattccagctactcaggaggctgagcctgaggcacgagaattgcctgaactcaggtggtggaggttgcagtgagatcgtgcactccagcctgggtgacagagtgaaattctgtctcaaaaaaaaacaaaagtgctgtattgaggactgagacctgagatagtgagagacagggatgtacaacttgagtcatactgtggactgacaggatgggaatagctaagggactgtctgaggtggggatgcctgtctggttcacttgttactgccttgtttatgtgacttagatagtacttagcttccgctgttgatactcagtgggagatacacctaaaccacacagacagcattattctgaaaaggagaagttgccagggagtgtggaccagtagtctccgtggccctgtactctccaagcagaagtgtagacttcttcttccctgtgactagccttcaggtgtaatttccagtacatagttccttataaattctatagctcaggagaataaataagaggctccttttccagaaaatccagtattggttttcctcctttggaggcgtagagtcagaactctcatggcatggcaggatccatggaggtggccacatctcccttttttcagtgagtattagatcccacaagacaaccgcacagctaaacataattaaaacttaggttttatgatatttgttcctttcctaaaaccttcagtgactccttattatccatagggaacatataagctaaataaatgtgaacttttttctccaagcaaaacattctccccagtgaatagaaaatcttgttttcctgtgttaccttgaaccaaaattttttttttttttttttttttgaggcaaagtcttgctctgtcgcccaggctggagtgcagtggtggcgcgatctcatctcactgcaacctccacctcccgggttcaagtgattctcctgcctcagcctcccgagtagctgggattacaggcgcctgccaccacaccttgctaatttttgtatttttagtagacatgaggttttgccaggttggccaggctggtctcaaactccggacctgaagggatccatctgcctaccttggcctctcaaagtgctgggattacaggcatgagccaccgcacttggactcctttaaaattattattattattgagacagagtttcgtgctgttgcccaggcaggagtgtggcactaccttgattatagacgcaagtcactgggccttgggattatagacgcgagtcactgggcccagctttctttccagttttaaagtattatttttaattatccaaactaaatgtgtagtaaatactcttcttataaatctttgttttcttgattgcttccttagcatataatttcagaaatagaactgatcaaagggtatgcacatttttaaggatttataatgccagatgccttccaaaagatgttaacaacttattgaactgacagtatataagggtgctatagagtaatttatttatttgaaaaacaaatctttattgtgtagaaatatgtattttaaaaatcccccagaaaagatgctcttctctcatttccccatcctcttccttttcttccacacctctgatatgaaggacattattataccttattaaaacttcatccacactaggcatggtggctcatgcctgtaatcctggcattttgggaggccaaggcaggcagatcacttgaggtcaggagtttgagaccagcctggccaacatggtgaaatcctgtctctactaaaaatacaacaattagccaggtgtggtggctgacgcttgtaatcccagctacttgggaggccaaggcacgagaatcacttgaacctggaggttgcagtgagctgagatcgcaccactgcactccagcctgggtgatagagcgagactctgtctaaaaataagataaaataaaataaaatgaaaacttcatccagatgtctagacaacactttaactatgtattcttctgtatttgcaagttacatgttcatatagccatctacagataccagttagcctttgtaatccattccccacttaagtttcaccatctactggcttttctgttaatcccttgaggaaaggtttggaattgaggagtaaatcctttataaggagaatgctgcagtctattcgctattcaccgctgaccaagctgccacctggccctcctgactgcagcaggcacccccagacagtcatgtaaatggactaggcctgagtctgtagttctttgctctgaaaaaggagacgtaatggcttctactttttatcatttggtggaaataatagaggagtttttctagaatgttttttgatctggtggttaaagggaacttggacatttagtccctgaaataaattgttgcatctttgaaggaaaagatgaaagtagtttcttacactttagtgaagaagcctttggaaaattttgttctggatgttgtatattctctgtagaggagtgttggggattccccacatcagcagaactaaagggtaactgaagagaacagggagtgacatgtcagattgagaatcagtcttttgaaagtggcaaaaagaatatgtgttaaaagaaaaaatagggtagaagataaaaagaatagggcagaagatattagcttcaattcctccttttttttttttttttttgatcctttggaatgatttcttcctagactgccagtgttgcgtagtaaccccgcccatgaagaggactggaatactgaaaaactgcatgaaactaagcgctgtgggttgggcggggtggctcacgcctgtaattccacactttgggaggccaagttggctggattgcttgagctcaggagcttgagaccagcctaggtaacatgatgaaaccccatctttacaaaagatacaaaaattagctgggtgtggtggcatgaagctgtagtcccagctactcaggaggctgaggtgggaggatcacttgagcctgggaggtagaggctgcagtgagccgtgattgtcccactgcacttccgcctgggcaacagagcgagatcctgtcccaaaaacaaaaaaactaagcactgtggattagaaattaataatttttcatctttatatctttttttttttttttgagacagtcttgctctgtctcccaggctggagtgcagtggcacgatctcggctcacttaggcaaggtgtttaattaatctctgaaaagtggagaatttagcaccaggcatggtgactggtgcctgtaatcctagctacttgagaggatgaggtggaagtgttaaaggtggagggtgtccaggttcttggtgtcttgaaaaaagaattggacaaaatgcacaaacaaagcaaggaagggacaaggaatttactgaacatgaaagtacactccagtgtgggagcgggcctgagcttagaagttcagtggctccgttacagaattttggggagtttaaataaccccagaggattccatggttacttcgggtatgccttatgtaaatagagaagatgaagtaaagttacaaagacatttatggcctatgccctatggacagaatattacctgttatagctgaagtgtgaattggccttatgttccctacctccagaccctattttcctgcctcaggaggattacttgagcctaggagttcaagtccagtctggacatcaatagtgagacccctgcctctgaaaaaaaatttttttgagacagagttttgctcttgttgcccaggctggagtgcaatgggatgatctcagctcactgtaacttccacctcctggattcaagcaattctcctgcctcagcttccctagtagctgggattacaggagccggccaccacgcccggataattttttgtatttttagtagagacagggttacaccatgttggccaggctggtcttgaactcctgacctcaggtgatctgcccacctcagcctcacaaagtcctgggattacaggcgtgagccaccgagcccagcaaatttttgttttttagacggagtctccctctatcgcccaggctggagcacagaaatgcgatctcggctcactgcaacctctgccgcttgggttcaagtgattctcctgactcagcctcccgagtagctgcgattacaggcgggcaccaccatgcccgactaattttttgtatttttagtagagacggggtttcaccatgctggccaagctggaaaattttatttttaataaatgaaaggcagagtatttatctgaaaaaagtgggagaccaacagtctcatgggattgttataaagattaaaagagagagtgttactgaaatacttagaagagctgttattctattgctgtcctttccccttgtatttggatagattaccgtacttgtttcttctatgtaactctaattgtcagtggggttctccctctcttagaggcctggagaaacttgtcttaaatgctttcccagttaatgaattgggagaggcagattttatgtctaaattacaagggcgagacttaaaagtatgaattggggctaatgtcagtgctcaggtgcagggatcctccgttttgttcatcacacagctcccggcactttaataaatgaggctcaaagaaacgacgggcttaggtcatgcagtagtcaaattcagaactcatgtttgattccaaagcccacacgttttcctagtttagaaacactaaacatttaattcaccgcaccgggggccagacaggtaatggagaacgccttaagtatgttaggaagggaagttatctacagtcgcagccgctattcagatctatttcactgccttgcagaaaacgccgactgtcgtctctttatcccatggccgatttcttgtgaaatctcctaacttttaaatatttccaatcaaaagactgccgttcaaatgcagcccaccaggagcatgtttgcaaactctggagtaaacaagagtgggaagctgataaggtgagtacctcagttcgatagtgacagccaagaaacggggagttttgtacctaaggcgagaaagaaattctccgccgaaatctcccggaagaaggactgaattaaatgcagattagagtcagggcagggtaaggtggcgggagaactaggctgccatcccaggtggctggcctaccagccagcgcggccggaggtacagaccatgtacagaccacggcgaggggtgttaggggcttctcgggataaaggcagcgagtggctgcgcattccctccccgactctttcagaggtaagccttctgtggagcagaccctaatcctccccctgattccttaggtcactcggcgatttacttccttcccccgcttcctcacagtcctccacagccctacgacttccgcttgcctcgtcgtctgggaaaccgccgacttccggccgcgcagcggtgggctgagctaaaatggctgaggagagagtcgcgacggtgagcgccgagattctctttagttgcccggccgcagggcaaggcaagctggcgggtggcttttgtcccatgcagcggttcctggagagaggcggagctgggtgccgagcgtctcagggtgggcggggcgacacggtcccctttttactgtcccgggaactggtcgcctggggcaagtctggatacttagcagcacaggtcctgttctaggactgtagtccctcttggggtgcgctggacggagaagggagacttttcaccagtaatggctcttaccgtagtgccatctttttctgtctcgggggtttggaaggtaatgactagcacttgtgtagacagttcctgttaatcccgtgaattgggaatttaacatgcctggaagcttgcagcgtcactgccttctgccagtggagcgggactgtgttttttctgtggtgattaagtttaggaaagtacggttttggaattcatctgaaggctgagttgggcgttcactccacagaactgctaatatagaggaacccgatgaattcaggatgacctagtcgctattttttgaggcatatatctataattggatctaatttcggtaaagtgccaagtgtgaagctttgtttaccttgctttagtgttgggtttgaaagcctgttctgtccatttgttagaatgattttaggtattcggaatttattgtctttcgaaaaacgccctggaaaacagtacaaatagcagcctttggctgttttacaacttagttttggctaagcagcaaggttagtgttattgttagagggccttttgtttgttttctactctcatttgcagagtagtcatattattctagtctaattagaaaactctgaagacagaaacttttttttttgagacggagtgtcgctgttgtcggcccgggctggagtgcaatggcgcgatctcggctcactgcaacctccgcctcccaggttccagcaattctcctgcctcagcctccggattagctgagaatacaggcgcctgccaccacgcccggccgaaacatttttattaagctaagaaatttaaaatagctaggccggacgcggtgcatcacgcctgtaatcccagcactttgggaggccgagacgggtggatcacttgaggtcatgagtttgagaccatcctggccaacatggtgaaaccccgtctctactaaaaatacaaaaattagcggggcatcgtggcgctcgcctgtaatcccaggtacctggaaggctgaggcaggagaatcgcttgaaccccggaggcggaggttgcagtgagccgagatcatgccattgcactccagcatgagcgacagagacagactccttctcaaaaaaaaagaaagaaaaaacagattttaaaataattaaataggccaggctcagtggctcacgcctgtaatcctagcaccttgggaggctgaggtgggtggatcgcctgaggtcaggagttcgagaccagcctggccaacgtagtgaaaccctgtccctactaaaaaaatacaaaaaattagctggacgtggtggcgggcgctggtaatcccagctactagggaggctgaggcaggagaatcgcttagaacccaggaggcagaggttgcagtgagccgagatcgtgccatttcactgcagcctgggcatccagagcaaaactccgtctcagaaaaaaaaaaaaagtaaatagcatggttaatgttactgggttttaaatattaaaaacataggaaagaaaatacttccactccagcctgggtgacagagcaagactccgtctcaaaaaaaaaaaaaaaaaaaaaaagaaaatacttctaagtaatcttaaagtgtaaaagataatgggtaacataacattgctacaaatatagcttatcctctagtgctcatcacaagtgtttgtgtaatagaatatgaacttgagtctgtgacggcagaattgtcatgtacatttgaatgtctaatactgttttaaagagaatagcttttgtttcgatatgacttagcaattaagcctgaagttaactgttttcattgttgtcaaatttattgctagtagtgttacgtttatagtaattttcatcttttcaagttaccaatgcatggaaatgtgaatttctgtccttttaggaagtggtattttatcttttttttttttttttttttgagacggagtctcactttgtcgccctgtctggagtgcagtggcgtgatctcagctcagtggaacctctgcctcccgggttcaagtgatttttctgcctcagcctcccgagtagctggggttacaggccctcaccaccatgcctggcttatttttgtggagatggggtttcaccacgttggccaggctggtcttgaactcctgaccttgtgatctgcacgcctcggtctcccaaagtgttgggattacaggcgtgagccatggccccctgccttattttttaatacaattaaaagaacccagtaatcctactcctagacctgtgtcccacagaaaaaagtgttaaacatgagcgtgtagtactagggcattcgttgtagtactatccgtagtggcaaaacgctggaagcaaattaaatgcccattaatagggtaattgatgacttcagatatttccatactgtggaatattatgcagtcattaaaaagaatgttacaactaattgcttttcctctcagaagcccctctctctcactagagaaagctgttctcctttctttcttctgcctattaaacctccattcctaaactcagaaagaaaaaaaaaaaaagagaatgttacgactaattgacttggagggacttccatggtgtacatttaaataaaaggtagatgtgaagtggggtatattatgtgatcttaatttcataacacaaaggaaaacatatagatccgtagataaggatatatggatatggaggagagaaaaggaaaagactcaaaactcacagaatttttgaagaaatgtatagctaaaaatctaagaaggctacagtcaaggccttgaggccagaagacaccccatcaaaactgagtaaaactagcccagtgtgggacgcagaaattctagtatgctaccaaaattacttacggattgctaccagttccttagaaggaaaactgaggactaatatttgtattttcagtatagtttagaattcttaaaaaatgagcaaacaggctgtacttggtggctcatgcctgtaatgccaggacttgtggaaactgaggtgagaggataacttgagtccagaggtttgagaccagtctgggcaacatgttggagccccatttctacaaaaaacacaaaaattagccagacgtggtggcacgcgcctgtcttcccagctactggggaggatcatctgagcctgggggaagttgaggctccagtgagccatgatcatgccactggactccagcaggggcagagtgagactttgtctgaaaaaaacaaaaaatgaatgagcaactaactctggctttcatgatttgtgcttataaatctttttatttatttatttatttatttatttatttatttatttatttattttgagacggagtcttgctctgtcgcccaggctggagcgcagtggcgcgatctcggctcactgcaacctccgcctcccgggttcacgccattctccagcctgagcctccggagtagctgggactacaggcgcctgccaccacgcccagctaattttttgtatttttagtagagacggggtttcaccgtgttagccaggatggtttcaatctcctgaccttgtgatccgcccgactcagcctcccaaagtgctgggattacaggcgagccactgtacccagcctataaattttttttataatgccctgattcccattatttgatgtatttggataaatatgtcatcctgtaaattgaaggattaaactgataagagcagaaaacagaaattagtacactagttgatctggctcagatatagtgcctatgtatcaggtgctccatgaatatttgttggatgaataaatgatcataaaactatataaaaatgaagaaataacagaataaaataatttgttctatataaatcctatgaatgagattgagtgggctaatagaatcctttccatctcaaaatgttctggaaagtcttgagtaaaagactcatcaaaaaaataattctgctttgtgcagaaagaagggttgctgacctttgaaggtgctttttgagtctttaacattctttagtagtatattccccaaagttaagaaattctagttagattttaaaaaattgagttaacatttaaaaaacagttttgttgaggtataatacacgtaccataaaatttactcaatttaagtacaaagtttgatcagttttagtaaatttatatagttgcacagctgtcatcagaggctgcttttaaaacatgtccatcactccagaagggttcctgtgtcaatggaattgctgggttatattgtttaagtatttgtttaaaaaaacagaaacaaatctgcctaacttctgcaggctatatacgagttaacatttccatgagcaatgcatgagggttgtgatttttccacatccctgtcaacacttggtttgtcagtttgtttttatttagctgttgtagtggatgggtagtgatggtgtatggtggttttaatttgtatttccttcatgaataatgatattgaagattttttatatgtttattttccacccgtatctctttggtgaaatgtctttataaatttttgtgaatttttaaatcaagatcattaaccaaatgagcccctcatttgggctcaagtgatccttccacctcaacctcccgagtagctgggaccacaggtgcaggccacgcttggctaatttttgtatattttgtagaggcggggttttgccatgttgcccaggctggtcttaaactcctgaactcaagcaattggcctgcctcacataagtattctcttttattttgaggattaatttttgttgttgtgaaatatatcctacctgtaaaagagtgcttaaaatgtcgtatgtgtgctttaaaggataatataatggaaacttgtgttcctactgcccaggttaggaaatgggttattaataactttgaaacctcctaaatgcctctctcctactgcattttccttcctccacatcagatgtagtgtttcttcaattttatattaatattttgtactttttatagttttaccatatatgtttatatatatccttaatatattagtttttaaaatttgttattaaccttcagtttattcattatttcaacactgtatagtatcttattgtagtaaagtatgtcaattaacttatccattccactagatggagatcgggattatttctggtttttagttattaaaaacaatgctgctgctgggtgcagtggcttacgcctgtaatcctagcactttgggaggccgaggctgcggatcatgaggtcaagagatcgagatcatcctggccaacatggtgcaactccgtctctactaaaaatacaaaaattagcaggatgcggtgctgcgcgcctgtagtccctgctactcgggaggctgaggcgggagaatcacttgaacccaggaggcggaggttgcagtgagccgagattgtgccactgcacttcagcttggcagagcgagacttcgtctcaaaaaaaaaaaaaaaaaaagctgctataaatatggccaagactaaggaaaggtaagtgaggtgcttagggttcacattttatggagtaagagtaagtaccttcttaaggtttataccctaggttcttcacatgcctcactttagtcctagccctgagcattattatgtaggtcttctgatgcaatatctaagagtttctctaaggtatacctagaaatagattgctaggtaatggagtaactttattacttacaggaaactatatggtggttgtaacaatttatgcttctgccaccagtcatggtggatatgaaattatgtcttaatgtgataatttacattgcaatttttttttttttttttttttttttttttgagacagagtcttgctctgtcacccaggctggagtgcagtggcgtgatcttggctcactgcaacctctgcctcctgggctcaagtgatccttccacctcagcctcccgagtagctgagaccacaggcgcaggccacacttggctaatttttgtatattctgtagaggcggggtttcgtcatgttacccaggctggtcttaaactcctgaactcaagcaatcggcctgcctcagcctaccgaagtgctgggattagaggtgtgagccaccacacctggctgtttgtttgttttgagcctgttcctcaggctggagtgcagtggtccaatcatggcttgctgcaactccgcttcctgggcttaagagatcctcccacctcagccttctgagtagctaggactaagggcacctgccactatgcctggctaatttctaaagttttttttatagaggcagagtctcgctgttttgcccaagctgttctcaaatttctaggctcgtgtgatcctcctgcctcagcctcccaaagtgctgggattataggtgtgagccaccacacctggctgatctatctgtcttaaactggagaattgcatttttttctacctcctttcttttttttaaaaaaactgaatttccatctgttacccctccctttctgctcctcttatttcatgccttggaagttatactttgccttcctttaatgagtaccaaagaaattaaaaaatacatgtttactgtaagtccaggcctaaatgttgctactacagggaccatcaaatgctttactaccatctattgccatctgcaaatgtatgccattgttgtttagttttgtagttcttaatgtattttaattaaacaccacaaattatgctttttgtttgttttattcagtcagtagatgcttagaatacttgcttattttaccaattcctttgcttattccactcctttgttctgggattatttttctttttcctaatatattttcattaaaagtttatttggtgagaatctaaaaactctcaaattctgaaagttttaaaaatttgcctttgttgttgaaaattagttttgatgggtgagagaatctagatcaggtgttagcaaacctttttttgtaaagggccagatagtaaatattgtgggctttgtgggccatagagtctctctgacaactactcagcaatgctgttgtaggacaaaagcaaccatagacattatgtaaacatgagtgtgggtatgttctcacaaattttgtttatagacactgaaatttgactcaattttcatgtgttaaaaattattattttttgaatttttttaaccatataaaaatgtaaaaatcattcgtagcttgtagaccaaataaacaggatggatttgacctgtgggccatagtttgctgacctctggtctaaattaacattcattttacttagtacctgacactggagtaattattcttatgatgtcttattgtgatattgtcttccatttttaattgttgaagagccagctgtcagtcttttttgtttttctttttcttcttcttttttttttgaaatggagttttgctcttatcgcccaagctggagtgcagtggtgtgatcttggcccactgcaacctctgccttctgggttcaagcgattttcctgcctcagcctcccaagtagctgggattacaggtgcctgccaccacacccagctaatttttgtatttttagtagagatggggcttcaccatgttggccaggctggtgttgaactcctaacctcaggtgatccacctgccttggcctcccaaagtgctgcaattacaggcatgaggcacggcgtctggcctttctttcctttttttttttttttgagacgtagtcttgctctgttgcccaggccggggggcgatggtacgatcttggctcattgcaacctctgcttcccaagttcaagccattctcctgcctcagcctcccaagtagctgggactataggcacgtgccaccatgccgagctaatttttgtatatttagtagagacggggtttcaccatgttgtccaggctggtcttgaactcctgacctcaagtgatcctctcgccttggcctctcaaataactgtcctttctttgttggtaatctggtgatatgttttcttgtttggctgcttttaagagctgcttcttgtctctggtgcagttcgctatgatgtatctaagtatgtatttattttcatttaacctggtcaggatttgttgagtatccagaaactaaggattggtgtttctcattacatctggaaaaatttgagccattatttttgcttatattgtggtatgtcataggaagttgagaaaagaaaaattcatttgatggttttctatgaggttatagtggaaaataactatctcccttttagaattgagtgctagacagtttctgtgtagatgatctcataagcttccttttatcaaacagcgatcacttttttggtttggctgctgagaagtatggcatcaagtataatactcatatgaggtgtttaagaactgagtatatttcttatgcacattttactatatactataattatacattaaaaatgcacattgtaaatattataaatatgtgttatacattgttaatagtttggatagcaaaagtatgacttgacatttgttttttaaaccatatttaaagtaactctatcacaatatggatttaatggattaattgcataattggtgagctactgattattcttgttatttggatgcttctttaagttagcaagtttatattgtggtgcttcaatatagactacttatttcatttcagagaactcaatttcctgtatctactgagtctcaaaaaccccggcagaaaaaaggtctgtatgcagtttcatggtatgtgtatgtttgcacagacagatttctcttttatttatttatttatttttttttttggaggcagagtctcactgtcacccaggctggagtgcagtagcacaatcttggctcactgcaacctttgcctctggggctcaagcaattctcctgcctcagcctcccgagtagctgggattacaggtgcacgccaccacacctggctaacttttgtgttttagtagagatgaggtttcactgtgtttgccaggctggtctcgaactcctgacctcaggtgatctgcccaccttggcctcccaaagtgttgggattacaggcgtgagccgccacgcctggccagatttctctctcttgttgattcttttatctattctatattatttcaaaatgagtgttgggaaaagaagtaatagtctaaatgttctgtcacatctagcttttatttaatagagttattagatattaggaggttggtttgacctggaaattatttaaatggggtttgattattatgtaagtgtgtactaattttctgcttctggaaaaaccactttgtgaagttccaggtatctttttgctttgttggtttctagtttaattctattgtgggtagagaacattctttatatggtttgttttatggcccacaatgtggcctgtgttggtgcatgtcccatgtacacttggaaataatgtgtattctgctcttgtaggatgtagcattctgtaaatgtcaattaggtcaagttggttgatagtgttctgtatatacttacaattacagatattcatattcttactgatgtagttactgattggaagggtgatagaagagtgttgaagtgtgcaaatgtaattgtggatttgtttctactttcagttctatcaatttttgatttgtgtattttgaagatctgttgttggatgcatatacatttaggattgtctgatttcttggtaaattgacccgtttgtctttatataatattcctcttcaatttctgataatattccttgtttgaagtctactttgcctgataatattttagttttagttatttatttagctattttagttttgctttggccagtctttgaatggtatcaacatataattttcgtagagtaaaattccctttttttagtacaaattctgagtttcgacaaatgaaactagccatgtaaccactagtagcaccataatcaagttataaaagtttaattactcccccaaaagtcacctttactttgtagtaaaccacttcttccattcccaattgcgggcagccattaatctgtttctttcttcctagttttgcctttcttggaatgccaaataaatggaatcatacattattattattttgagagagagggtctcgctctgtcacccaagctagagtgcagtggtgtgattatagctcactgcaacctgaaactcctgggttcaaatggttttccccagtagctgggtctacaggtgcatgccgccatgcctggctaatttttatgtattttttttgtagaaatgggggtctggctctgttgcccaggctggttttgaactcctggcttcaagtgatactccatcttcggcctcctgaagtactggcattacaggcatgagctattgcacctgggttatgtaaatttttcagtggcttttaaacctcatataatgtttgtttgttggtttgtttttgaggcggaggctcgctctgtcacccaggctggagtgcagtggtgcagtctcagctcactgcaacctccacctcctgggttcaagtgattctgctgtctcagcctcccaagtagctgggattatcggcatgaaccaccatgcctggctaatttttttatttttagtacagatggggtttcaccacgttggccaggctggtcttgaactcctgacctcaagtgatccacctgctttggccccccaaagtactgggattacaggcatgagccactgcatccagcccaatatagggaggtattaagaaaagagaagaactatcatccttaagtattaacgggactttaacaaattaaaaaagtagtactttgaataaaaagctgtcacattttactgtgaaatccttagactttttttatacctctagttcaggttttttcagctttggcatgaatgatattttgagcaagataaatctttgttggagttgtcctgtatattgtaggatggttaacaacatccctggcttctacctggtagatgacagtagcacttaattgtaacaaccaaaagtgtctccagatgttgccagttattccttctggggcaaaattgttcccacttgagaaccactgctctggttaagtagtgtaatacttggaaatagaaggcagaaagttggtaagtgcataaagaattcacacagaagttggattagcaagctgagagacgttatttgaacaagtagcaattggaggcattttgactgagaatggatgttgtgcctctccctcactctttcctcctcagcttgagaggtccatattctctcaaagtttgactctttagttttgagggtgatgactgccaactgtggaagggataaacagatttctgtttggtatttttgtccaaatatatcaggactttttcaagaacaggcaatgaaattattgatcagaactacttggtggttctgagaaaataatatgctacatgaggctactgaagtcctcttccttttgccccatgatgtaaccttaggtgactttcttctggctttcagttgaagatcttacccatcattgaggtgagcgaactgatttactgcttgagtctattttcttccttaaaggagtcttcattgaaaactttacccattttggggtggccatagctgaggatgagttttgtccacaacctgagacaacatactcactatgtaaaaaacctgatctcagcttgatatctggttttagactaattgtttaatagaataatttattattgtaaaatatatataaaatttaccatttttaagtgtgtaagtcagtggcattaagtacatttacaaagttgtgcagccatcaccactgtccatttctagaagtgtttcatcattccaaacagaaacactgtacccattaaacaataaatctccacatccccttgcctccccagatcctggtaatctccattctattttctgtatctatgaatttgactattctaggtttttcatgtaaggtgaatcatacaatatttgcccttttctgcctggcttattccactcagcattttcaagattcattcatgttgtagcatgtgtcagaatttcattcctttttaaggctgaataatattctagtgtatgtatatatcacattttgtttatctgtctgttgatgggcatttgggttgttttccttagagtctttatatgtcagtaattcttaaagaatttaaaagttgtagaaactaggaattttgtagatattctagaaatatgtcatttcctgtactgtatataataatttattctacagactaattactgtgtatatatttggttctcagacgtgattttgattttgtagatgctgtacatgctcttcacttcattaatcttttccttttgctaattttggttcttgtgtatacagaattatagagttacaaggtaatttagttgttacctaattcaccctaaagtctacatgaaaccactgtcacagtctttgataagtagttaccaaatctcactatttctactgtgatagtgaatgactttcattgattagctttctgaaagaatagtttatcttacttgtcttggtatcctcacctctgagtctatttgtctattgtaatctggcttttgctccaccgctccactgattaaatggatgagctaagcatttttttttttttccactgcaacctctgcctcccgggttcaagtgattctcttgcctcagcttcccgtgtagctggtattacaggtgcccaccaccatgcctggctaattttttgtctttttagtagaaacggggtttcactatgttggccagactggtatcgagctcctgacttcatgatccaccccaaagcctcccaaagttctgggattacaggtgtgagccaccgtgcttggcccaattctgtttaatttttgaggaacaatgttaacttctaatttaaatggaaggtagtatatatctaatttttccctattatttttaatttcaatgctagtaaatctttaaatctgaaatacacactcttgaattttgacagatatgtatactcatgtacatatttatattcctgtaatcatcagatcaaattaaacatttttatcacttagaaagtttcctcatgcctttttccagtaagtcttctgcttcacttcgccagatgcaaccaccattctgatttctgcctgtataaattgattttgaactttcctataataagttgtgcttgaacttcacacaaagggagccatacagtatctactatttagcttttggcagctttcatacaacatgttgttttggagattcatccgtgttgttatatgtatcagtagttcttttatttaaaaaatgctgtttagtattcagttgcatgaatataccaccgtttgtccattctcctgttaatgagtatttgcaatgtttccagtttttgagtactgtgaaagtttctatgaacatttatttatttagagatggagtctcgctttattgcccaggctggagtgcagtggtgcgatctcagctcactgtaacctccgcctcctgggttcaatcgattcttcagcttcagcctcctgagtagctgggactataggtgtgtgccaccatgcccggctaatttttctatttttagtagagacgggatttcaccatattagccaggctggtcttgaattccttacctcatgatccgcccgcctcagcctcccatagtgctgggattacaggcatgagccactgcacccggcctgaacatttatttactggttttttttgtgtgtgcatgtgtgtgcaagttttcacttgaataagtgcctagggagtggaattgcttggtcatatgtgaactgtttgttttaactttataataaactgccgaagtattttccaaagtggttgtacagttttacccgaccgccagcaacgtgtgaggattctgtttggctacattcttgccaacatttgttactatcagtctttttcatattagacttgctggtgggtatattgtgttttattgtgattttaatttgcattacactaatgactagtgatgttgaacaccttttcatatacttattggtcatatcttttgtgtagtgtctgctcaagttttttgcctatttttaaatttcttttttccttattattgatttgtgagacttcttaatatattctgaatgtacgtcctttgtctgttatatatgtggtaagtatttccccccagcctgtgttttactactttcattttattaaggtatcttttgatgatcaaaagttttaattttgatgaaggccaatttactattatttttcttttgttattaatgccttctctgtcttgtctaggaaatcttgatccttaccccagactgagttgtgtgtcctctcccttttctgcattaatattgcagaaattaattttttggttttagaaaatgtctaatttggctcaatcagtaatttttgatatctttctattgaaatatatatacagaaaagtacatacataaatcataattgtactgtgcagtgaatttttacaaagtaaacatatccatgtaatcaccatctagattaaggtatagaatattatcagtgccctccaggccgcctccttattccctaccagtcattaaccacccctcccaaaggtagtaacttgtatttaacttctatcttctacatcagttttgcctgcttttgaatttaatgtaaatggaatcatgcagtgtgtactttttaatatctaacttcgttgctcagaattatgtttgtgagattcatttatgttgttgcatgtagtagtggttggttgttttcttccttgttatatatattccattgtggggctctacctaagtctattcattttatacttgatgaacatttgggatatttttattgtgatgtattatgaataatgccaccatgaagagtcttgtacatgttttttggtacacatacatacttaggagtaggattttcagggtcaccaggaaggatatatttaggctcagtgaatactagcaagcaatttttaaaatgcggtcaatataatccccatgtgtaaaataaaggtgtacaaacgcacacacacacacttgctcatatgcttatatgtgcatagaaattccttgaaaatactcaagaaatgcttcacctctggtaagggataggaatggaatgggtcttttgtttagtatcctatgtgccctttgaattttgttttactgtaagtatgtatttttaagaaaaccaactagttatttttaaaaatcatttgaaagtcttcctactttgatatatgaaaaacactggttttaaaaaaaataatagaaaagctttaaaatcattattatttttttgagacggagtcttgctctgtcgccaggctggagtgcagtggtgcgatttccgctcaccacaacctttgcctcccggattcaagcaattctcctgcctcagcctcccaagtagctgggactacaggtgtgtgccaccaggcccagctaatttttttttttttttgtatttttaatagagatggggtttcaccatgttggccaggatggtctcaatctcttgacctcgtgatctgcctgcctcggcctcccaaagtgctgggattacaggcgtgagccactgtgcctggccgctttaaaatcattaatgttgcgttgctcagttatgtctaattgacagcccaaacatttacattgtaatattagaaaatcctttatgattgggcagaaacttggtttaatgtgtcaccttggagacctgggttatagtcctgcctcttccattaactacttgttgaatgtggacaatttacttaacctttagggccttaatttcctcctttataatgtgagaatgttctctgaattgcataactcactggccttacgtgactattcagtggaataataagagagaaaaactttgagatacatgcacacacacccttaagaaggatataattgttaaattttgctttgaggaaataaaataatctaagctataaagtaaaaccataattagctaatcttttatatgacttttttcttcctcatttcaagctaatgagaagcaaacaaactggatagcagcaatataattaaaaaattataggccagcttctagcatgtattcttgagtcaatactgactcagcccagtctcttcctcttccttcatcatcatttatgtacctgaacagagtagatgtttctcttgatcctgggcctgttcgccctcagatccattccttgccttctcttctctttttggtatagtgaggagctgactctttttttttttttttttttttttgagacggagtctcgctctgtcgcccaggctggagtgcagtggcgggatctcggctcactgcaagctccgccttccgggttcacgccattctcctgcctcagcctcccaagtagctgggactacaggcgcccgccactacgcccggctaattttttttgtatttttagtagagacggggtttcacctttttttagccgggatggtctcgatctcctgacctcgtgatccgcccgcctcggcctcccaaagtgctgggattacaggcgtgagccatcgcgcccggccgaggagctgactcttgcagcctccttttcttcccaggcttccgtgtcagcagtttctggctggattagcaagtggaggaactggcaggagattagaaggcaagaggaaagagaagacagggcttccctccccgaccttcaggcctcagagtcgtagtggttttttgctcatgcagacttctgatttgtctcaccattccctgttgggcctctcatttcttccattgcctgttctctgcattaaagtccttgtgtttcaaatcctcaagtggctttttgttaggctttgactgatacagggctcaaaatgatagtaatgaaaatgtcttacatttatattcttttcaagatttgttatctcttttgataccccaaatatcctattgaggtagaaaagtgttataattcctgtttggcatgaggaaattaacatttattgaatgactattttcagattctttggattttcgggtgaaaattttaggggggataaatggaggcccagagaagtgaaataacttgccctaggccccatagaaggctggtattgaatcaagattgaaattctgcatgtgaaaacttttacgtgctacatgtctgctagtcctggaagaaatcctttctttgatgagtattttttttaaaggctttacttgcaatatatttacaaaagccttagttatttagtaaatttttcaatgaaaaatctgaaccataataattttctgcttagtacttatatagctagcatactatccctagcattaatcaaagtgtcatgtaaaggtttgatttttgagcctaagcagaatttgaaattcttctaagagaatttagcacctagggcaaactacaggggagaattcttgaggtgtcatgtttattcacttctggaattgtttaaaatatgtcaggtgcatccttaaagggagaaagaagggggaagagatgttacaaaagagtagaatggggcaagagaagtggcaagggagtattgttgctaggttgccagccttctgcccccactgtcttggtgatggtggaggggtagtgtggcagctgggatatgaatgaggtcttttttataactcactaaaagccattaccttgtcttcatctcgtcagctggctacctgacctctgtggtaacataggctcctgaaatgtagcattggagatgatcactgtgctttattgcaaaataggggagactctgctctgcatttacatgcttatgttttgtggaggatctttcaactagtaattctcataatacctgtgaaagcatataagaaccagtatctccatttttagggggagttggagtgagcaatgatttggaataccagaaattcaacttatatatttacaggtaaaattctaattgtaaattcaggattcatagattctagggatttctgaggtatccagaattccttcatctttgatgataagtagataataatggtaataaaaataacagcaacaggcccagcacagtgacccacacctgtaatcccagcactttgggagactgaggcaggtggatcacttgaggtcaggagttcaagaccagcctggcggacatggcaaaaccccatttctactaaaaatgcaaaaattagctgagcatagtggcatgtgcctgtaatcccagctactcagtaggctgagtcataagaatcatttgaatctgggaggtggagattgcggtgagctaagatcgcgccactgcactccggcctttatgacagaactcgactccatctcaaaaaaacaaaacaaaacaaaacaaaacaaaaacaaaatgcaaaaaaacagcaacaataataggtaacatttctttaaggcctactatgtaccaggcactatttgaacctctttatatattaggtaatacgatacaactctatgagaatgagtattttatttcctgacccttctatttaaaagtaaaaccccccacccggcactgtttctctttcctgctttatttttctccatagaaaaatatcactcataagtgtaacatactttattatctgtcctgtgtggtagtagcccctgccctcaattataaactccatgaaatcagggagtcagttttgttcactgctgtattcccagtgcctagaacagtgcctggaatcatggtaggtacccagcgaatattggttgaatgaatgagtcttggttttacagatgaggaaactataaatttcccaggtcacacatttggtaataggacagttgtgtacactgaaatgttctctaaaatatttgatggaacgaaaattagcttttggacagctacatctccaagagtgtgaaatgaccttcagcactggatttggtggattttcctttttctaatccctagagttccatttaatgagcgtttgggttcttgagctaccttacaaattgaacacttttttctccagctttcactcaagaaacacaaaacatggcttgtcctttttttttttttttttttttttgagactgggtctcactctgtcacccaggttggagtgcagtgcacaatcatggttcattgcaacctctgcctcccaggctcaagcaatcctcctaactcagcctcctgagtagctgggactacaggcttgtgcctccactcctggctaatttttttgtattttttgtagagatggggtttgtccaggctggccttgaagtgctggactcaagtgatccgtccacctgggcctcccaaagtgctggggttacaggcgtaaaccactatagctagccctgattgtcttttattgtgagattttaataacagctaagacttgaaaattaacattttataaattttcttttagactacttagtgatatactaagtatctaaggtttgtaatacttagtataaactcaaaagggttcagtgcctcattctcttttactctttccctttagtagataggtgacagaggactgggtcatgcagttgagacttggtccaagatgacttagtaagctacttgtcccagaactatttatttatttacttatttttgagatggagtctcgctctgtcgcccaggctggagtgcagtggtgtgatcttggctcactgcaacccccgtctcctgggttcaagcgattcttttgcctcagcctcccgagtagctgggattataggtgcccgccaccactcccggctaattttttgtatttttagtagagacttggtttcattgtgttagccaggattgtttcgatctcctgacctcatgatccacctgcgtggacctcccaaaatgctaggattacaggcgtgagtcaccacccccggaccctggaactatttatgacggtgcactttatgcacttaacacactcacatgtctttaagcttggtgactcgtgtggctttttcgaaggagatttgattctggaagtggttaagtaggatgtgaatggctaaggtctggtcattggtgaagcctaggggaagaaaagaaaggaaacacaagtcttagaagaatttcagatcggccccaacgactagaagggtggttctactaagaaaatgtgtgtagtcagaaaatgaagagtcagttgcttaaaattttactttttttcttgttcctggcatgtaaagtcatatccatactttctgttataatttcttcttacaaattccattgataatccctattcttggatagcaatgagcagcattacttcttttttatttttttaaaaaaattaaattttttgttgaaatgagggtcctgctgtattgcccaggctggtatcaaatttctgggctcaactgatcctcctgcctcagcctcccaaagcgctgggattacagttgtgagccagtgtgtctggttgtaccttttaatttttgtgttcaggcaacattaactctgagtcacagtaagctttttttttcttcctgtcatattatggacatagaagttttttggttttctttagattgtttctccttaggttgcagaacatcaagaaatggattacagtcattttcctctcttccccatgctcttccctttcttttccttttttcttttctttttttttttttggagacagaatcttgctctttggccgaggctggagtacagtgtcatgatcttggctcactgtaacctccccgcaccaggttcaagtgattctggtgcccaagcctccctagtagctgggatgtcaggatgcgccaccacaccctgctaatttttgtatttttttgtagagatggggtttcaccatgttgtccaggctgacctcaaactcctggactcaaatgatctgccctcctcggtctcccaaagtgctgggattataggcatgagccaccacatctggcctcttttccatttttaaaaaggactgtctccaacatattaaaattcacaaaaaataatataaacacacatgtactcactggctaggcttaataaaaaacatttagtcatgtttactttaaagctttttatttttttgagaaataggcattaaagagttgaagtctcctttctgtcttttcataattctgttcttccctcttccttccttgagatcttcactattcttgggttaatttggatctttctactccttgttaccacagaaaagtaattcttaatgaatttgaccatattttaaacttctgatttcagtgggcaggtaactcattttatggtttctgtattgtgagccattttcaatgactcaactagatttttttcatcgttgacttctcatttctgggcaacagcataatgttctcatttgagctatttctaaagattgtgtttaactatttaaaatatttgtggtactctgatcatcagatgtgatttttttttttttttgagacggagtctcactctttcaccaggctggagtgcagtggcgcgatctcggctcactgtaacctccttctcccaggttcaagtgatgctcctgcctcagcctcccaagtagctgggactattggtgcgggttaccacacccggctaattttttgtatttttagtagagacagggtttcaccatgtttgctaggatggtctcgatcttctgacctcgtgatctgcctgccttggcctcccaaagtgctgggattacaggcgtgagccactgcacctggccagaagtgatattaactatcttatatgtatatttctgttgcgggaagtcaggggccccaaacggagggaccggctggagctgtggcagaggaacgtaaattgtgattatttcatggacacttaccagttcccaaataatattcttataatttcttacacctgtctttaatctcttaatcctgttatcttcgtaagctgaggatgtacctcacctcagggccactatgataattgtgttaactgtacaaattgattgtaaaacgtgtgtttgaacaatatgaaatcagtgcaccttgaacagaataacagcaattttagggaacaagggaagacaaccataaggtctgactgcctgtggggttgggcaaaatagagccatatttttcttctttgcagagagcctataaacggacatgcaagtagggaagatatcgctaaattcttttcctagcaaggaattttaataatactctggagaaggaatgcattccttggaggaggtctatagggcatgtctgtcttatgctgttgacataaggactgaaatacaccctggtctcctgcagtaccctcaggcttattagggtggggaaaaaaccccaccctggtaaatttgaggtcagatcagttttctgctctcaaaccctgttttctgttgtttaagatgtttatcaagacaatttgtgcaccgctgaacatagactcttatcagtaattttgcttttgccttttgccttgtgatctttgttggacccttatcaggagtttctgattttgcccttgtcctgtttcctcagaagcatgtgatctttgttctcctttttgccctttgaggcatgtgatctttgtgacctactcactgttcttaggccccctccccttttgaaatccttaataaacacttgcttattttgcagctcaggtgggcatcacggtcctaccgatatatgtgaggcccagctgtgaaattcctctcttcgtactcttatttcttagccggctgacgcttatagaaaatagaaagaacctacattgaaatattgggggcaggttcccctgatatatttccttagtgacattcctgcaatctcctttagaaagtctttctgttcaccttctataaccagggaaggagagattgagaagagacgaaggatgattttatgtttttcagtcccagtcattatttgatgagaaactgatattacaagctttaaaaactcaagatatgtattcaacatgtagtagtagaacaagtatcttagtttaatagtctataaatttttgatgcactataatatattattgtagtcagtagcatcaaaattttaatgtgatattgcagtatgtttatggttagtttagacatgaggacagtgctaaaggagaaaatctaatgactgtgttgtttgttttgtcaaaatatgctgcctagctccagagtttcctattttggagaagcagaactggttgattcatcttcattatatccggaaagattatgaagcctgcaaggtaagagattgccataataataaaaatgagaggcaggatgttgggtaggcaactaacagtgcctgctaaacagagtgtggcagtttatatctcagtgataaaacatgaattccttcttccccatacttcatacactggttatcttttgctatggtagtgatgtttaacatacaacctcaatatttcagtggcccccaacaaacaaatattaattgctcatgggctttcagatcagctgtgggttggctgggtttgactgcaggctgtgggtcaggtttaggtgtgttccatgtgtcttctcatgtcaagagcaaacaactctcttggacatgttggtcttctggtggaggcagatgttcaactcagcatattaacttttttatctttggatagatgaaaaatggtattttgtcgagtttttttttttttttttttttttttgagatggagtctcactgtcacctaggctggagtgcagtggcatgatcttggctcattgcagcctttgtctcccaggttcaagcaattcttctgcctcagcctccccagtagatgggactacagatgagtgtcaccatgcccagctaattttttgtatttttagtagagatggggtttcaccatattggccaggctggtctcgaactcctgaccttgtgatctgcccgccttggcctcccaaagtgctgggattacaggcgtgagccaccgtgcccagccctgagttttattttttaatttctctcttactgcaaggttgatcatcatgtgtatatttaaaaaccatttgtatttccctttctctgtatctttggtgacataccatatgtgttacaaacttgcaggcagacagtggtagtactaacatgcagaatgtatccttggtgtcatcttttttggtatccagagctttgtgacccatctaaggtttttaatttatacccatggcatttatacctatggcaatgcacagaactaattcatactggtatgacaaagattcataccagtttttttttttctttttttaagtggagttttgctcttattgcccaggctagagtgcagtggcgcaatctcggctcactgcaacccccgctttccagtttcaagcaattctcctgcctcagcctcccaagtcgctgggattacaggtgcccgccaccatgcccagctaatttttttttttttttttgtatttctagtagaggtggagtttcaccatgttggtcaggctggtctcaaactgctgacctcgtaatccacctgcctcagcctcccaaagtgctgggattacaggcgtgagccaccgcacccggcccataccagttttttttgacaccgctgatccgaaggcagataccagtatgaatctttttttttttgagatggagttttgctcttgtcgccaagggtggagtgcaatggcgtgacctcggctcaccacaacctccgcctcctgggttcaagcgattgtcctgcctcagcctcctgagtagctgggattacaggcatgtgccaccacgcctggctaattttttgtgtttttagtagagatggggtttttccatgttggtcaggctggtctcaaactcccgacctcaggtgatctgcccgcttcggccacccaaagtgctgggattacatgcgtgagccaccgcgcctggccaccagtatgaatcttgaaaggttctctttctttttcatctgtgataatacttggaaatcttatcacacttttcttagcttgcctagttagattttagacaggggttggcaaactttttctgtaatgggccaacaatattttagggtttgtaggccacatacagtctctacatcatatttgttatcttattttttataaccctttagaaataaaaaaaccactgttagcttgagagctgtacaaaaatatacagggcctgtaagccctgtagtttgcaaatccctgttctagaagaagtaatcacaacaagggagttgaaattttaagaaactgaatgaactaatactttactaggcattattaatactctaggtttttttacatatgattcttgtccacgtctgctttttcattactatttgttttcttttttttttcagacagagtctcactctgttgcccaggctggagtgcagtggcgctatcttggctcactgcaacctccgcctcctgggttcaagcgattctccttcctcagcctcctgagtagctgggattacagacacgcaccactactgcccggctaatttttgtatttttagtagagatggggtttcaccatattggttaggctgatcttgaactcctgacctcataatctgcctgccttggtctcccaaagttttgggattacaagcatgagccaccgcacctggcctgtccatgtccactttttcttaaagacacctgaagaaacttaaccactgctcagaagcatttttctccctctttcaggctgttatcaaagaacagcttcaagagactcagggattgtgtgaatatgctatctatgtccaaggtaagacacatacttcttgtcttcttgctagagaaatacacttttcctaggttcttgaaaaagatcaggcaattgaagaaacaagttcaagtacagtcatgcaccacttaacaatggagatatgttctaagaaatgtgttgttaggcaattttgtcattgtgtgaacattacatggagtgtacttacacaaacatagatggatgatatagtgtactatacacatgatatagtctgttgctcccaggctacaaacctgtatgagcaggtgttataccgaatactgtaggcagttgtaaaacagtggtaagtgtatctaaacatagaaaaggtactgtaaaaatatggtataaaagataaaaaatagtatacctgtatagagtacttaccatggatggactggaagttgctctgggtgagttagtggtgagtgaatgtgaaggtctaggacattattgtatactaatgtagactttatgttgtatactaatgtagactttataaacactgtacacttagcctacactaaatttatttaaaaatattttttctacaatgataaattaactttagcttactataactttttactttataaactttaaaactttttggctcttttggggtaatacttaaaacacacaacaacattgtacatttgtacaaaaatagtttctttaggtccttattctataagcttttttctttttctttcttttttttttttggtagagagacagagtctcactttgttgcccaggctggtcttgaactcctgggctcaagcagttctcctgcctcagcctctcaaagtgctgggattataggcatgagctacgacacctggccctttatgctattcttaaaactttttatttttttacttttaaacttttttgttaaaaactacgatacacacactactacagtggtggtactaacatgtggaatgtgtccttgctgtcttttttggcattcagagctttgtgacccatctaaggtctttgtgacacacacacacacacacacacacacacacacacacgcacacgcacgcacgcactggtctaggcctacactgagtcaagattataaatatcactgtcttccacctccttatggaaggtcttcagtggcaataacatacatggagctgtcatctcctataacaataggaataccttctggaatacctcctgaaggatctgcctgaggcagttattcttttttttagtaagtggaaggagtacactctaaaataaagattaaaatgtatagcgtagtaaatacataaaccagtaatgtagtcatttattatcaagtattaagttctatatatatgtaattgtatatgctgtacttctatgtgactggcagcacagtaggtttgtttataccagcatcactacagataggtaagtaatgcattgcactgttttgattgctatgacgtcactgggcaataggaatttttcctcttcattataatcttaagtgatcatcatcatttatacagctgtcgaccaaaatgtcattacaggtgcatgagtttaaatgttccagaaaggttttattcagtattaatctttttatggaatctgaatataattactgtgttggatttgacttcagaaatgactagtaatgttaaaaaattgctatgattacccattttttagtttctggctagtgttttttggaatggatgcttaggattcctgcctaatgcagtgatttcagggccaaaagatgcttttggaaggattgcttgtaatcaagctaaaagagatgaagaagagcttgaggatttctgtaaggtgaatcaggatgaggggaagaagcctggaaataaacaagataaagcagagcataaattcagctcattagaaaccaaagataaggaccactcacttactttttttttttttttttttttttgagacagagtcttgctctgttgcccaggctggagtgcagtggtgcgatcccagctcactgcaacctctgccttccaggttcaagcgatcctcctgcctcagcccccctattagctgggattacaggcacatgccaccatgtccagctagtttttgtatttttagtagagacaaggttttgccatattggccaggctggtctcgaactcctgacctcaggtgatccacctgccttggcctaccaaagtgctgggattacaggcatgaaccactgcacctggcccactgacttaaattttcctctttagtggcataagtagcattcttagtttttccaggaactttctttttgactcttgggtgtaaataaatggttttgtttaccattcattgcatttgtagtcttcagattaacatataattttctgacataattgttaagatattgacaaatttaggacatcatggcaaaaaatgctcttattcccagtgtcacaagtatcagactttcagtgcctgataaattcttctggaaacataggcctaggaaaaacctctggttctaattggttgttacactgacaactgaagtcttaaatgttactttatcctttgccagaatctccatgttgaatttgaggtattgattccatttgccccatttgggggttcgctctgaaaactatcagttggaagtaaattatgataaatgaagcatctgatggggaagccccaaaatgttgttaatgtgaagagtttgtgtgataatttgcaaaggaactgattatctatgtgatggatcctgggagtagagagagaagtaggtaggtttgagctaccttgctaaaagacagttgagcttgtcagcagttttggttgttgtttcagcctgtccaaagccatatctgattgttttaaggatacagttgtccaaaggatttacttgatgtggtttcccagttttctcttctccaatttttctgaccccaggctccattcttcccagaacatggttttacttttttttgtattttctgtttcttggcagcattgatatttcgcctagaaggaaatatccaagaatccctagaactcttccagacatgtgcagttcttagtcctcagagtgctgataacctcaagcaggtggccagatctttgtgagtattggcaacctggaggccctagggcactcacagagaacagtgtaaaatgcattcctaggtccagcctgctgctggcagctgcatcagcctgatacacaagtgggggaatggtttaataggtacagtgggattcactctgaagagcatggattaagtttgaaatttgagaaaatgagataactagtgttaaggaactaagcattttaaacactgtgcattctagtttgatgggggaccaatattgtttatcatgtaaatagagacaccttgtaccctaagtcttctaaacttattggcaatccttggaatttttctcatctactcttctaacacttagtatttgtcacacagtaagtttttagtaaggacagagagttcctgacttctgatggttcaacttacataatttttcaactttacaatgatgtaaaattgttatgtattcagtagaaactgtacttcaagtatccatacagccattccgtttttcattttcagtatagtattcagtaaattacatgagatattcagcattttattataaagttggcattgtgttagatggttttgcctaactgtcagcaaatgtagttaagaaagtggagataggaactccatggaacagagtaagtgttctgagcatgcttaagataggctaggctatctatgatgtctggtagagtagatgtattacatgcatttttgaattacagtgttttcaatttacaatgggtttactgggatgtaaccccatcataagttgaggagcatctctatttgttgagtgaatgtcctaaagattcctagatggaaagaatctcaagtgtttataaactactaggtactcccttttcagtcctttgttccatggagttcctatctcccctttcttagccacattgccattcatacctgtgttgtttttgcatagagcttggttttccctgtttctctctaaactcaggatccaatatcaaggaaagagacttagtcttggaaggaaaggatgtgtccctaatgggtgatgataaatgatggtagttactgcttaacatggtatatcattaggcttatttcttttttggtctgcatttatagtacattgtagaagaaaaattccacaagactctcactaaaattggtatagaatgagaccaaggccttggaacagctgccagtgcaatccctactaagagagcttctgctgttagtgtatagcagcttcactgaccaaaccagcacaaccacctcatagagaaaaggcttctagaattctctgctggatgaaatatgattaaaatgtgggactagtagggttagtcttctaagaattttgaggtaataattatggaaaatatatcttttacagatttcttttgggaaaacataaagctgccattgaagtatataatgaagcagctaaactcaaccagaaagattgggtaagtagagaactttcagttctttcttattagtaaacttgctaatggttccatttatcatctggctgtcttatttctgaattcttacattccaaaaatgtcttgattttaacctcatacttaattcatgatttgtataagtataggatcaaaaaccatgtttcctcataactttgcaggcattgctgcatgattttctagcagtttgctgacgagcagtctcttaccagtctgattcttgttgatgacccctagaagctttgggtatttttttcgtcattggaattccacagtatcagcaataggcatctagttgtgtttcatgtctttttcccgtccccatctgtgtgacattcaattgactctttcattctgaagacccttgcctttctttgggtcagggcctttgagtagttctttatttttcccctccccttctctttgtgtcaattgaggattgtgtgtaaatgcaacagaaaatttgactaaacattggctttacaaattcgtttttgtttttttttttaattctcatgaaacaagatgtccaggtaagtagttgctggcattgatttggtggtcctaggatgtcaagactgagagtttttcctcatggttacaagaagactgctgcatccagcatcatatctgcattctagggaggcagaaagagaaagcaacaaggagaaaaggacagagcctatactgggaaagcacaactttcccagaagtcccccacagacttccacttatgtcatatcagctccccttctataaggaaggctggttaaatgtcgtttttaatctggtcacactgccactctaaacaaaattagggttcttttagtaaggaaaaagagaagagtaggtagcaggtaggcaagtagataactagcagcatctgccacactgttttccattctctatgagagatgttctctaactattctctacaactcttaacttgcctctcattttctacctctgtgtccttttctttgtgtgtggtgcgggggggtacagaggctcactctgttgcccaggctggagtgcagtggcgtgatctcggctcactgcaacctctttcttccaggttcaagtgattctcctgtctcagcctcctgagtagctgggattacaggcgcctgccaccatgcccggctaatttttgtatttttggtagagacggggtttcaccatgttggctaggctggtctccaactcctgacctcaggtgattcacctgccttgtcctcccaaagtgttgggattataggtgtgagacaccacgcctgaccctccttgtcattttattatatgttcaggacatgtattcagtcttatcttccatatcatcatttttgtttttagctatttgtattctgttatataccctatccatccaatattttttatttcatttccttttattgtatttttaatttccaaaaatcttgtcttttcttcaatgtctctgattcttgaagttcttttctgcttctcagaattatctttttcttcctctctgcattttggttcttctattttatgctgttggtatttttcaagtatttggtgattctcagagagacattcatatctgtgagtgaagaactagatttattagtacagagaattagcatggatttcctttgcagttcttacggggcactattatttttgaagtgtgttcaatttgttagtcgcttttcttctgtacatcggaagattgagttgagtctttatgccatggagtatgttatagctaacagccagagtgaaactacagatgaagaaaaattcatgtacttttcattcagtcggtttttcaaaaaatgagtatgtctgctatatgccaagcactgatctatgccctggagatgcaaagatggactgttggattataagatactcaactagaataggaaatgaaggaagaagagcaaggtttggaagaaggtgatggtaagaaatcagagttaaatcctgtctttcagaggattttggatatgataagttttaggttctgaggggatatctaaattgagatgtgtccagtaggattggatatagaaatctgaaactcaagtgttttggagtagagatgtgaattctggagtcagcaacataaaggtggtaattgaaaccattagattggttgacattaccctgcaatgagctgaggatgggaccctggaaaaaaagagttttttactttttttttgtctgtttgagacggcacaggaaaagttactgctttaatgcagggaggaagccctgcattctctatgggggccaggatcatgggggtggccagtgccacaaatggtcaccatacaggccagggaggagccagggcccaccaataatccctggaacatccctggatgctagcagttttttactttctaaatttttttttttttttttaagagacaaggttgcctaggctggagtatagtggggtgatcatagcttactgtaacctccaactcctgggctcaagtgatcctcctgcctctgcctcctgagtagctggggctacaggtgcaagccaccatgcctggctaaatttattttgtggaaatgaggtctcatgttacccaggctggtctcaagctcctgtcctcaagtgatcctcctgctttagcttcccagagtgctgggattacaggtgtgagccatcaaaaagcaattttgaaggactgagcagaagaagagaacccatagagggagatagggaagaggtaaagcaggagagctcagggtcacagggggaatggaacgtatttcttaatctatccagttggttgaaagagctcatttggtattactgactcacttgggataaccatcccattgttactagtagatgtgatcattcacaaaacagccattctttttttttttttttgttgagacagagtctcattctgtcacctaggctagagtgcagtggctcaatcttggctcactgcaacctctgcctcctgggttcaagcgattctcctcccccagcctcctgagtagctgggatttacaggcacccgccaccatgcccagctaatttttgtatttttagtagagatgaggtttcaccatgttggtcaggctggtctcgagctcctgacgttgtgatccgcccaccttggcctcccaaagtgctgagactacaggtgtgagccaccaccttttttttttttaactttaaaatttttctttaaaattttccccttcatggcatttttattttctttttagaatattttaatgattttgaattttacttttattaatagcccttacctaccctacatatttcataagtacctgtagaaaaccttatagtagctggagcatggtggctcatacctgtaataccagcactttaaaaggatgctgagtggggaggatcacttgagcccaggagtctgagaccagcctgggcaacatagagacccagtttctaggaaaaaaaaataaaaattagtggtcgtgtgcacctgtagtcctagctattctagaggctgaggtaggaggatcacgttagcccaggaggttgaggctgcagtgatgcggtgaactgtgattgtgtcactgcacttcagcatggaaagcagagcaagaccctgtctcaaaaaaaaaaaaaaaaaagaaacaaccttgtagccctactttcttggactcatcagggtattccacagtcttgctgcaacaggggaatagtaattcctcctgccattatcttagttgacttttggaacagttctgttaagtagggagaatttcccccattgacaagtgaggaagctaaggctttggaagatggaagttgctacagtgaggtagttgctgagccagaactggaattcagacctgtgatctaggatgatctaagattcctcgtcttaagactgtgatcttttccactgtaccaactgcctttgcaggatgtctgctgggttcccttacctcctgaaagataggatttgactctgatttgttctgttgccctttccaaatttcttttgcagttagtttgttaaaggtatattgctgccttctcaactatctatgtcaaagattttaaaaggtcagaggttagccttcaggacatctatttacttacctaccttaacaattcctactgtagagcaggacatttaaaggacaagaaaggctttatttctgccttgtctctctccatgcatgcattcttatagcatgacaaagttggcagtatacaagttttggaagcaggcctgagttcaaatcccaatgttctataatatggacatgatttgtgattgaataaaaaaaatttttaaatgtgcggcatttgtgagataattggaaattttaacgtaattgaatatctaatatcaagcagtcactactttttttcgagtgtgacgatgtgggtagtttaagaaaaaggccttatcttttagaaataaatacggaaacatttgtggataaaacgttgggctgttatttgcttacaaaagttgtgggagtagatggggtgtggattggatggttgttgggacaggatgattagtacctaattctgtctgcacttacgtatgattgaaattctccctaggatgtagaactaaaaaagaaaaaaaaaatcccaatactctctgtcttaagttaggtaatctactcaacctctctgagcttcaatttccttatctgtaaaattggaaagattataactatgttgcaggtttgctgaaaattaaagtaacatatatgaaaacatctggcataaagcctgatgttagtaggtgctcaaccaatggttgctgttttgttgtttttactatttttggagacttggaaaacattaaatcagttgttatctctgagcctgggggtccatgtttcctcagacagggacacatctccactactaatagggtagttcttactatgtttcccaagagcattttccttacccttgctttctccttttccaaagctaccttaaataaagggaggtttattataaaggaatttgagagtccataaaacagtatcaagagatgcaggttggtcttttagtgaagcagaactggaacgcttcagcatccaaggtagctactctgccttttctgcttcatcttttctttctgtagatcaaaggttggcaaactttttttgtaaagggccagttaataaatattttaatttgtatagcttcatacagactctgttgcaacgacttaactctgcagttctaatgcaaaagagccatacaaaaacaatagttgtgtctgtgttccaatgaatctgtacttataaaaaagggcagggaatggatttggcccatggaccatagttttcccatgtcagctctagacttctgcagatggctccaattacatgtattccatcacagcagactccaggtggcgctgtcagtcctcaagttcacatcacctagtaaatttagtacttgtaactaactagctctcttccaattccagattcctagggaaaggacttcagttgtgtcaggtgtcactatccaactgtgttgccttaagggcggaaatgtgtggctagcagccctctcagcaggggctgtgggtagtctctcctgagaagaaggagcaaagggtatgggtgatgggcaactcttaaagaaaaaaggtatggggatgggctgggtatgtgccccagggttccccatagatccaggaagatcacctgtttattctgcttttatttcttataatctgtatttttttatgttgaggaacttatttttaacaattaatttgagtatgaactctaataaaaagctgactgtaatgcatagtttaaagtttaaaccttgccgagcaataacaatctctagatgtctgttgtttcactctaatacttactgtggaattacacctgagttgttttccttcttttttatgagcctaggagatcagccataacctaggagtttgctacatatacctgaagcagttcaacaaggtaatttatagaagtggtgatagatttcactgagggtgcacttgttgcagaagttgttacattgctcatttggtattatccctagtgcttgcagaggtttttggaactgaaaattgaaagtacctttatacatttttttctgttttaattctcacttgtcattattcatctgttgttttctgcttgtaataagaacatggaaagttctagaaatatgagggaatggcagtttttctcctttcttctttttctctacctccagttaaatttcccagtttagaaacagatgcttaataaaacatacatatcaaaaagtggacccttaagtcttaaaggtgtgatcatgaccatgtgagctatctccatgccctgacggcaacttagtttttagggtcattgaaaataaattttaaattttaagtggatctgatttctgagttttcagttttaattttatagttattttccatgatgagaaattatatttcactgtgattaagctatagactcctatatcagagaagacaagttgagcttacctcaaatttggtactcaggtaagaaaaagtatatatcataattgaggagtagacaaaattactgagagctctaaaacttagtgatgagagcgttgggtagtttccttcatagagctcacagttagtgattgtgaagttttattctcctttctccgatgccaccaggactgagaatctgaattggttagtacccatttgacaatgtttagtttgtgtcaatttgcagactggtgtaactagtatcccacactggtgtgaaaaaaaatatgcacattagcagttggggtgtaaaagtaacttttctcctgagataacaatatatatacataaaatacatttagtgggccccttaggttttgtagatggatctatagttttatatacttggttaggagatttttctcttcagagacaatttcaaacaggcacatttctattcacaggattattctgagtcaggggaaaagaaggatttgtctttggttggatctgtgctgagaagaaatatatttagattttactgtacagctaacaggctaggcaaatacaatacctggcatttatataaatgcttgttgaatctgtgaatgactaaacaaagcccttttgtttactaggagaaggtaagctcctccagagcaaggagttggttttataaactcaaatatatttagcatctagaacagcaagcagttgggtgaataaatgagaacaatctatttattcatttatcatcacattgatggggaaacctggcccaccatagggaaggttgtgcacttggtcagtgttacagctgggatttagtttagtgtagtactctacactgtactatgatggcccttttgacttatgaagtatgagtcataggtgtgaatatcaggcagaaaacattcagaaagattaatcgtcttgtataaattcttccaagtggctccagaagcagatatcccatgttgccagctgtcttttcaacaaggacagttttggtatgttttggtctttgggtagtgggggctgtttgctgaaatgtgatgttcctatgtcaatacagcagaaagtgtctttacattagccatataaaggtatagttcgttcagtggtagtgatttggttttctttattttgttaaacttgtcaggcacaagaccagttgcacaatgccctgaatcttaataggcacgatctgacttatataatgctggggaagatccacttgctggagggagacttggacaaggccattgaagtctacaagaaagcagtggagtaagtgtatctgtttcctttaaaacagtgagaaactaaaaaaattgagtggatatgtgaactcccaagcctaaaagagtgaatatgtttgattaattacttactgtatgagttaaaggttaagctgaagtttaagagctcccagtagcttcaataaggtagactgtgtttctttcttacctataaggatgactgctgctttaggttagctgggcagctctattctacaaggtcagccagggatccaggtttcttccttattaactcaccattccttaggctgttgtctttacctgcatggttgatgctgaatgtaacatccacatccaggctgtggtggaaggagatggtttgggaagctaagcatggaataagcatctggctatatatatatatatatatagagagagagagagagagagagagagacatgatcttactccatcactcaggctggagtgcagtggagaacacagctcactgcagcctcaacctcttgggctaaagcaatcttcctacctcagcctcccaagtagttgggactacaggcatgtgccaccatgcccagctaatttaaaaaaaaaaactgtttttgtgttgacagggtcttgctgtgttgcccaggctggtcttaaacttctgggctcaagcgatcctcctgcctcagccttccaaagtgctggaattacaggtgtgagccactgcacctggccttggtaataagttttaaatgacccagaaattgcacacatcgttcctgcttacattccatggttcaaaactacatgatagttacaagggaagtgggcagacatgcactcaagaagaaggaaataacagatttaagagttggccgacagtctgccattttggtatcatatgttaataacagatcttctgttttcagagatattattagggacagaaatctcctgattcagtaaaaaacaaaacaaaacaaaacaaaacatttggccttattagcatgagaccagtatcttttttcccccttccccattttcccttccccttccccgttttccccttccctttccccgttttcccttcccccttttctcttccccctttccctttcccccttcccccttcccccttcctcttccccttcctccttccctcttcccccatcccccttcccccatccccctttccccatccccctttccccatccccctttccccatccccctttccccatccccctttccccatccccctttccccatccccctttccccatcccccttccccctttccccttccccctttccccttcctcctttcccttccccctttccccttttcccatctcccttcccctttcccctccctctctcccttccttcctttttctctcttttctttccatcctttccctccctcccattcccatctttctttgtttctttcttttcttcctttcttccttcctttctttccttcctttcatttatttcaacagtctcgctctgtcgcccaggggtgagtgcagtggcgcgatctcgcctcactgcaacctctgcctcctgggttcaagcgattctcatgcctcagcctcctgagtagctgggactgcacgagcacgccaccacccctggctaatgtttgtatttttagcagagacagggtttcaccatgttggtcaggctggtctcgaattcctggcctcaagtgatctgcttgccttggtctcccatagtgctgggattgcaggcgtgaaccactgcgcccagccttgtgttgttacttttaaatgggatagctgtagcaaaatgccttgtctcatttgtttggtcccttaatagaatgtctggtctgtggttcaaggcttattattcctaataattagattctgaactaaacttagatttctattaatttgttaatcatctttgtcttctaccatggtagtaaattttctggttatatcagtcacagcactgctttctgaattttcttcaaccatattttgtgtctaaaacagaaaaatcccttggtttgttaagctacagaacagacttttgtcatcaagaggctgtatatttgggcaagtagtaaggagccatgtaacatgttcagtgcctctgtggtgctaggtagtagccctgatccctgacccctgccttctagaggttagctctttgagaatagcatacataaatcccaaggggaacattcttccagtaactgatcaaggactttggtcactaaatttcctaagggagaaatgtggacagctaaaatctgaagccttactgagaagatagagaccattgttcatgacctacagctttgaagagagtagtcatgttgtagtggggaagccaatattgctagaattacagaagttacctggctttggggagggaagtgatcaaagtggatgtttattatggcagaaagtgaaaggcggattcccagttgaattgagaaagctctgtttggtcagctcaggcctcccctggctggggctttgcatcttctggttcaggtcttcctataggtaaccagtgccctatatcattccttagaagcagaagacattgttcatagccctttggtgttttactgttgaaactgtctgatgatcctatggtcagatcatctcaactcagtgttgccttggttttgtgacaaagacaaatactagtgagggattgagcaggcaatccctgatgtgagtattttacttacatcagtgtttactcccaaaggtcagtagcaccttctttcctaggattggtatgtatcttccttcttttgtttagtttggctacttggtatagctctttgtttaagtggagagaacagcattaggggccttgggatcctaaattacatagaaaattatgctgcctggcattgtgagcacaatgaggatagaaaaaaaattccacaagagaggactggtgaaactgtgtgtgttctaggctgacttggtttataaagcattgttctttaattttatcagtgtgaccaagacagtcatgcaaaacattctataggttctttcttaggacttttaccctaagaaaggaatctgaattctaagcctcatttttcttgctgagcagttctccttatcaccagggttgagatgacctacttttgatggcaattcccaaattgccttcaggtatttccacggggaggaagaggctcagtggggtctgtcaagtattgcacgagggcatattactgtgcatgtgtcttcgtgtttctcatctacatcttgtttccctctgagcatctctatgttgcaggttctcaccagaaaatacagagcttcttacaactttaggattactctacttacaggtaatgaaaactctgtactcattcatgcactgatgttagaaatggttttgggtttgtgtgtatggtggttttcctgcattctgatatttattttattaaaggtcatataaagttcatgaactacactctctctattcgatactctttgctaaaggaattaattttctgcatttaaattggaagcaattctattttagcctagtgcaattataattcttatctaggctgggtgtggtctcatgcctgtaatcccagcaatttgggaggctgaggctggtggatcacttgagctcaggagttggagaccagcctgggtaacatagtgagaccctgtctctacaaaaaataaaaaaattagccaggcatggtggcatgcttctgtagtcccagctacttgggaggctgtgatgggaagattgcttgaactcggaaggcagaggttgcagtgagctgagattgagtcactgcactccatcctgggtgacagagccagatcctgtctcagaaaaaaaaaaaaattcttatgctatccaggaaagagcatatatgagaaataactctggtcttggaggctgttattttgttgtgaggagagaaacagatacaagtgagcacttagggctttggggcaaagccatttcttttgatctttcttcccagccagagtcttattggaaagagagaaggcaaagtatacttttatctagaataagaagttttctgtcccctcaacattcctgaatgtgaatgggattcttttagctccattgattctctggctgaggacccagggcccaggtatccaaggggcttttccctcttccccaatatacacatttgccaagttccttggtcagctgattctgcctccagccctgcctctgtggtggcctttatgtctatttcatttttctttaaaaggaatcaggagcttaaccctgggtcttcctgggctttggcttgggaggttggctccacgggagatgaggatacccagctcatttcctgcaaagaggcattaatgtggaacagtactagtgtggcagagatggttcttatcaaatagatactttgaccttatcaggtgacaaattaacaaaaatagaaggaaaaccatgactggggatttttagttttctttctttattatctggtaactgtagctgctttttttttttttttttttttttttaaagtcaagagaactcaaaaaagccagagcatttctgttctgggtgaggttggccagactgtttttttttttttttttttggagacggagtttcactctttttgcctaggctagagtgcaatggcgtgatctcggctcactgcaacctctgcctcctgggttcaagcgattctcctgcctcagcctcccaagtagctgggattacaggcatgtgccaccatgcctgggtaattttgtatttttagtagagatggggtttctccatgttggtcaggctggtctcgaactcctgacctcaggtgatccacccaccttagcctcccaaagtgctgggattataggcattagccaccacgcctggtctggccagactcttttaactgccgtctccttgctgatgtaaattgtcttgtttgctttttttccaagctcggcatttaccagaaggcatttgaacatcttggcaatgcactgacttatgaccctaccaactacaaggtattacaggctgtgaaggctctggccttcatatagacggtcccactgctcctagaggtgatctgaccctggaaagcaaaggaatagcttcttaaatttggatacctgagaaatagaaaaaatataaataaaaggtggctcttcttatttgaaaatagtgtcaagtatgctctacttatcttctaaaagtgcacatttgttataatagacgtgtaacccctgcagaaggcagatcatagtgctagtaaagcttatgtgttacttaggaaattagcaatgcctccacaactattgtcaaaaataaatctgcggcccggcgcggtggctcacgcctgtaatcccagcactttgggaggctgaggtgggcagatcacgaggtcaggagatcgagaccatcctggctaacacagtgaaaccccgtctctactaaaaatacaaaaaaattagccgggcgtggtggcgggcgcctgtagtcccagctcctcgggaggctgaggcaggagaatggcgtgaacccgggaggcagagcttgcagtgagctgagatcacgcgccactgcactccagcctgggtgacagagcgagactctgtctcaaaaaaaaaaaaaataaaaaataaaaaaaataaatctgctgggcatggtggcttatgcctgtaatcccagcactttggaatgctgaggcaggaggatcacttgaggccaggagttcaagaccaggctgggccacatagtgagacccccatttctacaaaaaaaattatccaggcatggtggcacacacctgtagtcctagccactcggaaggtggaagagggaagatcacttgagcccaggagtttgagtctacagtgggctatgatggcaccactatactccagcctgggtgacagagaccctgtctctaaaaagaaacaataattatgttgaaatgacttctagagtcctaatgatttgatactacaactttttttctagatgtgactttgggaatgagaaggaatagcatcaaatggatgaacatcattgaggagatgcagcaagacaagctgtttattaaaggatacaaactgaattctgatttaggaagtaacattagactgtcagctcccaccttgatacctttccttagagaaatgaaagggctgggctgatgaagcctaaagctgactcgccctctgttttacggtagaaagaaatttaccttaagtagccacgtacaggtgtatttcaggtatctagaacacttggtataccaaataggggctgcagagaacagattaaaggaagtttttacttaaagggctctggtattcattctgaaatactgactttcctggctagaagtaggaaacagatgggtaaagcaagtaacattttatctttttttttttttttttttttttttttttttgtgctgtgccagagagccacagtgtagagtgcaaggacattcctcaggaacatttgtcccaataggttggatatatttatgtccctggaagaaattttccagtcccatctatgctgatgggcctgctgagtatagactcaggaaagctgccccactgctacagccttttgggaatgactgaatgactttctctgtgccatgttttcaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggtgagtgtcccctcatgttctttgtttgtatttctacatgtggttattgggtctgtttagcttgcccttctcattgagtgccccttctctctcataggccatcagctgcctgaaacgagccaactacttggcaccctttgattggaagattctgtataatttgggccttgtccatttgaccatgcagcagtatgcatcagcttttcattttctcagtgcggccatcaacttccagccaaagatgggggagctctacatgctcttggcaggtaagaaacatttatgtggaaaactctctctgccatctgtaatgagggaaaaatggattagaatcatagaagatcagtggctgtctcataggagccattcccttagagatcctgtaggaatctggattactgtcctggagcttgaagaaatagaaaaagatgacaaaggaacttggttgtttctaacttgggggagtttgactcagagaccaacaggttaaataaagatcatccctagttcaccttttaccagttttttcctcttgccttgacaattcatttatgtatatattgagtccaactaagttccagacagcaagtgttaagagcttgggttttaggtagggtcctgcctctactacttattatatgtacctagggctgatgtgaggattgcatgattaagctctcaattaataatactggttttgttgaaatactgatttttgaaaactgttggttttactgtggttatataattggtctattattatcaatattgttgttactataattggcccctaggtgatacttccaagtcaagctaccttatgttgaaacccttatctcttctgagcatgttatatagaatgccattctcttcctgaaactccattttatgccatgcaaatactaaaattgatcataaaaataagttaaaattaatcaaacactttaacaattatgcacaaccattttaaagtactgactagtctttctaggaatttttttctccatatacatttacttactaaatgtaagacccaaagcagatttccatgtcctcatttggcagtcgtcttccagtggctttttgttcattactgtgggttcttatttaaaagagaaagcttgcaaaagcaattgtggttatttgagggttgcctgaatacaaagataactttaaaaaaaaaacataggttttattattattcagatatggtatgggcaacagatcagaagacatctgccactggaaagatagtctgttacaattcctgagaaggagggcatgctacaccgtgcagggccacatggggaagcaccaggtcaatcaggaggtagagggagcaaggggtaaatgtgggcacaattctttattgtagttttcatgggtagaaatgccctccccggggcaagaccgggaaagcaggttaaccaggttggggattggccagtttgaataatttcagtgggctctgggctatagggctgtctctaggtgtctggtacctgaccctcgggtgactaggactagggaatattggcccagtgtcagggcccagtaaaggaggcagttaagaatatgaacactgggttggtcggtctgcatacagaaggtactcttgtaggggttatatctaggaattagctgactgtgggagggacagtctccccagggtcagtaaggccccagatgtcaaaacatcagaataaaaaggctaaagtggggtgtgatggtacatacctgtagtgctggctacttgggaggctaaggcaggaagtttgcttaagcccaggagttgggagtacagcctgggcaacacagtgagactccattcctctctctttttttaaaaattttattttaggttcaggggtacatgtgcatcctgttacacaggcacgtgtgtcatggggattagttgtacagattatttcatcacccaggtactaagcctagtacccaatagttatttttttctggccctccccctcctccagtaagctccagtgtctgtttccctctgtgtctccatgtgttctcatcatttagctcttatagtgagaacatgcaggatttggttttctatcctttattaatttgctaaggatggtggcctccagctccatctatgttgctgcaaaggacacgatcttgttcttttgtatggctgtgtcgtattccatggtgtacatttacattttgtttatccagtctaccattgatgggcatttaggttgatttcacatctttgctattgtgaatagtgctgcattgaacacacacatgcatgtgtctttatggcagaacgatttacattcctttgggcatatacccagtaatgggattgctgggtcgaagggtagttgtatttttagctctttggggaattgccagattgctttccacaatggttgaactaatttacactcccatcaacagtgtataagcattcccttttctctgcagcctcaccaggatgttatattttgagtttttaataatagccattttgactggtgtgagatggttatctcactgtggtttcaatttgcatttctctaatcagtgatagagtttttcatatgcttgttggctgcatacatgacttcttttgaagtgtctgtttatgtcctttgcccattttaatgggattgtattcttcttgtaaatttgcttaagttccttatagatcctggatattagacctgcatggtttgcaaatattttctcccattttgtacattgtctgtttactgtgttgatagtttctttagatagctgggttctaatggaacacagaaatgtaaacagccataatgtaagagataacagcgatgctaactttacaaagtagagatggcattcaaactggatcctgaacaacaagctaaaatggaatagcacagaatggctgaggagccactgtgaagaaaggcatgcagccatgaaactgcagtgtcccttgctgttagtgggggttagtgttagagaatatgatgggagatgaatcaggaaagatattctggggtcagattatggaggtcatgcgtacagtgcaaggactttatcttagaggccatgtttgtccagctgtcttcctagatctcctcttaggtgcctggtaggagtgagtgcatagctggtggggaggtggaatgggcagggcttccagagcagctgtttttgttttatatattaggtgtcaaggaaatactgattttaaaaagtggggggagtgttttactgctaaatgaaagtgtaaagatcatggttatagatgtggggggccagtgaggattcctaagtaggatggtaatgtggtcagatttgtaaggcagtgagatacctggcagcgctgtggaaggtggaatggaggcaggtggggactttgacactggggaataaatggaaagcctaaaactacttgggcctgaacaagggcagtgtcagaaaagaaactgcaaaaaaaggatgcatagaacctggcaactgattgactgtagaagagatggttgaagatagcaccaggtatctaagctgacttagtaaactctggtgccatgagctgacagggtgaagtttactttgggggtagtctttaatactccttttgtcttctaagctgagctctccagctgcagtgctttctttgttgcagtggctctgaccaatctggaagatatagaaaatgccaagagagcctacgcagaagcagtccacctggataagtatgcactttgttgagaatggtactggcgggggttggactctccaaagccatgaggtggtgccatacatagcattggtgctgcctgtgtcagcccagctgttcctctatggcattagtacatagcagacctcagtgtggagggatgtgtctcctaagtatgtggtggctcagcaggaattgacactctgagaaaatgtttccagtcctaaactgagtaatcaggaggctagagaatgtcagaactggcagtgggcttgggttgctgatagctatgggctagctggaatatcagatgggactctgggctgtttaattcaagataaaacttgactcttccaggatttactccgctggcatcttctagacagcagggtagagatccctttttcaaccctggcctaggtagtctctgttgagggctgagatgccagatttggtcccaataccagctttgcttgttaggccattaactccttgattcttctccacaggtctgcttagcacgtatgtacctaccttgctgcataatggagaaatctctacttaaccagttttgttttgtttttgtgtaatgagaaggatctctaaatgaccatttgttgcagagcccccagctccatagaatctctgtctgccacaggtgtaaccctttagtaaacctgaactatgctgtgctgctgtacaaccagggcgagaagaagaacgccctggcccaatatcaggagatggagaagaaagtcagcctactcaaggacaatagctctctggaatttgactctgaggtatgtcttttattagctcccaagagtcataagtaagctctcaggagacttttaaaaatcaagcccagatcatccaaatccaaggtattacacgttcatggctgttctggctttgatgttcctagcagcatgagttcatcaattaataacagcctgagaaaaactttcctagaataataataaaaggaaattcaggcttactgagttgttattgctaattcaactcatcaaagttgaggtctgtgtctgtctgtagcttccttctatttcactttttttttttttttttttttgagacggaatctcgctctgttgcccaggctggagtgcaatggcgcaatctcagttcactgcaacctccgcctcctgggttcaagcaattctcctgcctcagccttccaagtagctgggactacaggcgcgtgccaccacgcccagctaatttttgtatttttagtagagacggggtttcaccatgttggccaggatggtcttgatctcttgacctcgtgatccacgtgcccagccctatttcacttgttgtaggaaatgcactgtttggcccggtaatgcaccaggcttgaattgttgggttttgagatcctatgtgaaccaccatgccatccagtaaaggcaatctgtaatctctactgtttgataagtacttcctgcctcaactgctagtacgaccagacactatttcagctaaaaccccagctcgaagaccaaagaagtgggttggcttgtctctgacagtcacgcttttgattcttttacttcctttgtggacacaagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtaggaccatacagagctccatgaagacctggcaggtacaagccacatgtgtctgtcagcagagattatagctttcagtgaggttctcttcagactcatatgtccaacgtagtattggccacaaggggagaaaaaaaacacagggtggctaaattggcacttgtttccttaaggcgagctatgtagtaggtaacagctactcacagacttagttggatggtctatacactggtctttccaattttagcaatatgttattaagtatatcctgttatgcaatgtttaatttttactgctttatcagaagttgacacgtaaatatttttcagtgactcattgaaggcaaacttgactgttgctttatttctcagttatagtcttcccttatagttaatgggtcagtcccactggttccagaaaatatggggtttcctcttgaactctaacagcaaaaaagaatgatttcttctgaaattgtggaacatgaggattcaagtttttattttgttactaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaacctatgatcacggtcttcccttacctgtgtctaagcctattttgaaattggaggaggaacctcaaggccaagttcctgcttggtacaggcatggcctctgcagcaaccctgatgcatgataagccagcaatttgcttactgagggccagtccccattttgcactgaaagtgccctttaatcaccataatttaaagatagatagattagatagatgatagatagaaaactgacctactaccaaaccggttggagttccttattttattacagggtctgttttgacattgaagaagcagctaactgagcaggacccccttcatttcttgtatctcaaaaagtatcagaagtgatgcctttgtcattcagctggtggtatgtggcaaacgtggatttgtaccctgaacaattgagaacacttctacttcagcatggagtctagtatattagaatgaaatggtctagttactttctgaaactggaaaagtcttagtgaaaaaagaggaagagagatttaggagctaatatcaacaggaattggggattgattggatgtggcaggttaataattgggtacccatttcagggcttagataaccagggagagtaaaggaatattggactagggttgagggttggttgtggaatctagttttagatgtttaagatatctaatgatgatatccatcagatacctgaatagctagatttcaggaatgaaacctggtttgaagataaagattcaggagtaggccagatacggtggctcacacgtgtaatcccagcactttgggaggccaaagccagaggatcacttgaacccaggagttggagactggcctgggcaagatggctcagacctcatgtctacaaaaaattaaaaagccaggcgcagttgtgcgcacctatagtttcagctatttgggagactgaggcaagaggatcacttgagcctaggaatttgaggtggcagtaagctatgatcatgccactgcactccagcctgggaaacaaagcaagaccccatctcaaaaaaaaattttttaagattcaggagtaatttagatttgaggaatcatcaaaaccatagttttgaaaggagtcatccacggaaagctaggaataagacgacaggcaaccaaatgaaagaaaataagtatttagagggagaagcagaagagcccacaaaaaagcatatgatacaagaaaaaacccaggagagtggtattatgggaagccaacgaagaaaggtttgggaagagaatggtcagcctcattgaacacttccaacagagaggtactgttatccccattttatagaagagaaagcttaggttaggagagacaaaacaaattttcaaaggtaagtggcaggaccaggattttaatccaggtctggatgcagagctcttgctcttaaccatcaatcatcaagcagtgatgtatctttgatgaagcagtggtggcaacagaaacttaaggacttgaagactgaatgagtagatattggactacttttatttcagaaagctttgatgtagagggaagaggttttcagaggacagaactgtattcattactctgatatgagaaacttctaatatttggggagagaagggtaaaaaggtagtcttttttaagtatagcatggtggaaacagagaatgcaagagtagagtttttgagtttttccacatttgggggcaagatggtgctttgcttccagggatagcagtaaagaagcaatgctttccacattaatttgacttagattttcttttaaaaataaactctactagggtgtgcagggtcagtcttttgggcatgtgaatttgcaatttttcttttactctggtgagataggagctattctaacttctagtatgggggttggttgctcatgtcatcagaatttgtaacagaattaggaaaatgaaaccaagaacataatcacagctacggatgtggttttagaaaactgaaagagagaggcaggaaagtagaagtatgaactagcaatgagaaaaaagtatccttcttgctgaataatattgggcaaaactgtgcattccaaagacagtaaaccactttggagtgtgtcactacaatgatttttgttttcaaggaaaactcattattgtctgataatggcttagtagttcatgtcggaccaatccttccataaataacaaatgtaaacaagtggtaaatataaaatactctctcggtttaactttaaaaaaatacatatgattgttcaaagaaaaaatatcacagtgtatgtgaggctgaacatacataaataacatgacaactataaagcatatatggttgcaaggttttaatattttatgtagtgggacacaaaattaatcctaaatagtttgtgaaaagctgaacatggtcctagccagagcaatcagacaagagaaagaaagggcatccagatcagtaaagaagaagtaaaactgtcgctgtttgctgatgacatgatcgtatacctagaaaaccttaaagactcatccaaaaagctcctagaactggtaaatcaattcagcaaagtttcaggatacaaaagtaaagtaaagtacataaatcagtagccctgctatatgccaacagcaaccaagctgagaaatcaagaacccaaccccttttacaatagctgcaaaaaaacaaaaaacaaacaaaaaaacaacttaggaatatactgaaccaaggaagtaaaagacctctacaaggaaaactacaaaacatcactgaaagaaatcatagatgacgcaaacaaatggaaatacatcccatgctcatgtatgggtagaatcgatattgtgaaaatgaccatactgccaaaagcaatctagaggttcagtgcaattcccatcaaaataccaaaatcattcttcacagaattagaaaaaacaatcctaaaattcatatgaaaccaaaaaagggcccgcatagccaaagcaagactaagtaaaaagaacaaatctgcaaagccaaagtgagactaagtaaaaagaacaaatctggaggcatcacattatctgacttcgaactatactacaaggccatagtcaccagaagagtgtggtactggtataaaatcaggcatatagaccaatggaacagaatagagaacccataaataaaaccaaatacttacagtcaactgatcttcggcaagcaaacaaaaaagtggggaaaggacaccctattcaacagatggtgctgggttaattggcaagccacaaatagaagaatgaaactggatcctcatctctcatcttatacaaaaatcaactcaagatggatcaaacacttaaatctaagacctgaaaccataaaattctagaagataacattgaaaaaaatccttctcaacattggcctaggcaaagacttcatgactaaagaacccaaaagcaaacgaaacgaaaacaaagataaataaatgggacttaattaaactaaaaagcttctgcacaacaaaataaataatcagcagactaaacagacaacccgcagagtaggagaaaatttctgcaatctatacacctgatgaaggactaatatccagaatctacaaggaactcagatcagcaaaaaaaaaaaaaaaaaatcccatcaaaaagtgggctaaggacatgaacagacaattctcaaaagatatacaaatggccaagaaatgtgaaaaaatgctcaacattgctaaagatcagggaaatgcaaatcataaccacaatgtgataccaccttactgccacaagaatggccatagtcaaaaaatcaaaatatagatgttggcatggatgtggtgaaaaggaaacacttttacactgttggtgggaaagtaaactagtataaccactatggaaaactgtggagattccttaactaaaagtagttctaccacctgattcagcaataccacccctggatatcttacccagaggaaaataaatcattatatgaaaaagatacttgcacatgcttgtttatagcagcacagtttgcaattgcaaaaatatggaaccagcccaagtgcccatcaactgatgagtgagtaaagaaattgtggctcatgcctgcagtcccagcactttgggaggccaaggcaggcagatcacttgaggccaggagtttgagaccaccctggctaacatggtgaaaccctatctctattaaaaatacgaaaattagccaggtgtggtggcgcacgcctgtagtcccagcaagtcaggaggctgagggagcaggattgcttgagcccaggagtttgaggctgcagtgagctatgatggcaccactgcactccagcctgaacaacagagggagaccttgtctcttacacacacacagcaactcataaatcaagggaaaaaaagaaaaaaatactttgaactaaatgataatgaaaacaaaacgtataggattcagccaaaagcagtgcttagagggaaacttagaattgtaaatgcttctatcagaagaaaggagaaaatcagtgataacaggtttccaccttaagctagaaaaagcagagaaaaataaacccaaagtaagtagaaggaacaaacaaacaagtattaaagaaaaatttgagaagccccaaattctatggaaaaaaaatttatgataaatccctacaaagagctgagtgcggtgggtagctcatgcctgtaatcccagcacttagggagggggagtattgcttgagcccaggagttcaagaccagcctgggtaacatagtgagacctacgtctctccaaaataatttaaaaaatacagaataagttagcagggcacggtgtcacatacctgtggtcccagctacttgggaggttgaagtgggaggattgcttgaaccctggagattgaggctgcagtgagccatgattgtgccactgcactccagcctgggcaatagaatgagaccctctctcctgaaaaagaaaaaaaaaaaaaaatccccagctaaactgatcaagaaaaagacaaattaccagtatcaggaatgaaagcgggtataatattacagattctgcagacatgaaaaagggaatgttatgaacagttttatggcaataaacctgacaaatgcaacagacaaaaatctttgaaaaatacaacatactgcctggcatagtggcacacgcctgtagtcccagctactcaagaggctgaggcaggagaaccgcttgaacccaggaggcggaggttgcagtgagccaagatcgtgccactgcactccagcctgggcgacagagcaagacttcgtctcaaaaaaaaaaaaaaaaaacagaaacaagatgaaatgtaaaatcttaagtcctactaaagaaacagaatttgtaaatcaaaagtaatccttgaaagcagactcctggctcagatgattatactggtaaattctgtcaaacatttatggggcaaaataaattcaacctcacaaaaatttgcagaaaataggagcgagaacttaacttgtttgtatcaggctagcaataaccctgatgtcaaaactggaccaaagacattacaaaacaacaaaactatagactattaccctgtatgaacataggtacaaaaatcctcaacagaatattagcaaatcaatccagcaatatataaaaaggtgaatatgtaaatcatgaccaagttggagttatcccagggaccctaagcttggttcattattgaaaaccaaagtactcacatgcattaacaaaagagaaaagtcatatgattttagtagatacagaaaaaaagcaatttttcttttgagacagtcttgctctgttgccccggccagagtgcagtggtgcaacctcagctcactgcaacctctgcctcctgggttcaagtgattctcccacctcagcatcccgagtagctgggactacaggtgtgagccaccaggcccagctaatttctgtattttttctgggggaggggagggggggctgtttcgccatgtttgccaggctggtctcgaattcctggcttcaagtgatccacctgccttggcctcccaaagtgctgggattacaggcatcagccaccacacctaataattttttttttttagataaggactcacggttgcccagcctggagtgcagtggttcaaacagctcactgcaccctcgaagtcctggactcaagtgttcctcctgcctcagactcccaagtagccgggatcacaggcatgcgccaccatgcccagctaattttgtttaagagatgggggtctcactttgttgctcaagctagaaaaaaataaatttttaaaaagccagtatagccaggcatggtggctcacccctgtattcccagtactttgaggggtggaggcagaagaatcacttgaagccaggagttcaaaaccagcccaggcaacatggtgagaccccatccctacaaaaaaaatttaaaagaaaaattagctgggcgtagtggcacatcttgtgatcctagttacttgagaggctgaggcaggaggctcacttgagcctgagaggttgaggctgcactgagccatgatctgtgatcatgtcactgcactccagcctggatgatggagtgagagcctgtcttaaaacacacaaacacaaaaaacccatcatgtttcttaaatgataaaggactgttacataaaatatacaaataacttcaaaaactctacattaagaatacaacctgaggccgggcgcgatggctcacgcctgcaatcccagcactttgggaggctaaggcgggcggatctcttgaggtcaggagttggagaccagcctggccaacgtggtgaaaccacgtctctactaaaaacacaaaaattagccaggcatgatgcctgtaatctcagctacttgggaggctgaggcagaagaattgctggaacccgggaggcagaggttgcagtgagtggagattgcaccattgcacatcagtctgggcaacagcgaaactgacttaaaagcaaaaaaaccaacctgactagaaaatggaccaaaacccctcacctcaccaaagatacacagatggcaaataaacatatttaaaaatgttccacatcatatatcatcagagaaatgcaaattaaaatgagataccactacatacctattagaatgcccaaatccagaacactgacaccaccagatgctggtgaggatattgagcaatggactgttcatttatcgatgttgggaatgcaaaatagtataaccactttggaagacagtttggcagcttcttacaaaactaaacatacttttaatgttagaactcagcaatcacactcctatttacccaaaggagttagaaatatatgtccacacaaaaacctgcacatggatgtttacagcagctttattcacagttgccaaaacctggaggcaaccaaaatgtccttcaataggtgaataaatgaataaactgtggtacatccagataaaagactactactcaattctaaaaagaaatgagctatgaaaagacatgtaggaaactgaagtgcgtattactatagaaaggaaccaatttgaaatggctgcatcccacatgattccaacaatatggccttctggaaaaggcaaaactataagacagcaaacggatcagtggttgccaggcattagtggggagggaaggatgaacagagcacagagggttgttagggcagtgaaattaccctgtgtgataccatagtggtggatgcatgttgttatattaatatatttgtccaggccaggtgtggtggctcatgcctgtaatcccagcactttgggaggctgaggtgggcagatcacctgaggtcaggagtttcagaccagccgggccaacctggcaaaaccccgtctctactaaaaatacaaaaattagccgggcatggtggcgcacacctgtaattccagttactcaggaggctgaggcaggagaatggcttgaacccaggaggtggaagttgcagtgagtcaagattgtgccactgtgctccagcctgggtgacagagtgagactctgtccaaagccacagaatgtacaagactgaagccaaaagtaaattatggactttgggtgataaagatgtgtccgtatatatacatcagttgtaacaaatgtgggagatgtttgctttacatgttcttgtgggagatgttgatagggagggaagaggctatgcatgtgttggggcagctggtatatggcaagtgtctgtatttcctcaatttcctatgaacctaaaacttcaatacccttctcagcccctgagaaagtaaaaacaaaacaaaatcataaaaattctcagcaaataaagaatagatgggaacatcttcaacctgatgaagggcatccatgagaaaaaaaatgcaatggatatcatatttagtgaaatattgactactttgcccctaagatcaggaccaaggcaaagatgtttgctcttaccacttctattcagccttatactggactagagttctggccagtgcaataaggcaagaaataaaaaggcataaagactagaaaggaagaaataaaactctttacagatgacatgattatgtggaagatcctaaggaatcctaaaaataaattattaaaataaaagtgactacacccaagtggatttggcagggtcacaagatacagtcaatgtacaaaaatcaattgtatttttatatacaaggaacaattttgaaaataaaaaaaatcacaaaagtgtcaaatactattgatacgaaatacttaggaatttaacagactacacgttaagacctctactctgaaaacggcaaaagcactggtgtgaaacagaaggccattatagaaatatatatcatgttcatgcattgtacgactaaatactgttaagataaaaattcttccgaaattcatctatagatcctatcataatcccagcaggttttggggtagaaattgacttgacaagctggctctaaaatgttatggaaacacaaaggaccaagaacatgtaaagcaatcatggaaaaaaaccaaaattggaagacttacactgccttacttcaagacttactataatagtgctcatgtagcactggcataaagatagacaaatagagcaataaaacagaagtgagtgcatacatagaccttacagttatacagtcatttgatttttgataaaggtaccaaagcaatgcaatgggaaaagtcttttcaaccaatgttactggaacgactggatagctgtatggaaaagcaatctaggggcaggggttggggagatgtacaacacggtgactctacttaatgtattattgaaaatttcctagtatataaaaatacaatacaaaagaatttaaagaagaaaaagttattgaaaattgccaacagaagatttcaagtgttctcaccacaaaaaactgagacaatgcataattagctcaatatagctatatacctacagctaatgtaaaggtaatatatacatatttcaaaacatgctgtacatgataaaaacttacacattttatatacaaagtgagactatatttgtgacatgggcatggtccaatatttctttgggcatagagaacattaagacattaagaaaaaggatatcaaaccacagacttggagaaagtacaaaacatatctgacaaaggacttgtatccaaacattttggatgcaactcttattactcaaaaaaacctaacaacccaaacaacatacacaaagcaaacaactcaactgggggagaaaaaggcaaaagatttggacacttcacaaagaaagatatatgaatagtcaataaagcacatgaaaaagtgctcatatgtcattagggaaatacaaattgaatccatgctgaaataccactgtatacctgtcaaaatgggtaaaattaaacattgacaactccagatggttgtggggaagaaaagcaaccacaactgtcatatgctgttttagggagtgtaaatggtccaaccattttagaaaaaaggcctttcacccagcaatttccctcctataggcctttacccaagagaaatgacagtacgtctacacaaacacttgttgacagcagctttattcataataattccaaagtggaatgctctgtactcacagtggagtactatctagctataaaaagcaaccaactacatgcaacatggattactctaaaaaatactatgctaaatggaagaagctctatacaaaggactaaatactgaatggctccatttttaagttgcattctgaaaacaggcaaaactgatttctggtggaaaataactggttgttctggggcttgaggtatgcggtggggatgacttggaagtggcatgaaggaactatctagggtgatggagacttttcatttttgctgctccttgcagatcaagactaactcagacaatgtgcttggggctgtccattctgaatcttttttttttttttttttttttgagacagagttggctgtgctgcccaggcagaagtgcatgatcttggctcactccaacctctgccccatgggctcaagcagttctcttgtctcagcctccccagtagctgggattacaggcacccaccaccacacccagctaatttttgtatttttagtagagaccgcgcctgaccgttacctggccaacatggtaaaaccccatctctacaaaaaatacaaaaattagccaggtctagtggcaggcacctgtaatcccagctactagggcggctgaggcaggagaatcgcttgaacctgggaggtggaatttacagtgagccgagactgagccactgcactccagcctgggtgacagagcgaaactctgtctcaaaaacaaaaaggccaggtgtggtggctcatgcctgtaatcccagcactttgggaggccgaggcggctggatcacctgaggtcaggagttcaagaccagtctgggtaacctggtgaaaccccatctctattaataatacaaaaaacttagctgggcgtggtggcaggtgcctgtaatcccagctactccggaggctgaggcagttgaatcacttgaacccaggaggtggaggttgcaatgagctgggattacaccattgtactccagcctgggcgacagagcgagactctgtctcaaaaacaaaaacacaaaaacaaatttaccaaatggcacacttaaaatttgtgcagtttcactatataaacattttcacctttaaaaaaaaaaagaccagaaaacaaaatgttaaattattacaagtagcttttcagtgatttaaaatagttctaaagagacccaagaaattgtctgttcagcttggttataactgacaattatttagctcttaagtatgtgccccatactgtgctaaatattccacatggcagtctcctgtaatcaacagccctatgaaggtaggtaccgccattaaccccattttacagataagcaaagtaaggctcagtaagggtaacttgtccaacatcattcaatactcaccacctcaaaaccttttgtacaatttggatttcttctcaaacttgccaggagagaatacaatgcaaactgtacctgcataagatgacggatttttggctgtactcttacttcttggtagtgctttgtatgctgcagcttttcttttccctgaaactaaaatcagtttcaaatgaaagccagagggagtgtaccaacacttttcaggaagactcacccttcaccaggcatcctttttaggccaatggattttcaaagatttcttcatataaaatcatatgtaaaatacctttgtaaaacaccaaagggttgagaaacctgaagcccccacctgttcagcttatcctacccttccaactcacctctgcataatctgtcttgtgtgataaatacccatcacttctattgcttagctgcttcacaaaaaagatggacattctgcagggcgatgtatgtatgtttaaatctatatacacttagacagtcaatgacattttataaaacaatgcttacttatacttacccttataatgtatgatgtttttatactttttgtgataaccaccaaatggatttagtagctattagttcaagatccattatttgaaaaacactgctctagggtatgtgtagtctatactccctgaactagtctttactggcatcaccaatcaaaaaatggagaacgagttaagaatacacactcaggaccaggggcttagtcaacttagacattagaaaagatcatgtgaacacttcaggactcctaataaagtcttcttaggtttagaatataaatatttcaattcttgagaaaacaaaaatttcatgtgagcctttctaataaaaataggctagaaggttggtggttatttttaacttatctgggaaacagaaggaagaggtagcagccagagatttccttaatttaagcctagaatgcagctttgagttacaagctgcattctaggcttaaatttactttgaaggagtaatcaagctttcttatccaaagcagggaaagggaggtcataaatgaagagcttgaggtagctttgagattccagaagctgctgtgggcccaggggaaatgaagacccctgaactaggcaggcccaccaccagctgccatgttcatactgccctcccaacaagctgaaaaggctcaccatgctctcaaactgctatgctccaattcagctttaactgggctacttcatactagtactttgtgtcactttcaaccccacaggacaagcctatagctcaggctcagcatgagggactgcaagcacctcaagagcaaagtaacatgcacatcacaaatgaagatcagaatgatttttatcttatctggttccagagtggtgatggagacaaaaatcaattacagacagaattcctgaaatgtaaattgtttttaatatatttaagagcacacagaagtcttgatttataaaaaaataaatatataacatgacaaatttactgatgatcctggagctctgaggtcaaactctttaaatgatcagtgaaaacataaaacatccatgatctgttaacacacacaggagcatattccagttgtaaaaaacaaattccttgaaggctcagaacgaacaaaaatcagtctttatggcagaaagcacatccaaagctaggcaatgaagttcagcctgggccacgtgaacctttcaccagccagcctataacctatggagccaggacaggaaagcatgatccttcagctcatgacgccacccaggcttccagacaactgcagaatgaaagagtccctcagaggctccccagcccctgctgccatcataaagcacgggagggattgttttgtccttagcggctctgtcctaaatttgagagcaggagactgagaaggttatgctcattaaatattgtcattgtaacacggaatggaaatcatgatccttgcccatgggcactgagctgaaagaaagaggaacctcacatgaggctttcctagagaccaggatgttgggtgagtgggcgtgcacttctcaagtgggcaaggaagaactgcttttctccagctgacatgctctcaggggtgaagaagtttagcttaaaatacctgatggcgctgcataaactggggatttgggaactgagtttttagctctgtgacacacaacataaaaaacaaaaatccagtctcattagctaaattcggattaaaatctgaaatgtttttatggagttgccaacaggctggaatgtacctgatacagtttaatctgcttttatttctttggctgtcttccaaaccactttcttcctgtaattcttaagttggctagttctccttcctcagaaaaattacccctaagaatcttcctaatagtgagggtgtacttccgaatagaagagtccttcggctgaaatggcatctccaaggcctacagttcgaatggggtctttacacaccaatactggtgtgaagtggaaggatattccctctctgtgccattctactactggcttgtttgggtttaatacaatcctggagcctgcctccgaatgggaagtcatgaactcttggggtgccctcagagacactcggctggtgtctatggtttctgtggcgcaggcctgtgtcccagccacacgagctcctgcagccacggctgccagctggttggcccagtgtccatccacagttgccaggatgtggtagaccagcgtgtggaaatggatcctggtgagatccgaggctctgcttttactcctcccatgttctttcaagatccagaagaggatgtcactgaccatgcccacatcaggaacaccgttccaggaagagagagaagagtgaggtccagaggctgactgggtgagaaataacagctcctgttcattcagcccaagggaagtcaccgcgggaaagacctgctaacaaaaacaacaacaggtatctttctgatggagataacctggctcctaagatgtcttatgacacagccagtgactaaatgacagggaacacaggcaggcagctttcttccttgatacaggactccctggccctgaagtcactgttttagctatcacacccctatcttcaccttcatcatcatttgggagaaactggaaagctgcagtaacattgtttcagatgcagtcttttgtgatatgccactgtaagacaaaaggcagaggtgtctatattttgtgtttctttccatggtccctagcttttgccactgcacacataggagatactcttaccactgatggggcatggctctcagttcctgaatgtcagcagtattagaccagtaaaatggagacctcaagcaacatactgtcagggttataatgattttttttatacaaaacaccaagaagcaaaaagcatacagtttcatgttagagctaagctttttaaaagcaggtgtgggttaggaagactgtctgaatttagcaataacactgtaagaaaaagattaccaaacaggtgcccgtgttttctgtctgatggggaaccacaatatccacctccctgtctttcttacttagcacttccctccttagaaccagagaaccacacttaaggtaacaatttttgcaggagagaggagtccttgtatgtatgtgtgcatgtataaaatggttttaaaaatttaatggcctacatctttgttggagcaatagcagctttccttcactgcatgttcttctgtgtcaggcactgagctaaaggctttatttcatccaattcttactgtaatcttctgagggaaggagggactgcctccattgtacagactaagcctcagaagggttaagtagacagttacagagaaaatgaaatagaaatggctcatttttttaaaggtgagaagaaaaacccaaacaaaagctatactgaaaaacaccaagagtgaacccaagtgtaaactatggactttgggtgctgatgacgtgcctgtgtaggctcactagcttaacaaatgtaccactctggtgcaggctgctggtagttggggaggcttgtgtgtgaggggactggaagtatatgggaactctcttggattctgctctattttgctatgcacctaatattaccataaaaaaaaaatgaagtctatcaaaaaaaaaaaaaacaaaaccaacgacagtcagccctccatatccatggcttcaaccaacttcagatggaaaacagagtattcaaggatgtggaacctgcagatagggagggccaacttgtctaatccacagattccacagggccaactgcaggacttaaccatctgcagattctagtatctgggaagggttctggaaccgcccccgccgccccacacaccgctgatgacgagggatgactgtatactgaaataccattttttcatctgtcagactgatataaatgcaaattttaacattctggtagcaaggatatgagggaacaagtatttgtaattattgccagtgggaagtaaactggtataattcttatggagggcaatctggcaatctcaaaattacaagtgcttttttatgctccagtccagctgttctacttctgagactttctcctaaatatggacttgttcacaggcaaaacaaaatcatgtatcaagttgttcactgcagcactgtgtgtaacagcaaagggcagtaaataaccaatatgtccatccagaaggttcaggttaagtaaacggaggtacatctacacattcattttaaccatatggctatgaaaagacagaggatactctccatgttagtgatgcaggaagatctccaagatatatttagtgaaaaaaagagcaaagtgaagaacagagtattcagtaggctatgctatctttttgggtaaaaagggatggaaaacaaaatcaggatatatttctgtattttcttatacttgtacaaaagaactctggaaataaactgatgaagggtgcaagtagggaaggggaggaagtagaagggagacttcattgtatatcttttcatagtttttgggtattttttaaccaaatgaatatattaccaattaaaattaggtaacactagattgccaggtgaggtaacttgcctgagttcatgaagcccgtgagtgcaaggctggcatgcgaacccaggtctccagagcttgtgttctgaagcttcacctgctcagatttatactagtcaatgctgctgcccagaggcaggcactgaacacccagatgcctgaggaaggagggaggttccctcaaagtttctttgctttgagcttcttgaagttcaactgaaagcagctgagctgggctttcagttttttccattcactttcaacttttccattccagaggagaaatatgatcaacaatctgtcagttacactgccataactttaacctagtaggagatactgctgtttcagaacagtcctggatccttatttggatctccatggacttgggtctgagtgacacaaacctacatgtcagtgagccagtccctgagcccaaacagatggtcccactgcacaaaaaagcttctctgcaaggctctatgaggatcagggccaaacgatggtcccatgaggttacctgatggacaatgctgctcatgagctccctgttagtcatactggccagctctaggtgaactggaataccagtggggatgtcagaaatggaggttacaacctgcaaagagaagaagataagcactgccattagaaatagaaggaagtcaagaaagagggaagaaaagatcagatcctgagaggcggttcctcctggtaatggccttctttgcatgctcacgggagctacaagcaatgtgggtccccaccacctctgtggacaagggacactcttcccaccagggaagactaggctgtgcagagccatcagggatacagaatcagagatggcagttcacttcgactgctgtacgaatctgtaggagttgcagcatagctgatgtgaagtgagatgatacaaataacacaaaggacacaaactacaaaccctgcagcttgcagccatggtcggtttagcacaggatgcagaggctcaggcaagaagatgttctgccctgtcctactcaagctgctgcccacatctgaagggatacagtgaggtgcctcactgcagcaggaggcaagctccacagccagctgccaagatatgtccctgggaggccaggacctaagacaaggcagcagatgccaagagaggctggaacctgaagaaaaccaccagctgagatctgtgaaattctgtaacagtgccattacctccaagagtctcttcctctggagctccttgctttgtccctccatcatgtgcaatccagagaggaccaccaggtctggctgaaactcctccaggctagacacaaacacctccagcatattcatggccccgttggagaggtcgtgagagaagatgaatcggttggcatggggagcttttaactggccccactcctcccctggaaaaacccagtcaacacaatgggaagaaaaggaagaggctttaggtctcctagctgtgggggcactttcaggcacctcacaggagccttggctccaagcaggctggtttctggctgaggagaccccagcaacaatggcctaaggtcagcatggcactgcaagaaacaaaccaaaaacctaaacccaaacccagccaagaaacagaaacatagtatgggtgctatatgcctttttcaaggtaattagctccccctgagtcccaggagagccctacttgagctctcaaacacaggagagacagtacagaatggcagcatgacttccaaataccagcatacagtgtgcagcacgcacgccctgcagacagtataggctgtcattgtttaaagcacattcttcctcacagcattgccctgagcatctttcattcagttggaacttaagcaggctgaatttcttcccaacagccaagctcactgcatctcctcttccctgctgcccatcagtggtttctgggcacctgatccaaaggatcagactatctagctgctccagttgcttctatgtgagttgctttagaggaatgactgtttaaagacccaagttcaagtgctagttcctccctaaacatgaagcctttcctaatcctaccacccctaagcagacttgattacctcctttctggggccaccactgtaccctaatacaggactgaggcacatgattttgcaattcctttttcttttttccttttttttttttttttttcttctgagatggagtttcactctgttgcccaggttggagcgcaatggcgcgacctcagctcactgcaacctctgcctcccaggttcaagcgattctcctgcctcagcctcccgagtagctgggattacaggtacccgccaccacgcctggctaatttttgtattttcagtagagacggagtttcaccatgttggccaggctggtcttaaactcctgacctcaggtgatctgcctgccttagcctcccaaagtgctgggattacaggcgtgagccaccatgcccggcctgcaattactttttccaagtgtctatctctggcagtaaactgtgagctgagggcagggcctgtgtcatcctctgtcgtattccttctgcatcatgctgtgtctggcatatagccatgggaatgaattaacaaaagaacaagcaaataagagaacagactgatgacctaaatgcccatgacaacaaaaaatatgggtatgaaccccaaatccaacattttgcaaatcaacaaagactctgtacgatgggaaaaatacattacattgacattctccagagagcaagacgtggactcaacccttgaatagtgacactgctaggaaacacgacctaactgaacctaggagaaaggagccacactgtattgaaaatacactgatttcttcaggaagtgacagaggcaaaaataaacaggctcttctgcaaggcaaggatgagaagaaccgtgcagagctgcttgctgtttccacaggaaacaaggcagcagatgccaagagaggctggaacctgaagaaaaccaccagctgagatctgtgaaattctgtaacagtgccattacctccaagagtctcttcctctggagctccttgctttgtccctccatcatgtgcaatccagaaaggaccaccaggtctggctgaaactcctccaggctagacacaaacacctccagcatattcatggccccgttggagaggccatgcagggggcagatgcaaatggatctaattctgcctgtaatggtagttagcgcccctctttcctcacaaagtgttgtattcattcctgtaagcaatctcttctcaatgtatcatcctgccctcagccagtaagtcagcaaaacctctgcgtagtgactcactggattcccagcccaagcctgacaatgggcttctctggggagatctggtaagagagaatgtggaaaaaaaaatggacaaatcccttggaatttccctattgaggtcagagacaagctgggaatggatttctgttgagagagctgagcccagggctactgccactagactaggctccctccttggacctaggaaaatgtcacctcacaaagtttaatggaagtccactgctttgtatgcagaagaggcataggaaagaaaaactgaagtgtgaagcttataaacccaaggatggagacactctctttgtgcggtgaactgtgctgtctccttaactacatacgaggcacagctgtccaatacaacatcaaagtcttgctgaagacgtaagactctccactctgtagtcaccaggaaaaatgacaaaccaggaatcacaaaggtccccagttcctgctgtgggtgccaaaaaaactgacacgaatctggaactcatggcagcaatacctcaggggctcatctttagcaattccagacccttccagtccacagtcaggtcattcttttatttatttattattattattttttgagacggagtctcgctctgttgcccagactggagtgcagtggtgcaatctcagttcactgcaacctccgcctcccaggctcaagcaattctctgcctcagcctactgagtagctgggattataggcgcccgcctccacacctggctaatttttgtatttttagtagagacggggtttcaccatcttggccaggctggtcttgaactcctgaccttgtgatccacccgcttcagcctcacaaagttctgggattacaggcatgagccaccacgtgcggccaggtcatcttttcatccaagctgctcacaatgtttccgcacaccaaccaatctcttaatccttaccacaatgatcaggcagtaaaaactattactcttacttcccatttgggaaaactaaagctgagaaactcaaaaacttgtgtagcattaagtatgaattgcctacgtcaacgctgtgtccctaattttcagaccctatccttctttaattcccaactgattctagtaagcacccgaaagagaaccagaacatgttacaactcttttttctacctggagaaaggcataattctcaagaaataacatagttcatatcttatgttaaagttaattactctagtagagaagattctcttaattgacttggaagtagttcactgaagagtattaagtgctgctttaaggtaccaattagtctgtttagatgcttgagtctttaatgtgtattaacaatgtgttgaatcagaaactcaagagtctgagttctgagcagagggaaaattacagcaggaaatacacaggatcaaagtatgtccaagtatttaatattctctcagaaaccagatgcctaatctacgtaacatataaaatctgctgggaagaggggatgggatgcagtggatgtggatttattaacattagaacatctgatgggaaacaatatagtgatgttaaatacaaaacacttccattcacacacccaaggaaaaataaaatgctccagagaaacttgccagaagcttggaatcaaccccaagcagcttggaagagtcagtcagaaaggcctagggcagaatccagcacagagttgaatggatgctacctgcctttctcttgtcttagtcataaaggaaaactttatatatgtgtgtttaacacgttttcacttttatttgagatgcttgctttcctatgacctgatttatcttgggttcggagcaattctgcttgtagacctgggaattttcttccatgttataatactcagtctcccttgagacaacggccagtatcagctcagtagaaccaataggtcaggaaactttcagtatggcaaaaacaggatcctgctaatttacaaagataaatttccggcacagtcacaccccaatctgacaatacacagccccttgactggtcttgccaccattacttactcatttccttacctgcttgatactctaaaatgaggtggaactcatccacttcctgcaatgactctggtggaacaaagacattgtcatcaagaagctcatgtagctttggaccaactggaccgcaaagaagaacctggaggcaagcaacacgaagtccatcaggagccccgttcctttccccacagaacctcaacagcaccccaggacagtacattcaggctgattctaatcatttcaacaaaatattggaatccaaatctaattttgaaagctgttggtctggaggtgtgcggcagaaggcatgtcaccagggctaaggcctctggagggtatggccataatgtacccagaactgagaggctgacaaaagaactgtgtcacagccgtcaggcacctatgcagctgctacatctcattccctctgctgcggactgcacgtttgtgtcacctccccaaatttagatggtgaagcccaaacccccatgtggcttatttggagatagggcttttggaaggtaattaatatgaaatgaggtcataagggtgaggtgaggtcctaatcagatagaactggtggccttataagaaaagagagagagatcaatctctctccccccaccgcatgcaccaaggacaggacatgtgggaacacattgagaaggtggccacctgcaagccaggaagagacttctcaccagaagccacaccttgctggaaccttgttctggggctttccagtctccactgtgagaaaataaacttctgttgcttgagcccccaagtctatggtattgtgctactatggcagccaaagcagaccctacccccactttctttactcactcacaccttgtgcaggcaaacagacatgggatgttgtctgcaacaaagctgccagatgaaaactgtttgagtttttatacagtataaaaaaagtttctggatcaccatatcctcaaccgggtgacctcatttgtggaataaaattctctcccattactgaactgttaagtgaataggacagcctttccaatatgagaattaaagagcatcccaactgagagacttcaggggaaggtgctctgcaacttttccaaaacctttttcttcaactccaaccagagcctccctctggctattctttctagaagccatttcgtatctgttcctgctcctcaactccaataaaccgctgtttttgacacaacattcaaggccaggctagcagattcaaaaccactgaacaatgaggacggcactgagatttaaaggaaagtccacagagattatcagcactgcttcatgattttttttttttttttgagacagagttttgctctgttgcccaggctggagtgcagtggtgcaatcatagctcaccacagccttgacctcccaggctcaagcgaccctcctgcctcagcctcccgagtagctgggactacaggcataagccacaccacctggctaattttttatttatttttaatttttttgagacagagtctcactccgtcaccaggctggagtgcagtggcacaatctcggctcactgcaatctccacttcccaggttcaatcaattctcctgcctcagcctcccaagtagctgggattacaggcgcgtgccaccaggcccagctaatttttctatttttagtagagacggggtttcaccatgttggtcaggctggtctcaatctcgtgacctcgtgatccacccgccttggcctcccaaagtgctgggattacaggcatgagccaccgcgcctggcctaattttttatttttatttttaatagagacaagacctcactatgttgcccaggctagtctcgaactcctgagctcaagagatcctcccaactcagcctcccaacttgctaggattacaggcatgagctaacatactcggtctgtttcagatttagtatgtcccacccagaagcttcaaaaggcattaacttgctaattaactgcttatatagactgctttgtacagaggtactttcgtgttatttaagaaatcccaccttctggataaaaacatactcctctcccttttctgccttgacacatgcccattacaggccaattctgaaaaagtcttgccccaaccactttacttcctttctctaattcttggctagtgcttcacttccaagatgagacaacaagggccataggccatatttaccctcctgcctgaaacaacaaaaaagacaaaatatatgaaacaatggttttcaaaacattgtgtgaacatcagacaataaaggacgatccctaaaaaacaggactaaactggccaggtgtggtggctcatgcctgtaatcccagcactttgggaggctgagacaggcagatcacctgaggtcaggagttcgagaccagcctggccaacatggtgaaaccctatctctaccaaaaatacaaaaaatttagctaggcgtggtggcacacacctgtaatcccagctactcaggaggctgaggcaggagaatcacttgaacctgggaggtggagagccaagatcatgccactgcactctggcatgggcgacaaagtgagattctgtctccaaaaaaaaggaaacaggaataaacttagtaagccctacaaatgtcttagcatattactgtaaaagaatttccaggtatacggaacctgaaagaatttatcaccagcagactcgcaccacaagcaatgttaaaagaagtccttctggcagaagggagaatgacatgagatggaaatatgtttttatatttttttgagacaagagttttgctctgtggctcaggctggagtgcagtggcgtgatcttggctcactgtaacctccacctcctgcgtttaagtgattctcctgcctcagactcccaagtagctgggattatggacacacaccaccacactcggctaatttttttttttttttttttttgtatttttagtagagatggggtttcaccatgttggctgaaacaacctgaccacgccaggctggtctcaaactcctgacctcaaatgatctgcccgtcttggccttccaaagtgccggattacaggcgtgagccaccatacccagccaaaaatatggatctaaacaaagaaatgaagaacaacagaaatggtaatgctagataagtacataagattatttttcttattatttaaatctctttaagagataactgaagagaagtactaacaaatttaatgtgaggtttgtaacatgaggaagtcaaatatctcataataatagtataaagattggagggagagaagtacaggcctacctcattttattgtgcttcactttactgtgctctgcagatactgcagtttttacaaattgacagtttgtggcaaccctgtggtcccctatgggcaccatttttccaacagcatgtgctcacttcgtgtctctgtcacattttggtagttctcacatttcaaaggttttcattattatgtctgttatggtgatcagtgatctttgatgctactattataactgttttgggacaccacagatcattcccacataagacagtgaacttaatcaataaatattttatgtgttctgaccactccatggactggctgttcccatctctcgccctctccttgggcctcactaatttcctgagacataacaatattgaaattaggccagttaataaccctacaatggcctctatgtgttcaagtgaatggaagaatcacacatctctaactttaaatcaaaagctagaaatgattaagcttagcgacgaaggcatgtagaaagctgagtaaagcctcttatgctgttagccaagttgtgaatgcaaaaagtccttgaaggaaattaaaagtgctactctagtgaacatacgaatgtaagaaagcaaaacaaaacagaaacaaaaaacagcaacaaaaggaaagcaaaacagccttattgctgatatggagaaagtctgaatggtctggatagcagatcaaacaagctacaacattcccttaagccaaagcctaatccagagcaatgtcctaactcgctccaattctatgaaggctgagagaggtgaggaagctgcaaaagaaaagtcagaagctagcagaggttggttcatgaggtttaaggaaagaagctgtctccacaacataaaaatgcaaggtgaggcagcaagtgctgatgtagaagctgcagcaagttatccaaaagatctagctaagatcactgatgaacatggctacactaaacaacaggttcgatgtatacaaaacagccttctgttggagggtaatgctgaagaagtacgtaaaattattgtaagaagatgccatctaggactttcagagctagagagtagaagtcaatgcctaccttcaaagcttcaaagaacaaactgactctctttttggggctaacacagctggtgactaagttgaagccaatgctcactgaccattctgaaaaatcctaggattcttaagtatgatgctaaatctactctgcctgtgttctatatatataacaaagcctgaatgacagcatacctatttacagtttaataggtattttaagcccactgttcagaactactgctcagaaaaaaaaaaaaaaaaatgtttgaagtatcactgctcattgacagtatacctagtcgcccaagagctctgatggaaatgtataaggagaaggatgatgttttcacacctgctaatgcaacatccattctgcaacccataaattaagaagttattttgactttttttttgagacagtctggctctgtcgcccaggctggagtatagtgagtggcacgatctcagcccactgcaatctccacctcctgggttcaagtgattcttgtgcctgagcctcctgagtagctgggattacaggtgtgcaccaccacacctggctagtttttgtatttttagtagagacggggttttaaccacattggccagactggtctcaaactcccagcctcaagtgatctgcccacctcggcctcccaaagtgctgggattacaggcgtgagccactgcacctggctggaattttgtcaagtctattatttaagaaatacatttcataaggctatagctgccatagataataactcctctgatggatctgggcaaagtaaactgaaaacttctggaaagaatttaccattctaaatgccattaagaacatttatgatttataggaggaagtcagcatatcaacattaacaggagtttcaaagagattgattctaaccctcttggacgccttttgagattcaagacttcagtaaactgcagtaactgcagatgtggtgaaaacagccagagaactagaattagaagtggggcctgaagatgtgactgaattattgtattcttcatgataaaacttgaatggataaagagttgcttcttatggatgaacaaagaaagtggctgagatggaatctacttctagtaaagatgttatgaatattgttgaaatgacaacaaaagatttagagtattacatacacttagttgataatgacaaatagcaggaaggtttgagaggactgactccaatttttagaagttttttaatttttcatttttagagataggaatttgctctatcacccaagctagagtgcagtggcacaatcatagctcacagtacagtagcctcaaactcctaggcttaagagatcttcctgcctcagcttcccaagcagctgagactataagcatgcgccaccatgcctagctaattaaaaaaaatttttttttagagatggggtctcgctatgttgcccaggctcaagtgatcctcctgcctcattttcccaaaatgctggaattacaggtgtgagccactgtacctggcctgattccaattttgaatgaagttccactgtgggtaaaatgctatcaaacagcatcacatgctacagagaaatcttttgtgaaaggaagagttaactgatgtggcaaacttcattgttgttttaagaaattgccacagccaccccaagcttcagccaccaccctgatcagccagcagccatcaacatcaaggcaaaacactctgccagcaaaaagattatgaccgtctgaaagctcagatgattgttaacattttttggcaaccaagcactctaaaattgtgtacactttttttcagacataatggtactgcacacttacttgacgatagtacggtgtaaacataccttttaatgcactgggaaacaaaattcatgcgttttattttattgcagtatttgttttattgcagtcgtctagaaccaaacatgcagtatctctgaggtatgcctgttatcacttgaaagtagaccgtgataagctaaagatgtacagtataaaccctaatgcaaccactaagaaaaaaagaattatacctaataaagtcagagaagataaaatgaaatcatagaaaataatccaaaagagtacagaaaaagagggacaaagatagagatggggcaaacagcaaacaaatagcaagatgttagatttaaacctaacctgatatatcaataatcacattagatgtaaatggtctaaacactccgattaaaaggcagagattgtcaaagtggattaaaaagcaagccccaactatacgctgtctataaaaaatacactttaaggtaaaaagatgcaaatagattaaaagcacaaggacagaaaaagatataccatgccaatactaatcaaatgaaagctggaatggctatttcaatcaaaatagatttcagagcaaagaatattatgaaatgattttatttatccctagtaatgataaaggaattaattcattaaagggatgtaacaatcctaaacatttatgtacctaataagagtttcaaaatacataaagcaaaaagttacagaactataaaggaaatagacaagtatccaaaattacagttggagacgtcaacatacctcttaataactgacagatcaaatagacaaaaaaaaaaaaaccaataagaatatagaagacttgaacaacactatcaatcaacttcatctaattgacatttacagaacactcgacccaacaacagaaaggcttatgtatattcttgaagctttcaagtacacacagaacctcaccaagatagaatattctgcaccatgaaaaaggtctcaaaaacttagtaggattcaggtcatagaaagcatattttctgaccatactggaattgaaatagaaatcagtaacagaaagacatctggaaaatccccaaatatttaggaactaaataacatacctctaagtagtccatgaatgggctattaaatggcacatctcaataaatcaaagggatattagtattttgaaatgaatgaaaataaaaataatccatcaaaatctttgggatgcagctaaagcagtacttaaggggaaatttatagcactaaacccctatatgagaaaacaggaaaggtctcaaatcaatgattgtagcttctcaccttaagaaactagaaaaagagcaagtcaaatctgaagcaagcaaaatccaatgaaaatagaaaaacagagaaaaataaattcaccaaaagctaattacttattaaaaagagcaataaaatttataaacctctagccaagctgatcaggaaaaaaaagaagatacaaatgaccaatatcaggaatgagaaggaaaacatcattacaaattgtagagatcttaaaggaataatagaataccataattaactttatgccaataaatccaacaacttagatgaaacaaattccttgaaagatacaaactactaaagctcatttaaaaaaaaaaaaggaaaatctggatttccctatatctattaaagaaatcagttatttaaaatcttcctacagagaaaaccctgggcctagaaggcttcactagaaggcttaaattctataaacatttaaggaagatacaataccaatgcgacactcactctgttttaaaaattgaagaaagggccaggtgtattggatgaatccaagcactatggaaggctgaggcaggtggattacttgcaatcagaagttggagaccagcctggccaacacagtgaaactccctctctactaaaaaatacaaaaattagctgggcatggtggcacacacctgtagtcccagctactcgggaggctgaggcatgagaatcacttgaacctgagagacggacattgcagtgagctgagatcgccaccactgcactccagtctgggcagagcgagactccatcttaagaaaaaaaaaaaattgaagagaagataggtgtggtggctcacacctgtaatcccagcactttgggaggctaaggcaggcggatcgcttgaggtcgggagttgagactagcctggcaacatggtgaaacctcaagtctacaaaaaatacaaaataattagctggctgtggtgacgtgtctgcaatcctaaatactcaggaactcggctgaggtgggaggatggcttgagcccaggaggcagaggttgcagtgagccgagatcatgccactgcactccagcctggatgacaaggccagatcctgtctctcaaaaaaaaaaaaaaaattgaagagggggaaacactttccaacttattctacaaggccagtattgccctgacagcaaaaccacagacattacaagaaaagaaaaatacagaccaatattattcttgggcattgatgtaaaaattttaaacacaattttagtaaactgaatatgtgaaaaggataatgaatacatcagaacaaagtaagctttatcctagagatgcaaggttggtttaatatgtgaaagtcaatataattaccatatatcaaactaaaaaacaaaaaaccacacaataacctcagtaaatgcagaatttgacaaaagcatttgacaaaataaaataactattcctaattcttgcctaattccacaagtatatatttttttgagatggagtcttgctctgtcgcccaggctggagtgcagtggcgcaatctcggctcactgcaacctccgcctcccgggttcgagcgattctcctgcctcagcctcctgagtagttgggactacaagcgcctgccaccatgcccagctaattctttgtatttttagctaagacagggtttcaccatgttggccaggctggtcttgaactcctgacctcaggtaatccgcctgcctcggcctcccaaagtgctgggattacacaagtatattttttaaaggcacggttcctctcctgaaatttggcttctattctatcattccactaaacctgcctttactatattcaccagcgtctatttcaaagatgcaatatagcatggctattaggagaatggattctgaagcttgactacttgggttcaattcccactctactcattatcaggtatgtgattttcaccagttttaacttctccatgcctcatttttcctatctgcaaaatggggataataaaaagacttcccttatagggccctatgaagatttaaattggttcatacacatttaaagcacctaaaacttaaaacagtgcctggtatatggtaaaaaactatagaaggaagtgccagctataattaccacctctggaaaatacctagttcttaatctctgtagttctcagatgatctctcagtccatgttgagaagcatttcagaaagttaaactgagtctctttgagagtgcatacagggtgaagtaaaggcagagcctgacacttgaatcctgactctatcatttactagccaggtgcccctgggcaccttacttagcctctctagacctctgtctttgaaatcataagactgttgtgaggattgagtaacagaatgcttctctttcctcagtctcctaccaaagccagacctgttttattagaatgccttccaatcagactggtcccaggaccagctactccagagaccaagagcaaatgctggtcccaggggaggtcaatactgaaaggtcaatcttgtactcagccatgaccgtcctgggtattgtcttcccagagggcagaattatttctcaggatcaggagggtggcttcttaggaaaccatgaaaactcctgggattctgatgggaatggcctgggctctctctaaagggcttatgatcaatctccttttcttccacccattagctggtaatatttccaaaggtcagccctggaatttctaatcttctctatttgggagttaattacaatttataaacataatgactgcaaaagtctttattttctttttattattctttcttaaaagtattttctaccctaatatttcatgagaactttgattcctattaaaatatgaatgttcacattttaatatcctctctaaactgaaagcacatctatctccaggtgtatagtgtggctccatatgaatttttccctgaaactgctgatgacctatccgtatttctgagttcatctctggcttctggttccaccactctgactcacatttctatttttaggctggtcccccaaaactagaagactgttcacagtctgttttctagtgttagcggccacaaccattctgcactgatcaaggttatttactccataatcatctttgataaatctcttctttgttccccatgtattgtagtaggttttagatacatgtttctcctctctggctgctctaatccaaaccttaatcattatacaggaaaacagcgataactttcttgttggcctcccccttcaggcctattctactcatagcaagagaaacttcttactcaggtgttactgtgaacatggcaacgatttttaattctacttaaaccaaacaatttaagtcttgaagacactcccctactgactctcatctagtggcttttattttttggcactctggatccaggctcaccaacacggccaaccgttgttttccctcatgacttgtataatccttagtctcaaggcccacatgctcctaactattaaatgatatggtgcctaagaacatgggttattgggtcagactgcctgggttaaatttctcattccattaccaatcagttgtgaacctctgtgtgcctcaagttttctcatgcagaaaggaagaacaatggcagtaccgactagccttacagggtttgttgcaaggattagataatctatgcaaagcactaaagacaatgtcaggcacagagtaaacactcaaagtattagttactactatctcctactattactgcttcctaacaaaagacccagggtctggtacatagtaggtgatccataagttgaatcaaggaatagatactcattcttgctcctaaaattattgaaacactagggaaaggcataggttttaatctaaaaacttgacctacctttaaatctgagttggctgcaaatttctgtccaattaaagctgcatttcctcctacatagtgctgtaagagagttcaaggcttttagacagtattttaatacaactatatcacccaagtttaatcattttttattttaaaaattaatttatagtccatttcccaaaaacattttgaggtgattttacatcaaaggacacacagatgaagtgaatgcaacacagaaatagaaagtgagtaataagatgaagaaaataaataggacaaccatgaaaatgagtctgattgctttaactgttgatcaaattcagctctgagcttacagacagccagaagagacacaggaaacaggaaaagtgtggacagggcttatcgtctacattatagtccttctaaaatgaagaaaaatttcactatcctgtggaaaaatcattcagtagatactataatgaactaaaatctaactcttgagtgaggcacatatggcctttatctaacccatgttttccttactaccttcatctcctgcccttcccttccacaccctgcttacagctctccaagtcagccttcccctgtctctgtgcctttggcacatgctgtttccttccattaggacaccctccctttctcatatactaggtaaaaccctgatcactttccaagaatcagctgcagtgtcacctcttctgtaatgccttctctgttccccttacaccccactgacatctcagccttcacaaccgccctcaccagataggattacagatctcttcctacccctataacctgaacaaacctctaatgcagctcttgtctgcttgggctactatcatctgggtacacaactaggtccttcggggcagggactgtcttcttctgaagtgttcagtaaatgtttgttgctaaattttgagaaacgaagaaacacactgatgtgttgggaaacataaaagttttcctgggagtaaattctaaagataatgggcccctaatataggacagtactttcccttaaacaccacatctctcagctgaggacctggagaacaaataattcaaggttggtgttccatgttgctaaggatggatccatatgccttggaaatctgacacataacagctaaggctgctgttctattataaaagttgaaaagcctgatagtgttacctgggtggaatgctactatcccagcttcctagtcctcagcccacgcagaggcatagactaaaccaggggtgtccaatcttttggccgccctaggccacactggaagaattgtcttgggtcacacataaaatacactaacaataacgacagctgatgagctattaaaaaaaaagggtgggggggaggttaaatctcataatgttttaagaaagtttatgaatttgtgttggaccacattcaaaggcatcctgggctgcagactggacaaggttggagtaaacaattctagatggtagacatcactcttatcccaattttgtgctgactaacctctgaattcaggtgggacagtaatagctttttagagataatttaaaactttctgtgatatgtaggctgaaatttggccctttaacatgtcagccttaatgttttattcaaccacgatagttagaatttactaaaaaaaatcttgggaaaatagtaagatatctacaaagtggatttcagaattttcatataatgtttatcaacctgccttaaactataaggaagtatgaaaaggcactcctctagtgaaaggggttttacaatgttaagaaataacctggaccatcacaaagctagatcaagttgctgtaaaaatttttttcatcaagaaataaaggcagaatcaagagagaagagaaatcaaactggtggtttaaattccgtaatcataaagacttttgagcagtgaactcatcatgttagaactatcgagattctctcataagagataagaatctcactactgatcccagttgtcaaaatgataactgaaatcttaacttgctgtcacctttagaaactcagctaggtaatgcctatgtccatttctaatgttcaaataggcagcttcgaagacaaaaaacttatttttaaaatttttttgagacagggtcacaccctgttgcccagactggagtgaagtggcacggtcatggttcactgcagccttgacctcccgggctcaggtgatcctcccacaggcacatgccaccatgcccagctaattttttgtattttttgtagagacagggtttcaccatgttgcccaggctggtctcaaactcctgggctcaagcaatccacctgcctcagcctcccaaagtgctgggattacaggcgtgagccactgtgcccggcctaaaatcttaagtcatcaaaataaaagtagtcacaaaggtttgcctgtgaaaggtgccaattaaaaatggcattaagagcttccctggctagaactaccaaaccagactgggtgcccagccaaagggaggtttaaatgaggaggaagaatggggtgggggcaagacatgggagataaccaaccaaccaaaactcagcctcaagaggcatgagggtacatgtaggagcaggcatactggggtgaggtaggaagagccatggttgggtctccagccccagcactgcctcttattccacgtgaacctccaggaagtgcctggaccatgcagggctttgtatataatcaccaggtgaacttggaaaccactaaggttctaacttcgacaggttctaccttgcagaccagtggttctcaaaaggaggttctcagacctacaggatcaaccaggaaacttgctggaaaggtaaattcttgggtcccatcccacatctactgaatctgaactctggtagtaggcccagaaatctgtgtttcaacagcctctccaaatgattctgacacatgctcaagtctgagaaccatcaacctagacccacagttttcaaccaggggtgattttgctcccctcctcttcaaactggaatgaaaagttgcttgcttgcttctaggaaccatattaaaaaggcatctttttccacccttaatttactattgctgaaccaaacagacctgggctcctgggaactctgatgcaacctgggcaatgtcgtgaaaagtttccttatcactgaagaagcgctcagcagctgctcccttccccatgaagtgaatgaaggcttcttccagatcattccttgaatgcagaatgctgtgatctttcccattcccaggactaaggccaagtgcctgcaagagcttcacccctgagagcaccacatcaacacatgcattgactctagaaggaggaaaaaaactgtgtgaaagcagcagaagcaccaagtagccattttgcatttaacaaaaggaaaatgtttctcagaaccttattcaacagaaaaaacaggaagtaggtctgaaacctgaattgggaagtaaacagcacatggcaggagaaaaattactttaactggatttatgtattagcatcagaacacaggactcttcaataatttggcaaacttttacactagttacaaagtgagaagataggtgcttagcatttcagaacaaagctactgtaacaaaaatgtaacatttctgagaaaaacgctggcagagccaaacaggattcatgctggccgtgtgacttgggcaagtcactaatttctctgtgcctcggtttcctcatccacaaaatggcaataatatgagcatttaactcatagagctatggttaagattaaataagtgaatgtatacttaggaacagcaattggcgcagagtaagcaaaatatgtgtttcagtcaaaggctaggtatcaggcatcttccctctaaaaacaaatgaggatggtaagatacaataaattcctaaatgcctgagtactcccagctgaaaccctgcctcttagaatttagtggtgttttacagacttaggcacacctgcagcattttaagaactcaccctttggccagtgttcacaggactgacccatgaacgttaaagacctgccactcctggttgtctcgatggaaattataaagtacaggttgaatcccttatctgaagtgcttgagatcagagtgtttccgattttggaatatttacatatacatgagatatcttgggaatgcaacccaagtccaaacacatttcatatatactttatacatacagcctgaaggtaactttatacaatgttttaaatacttttgtgcatgaaataaagtttctattccttacgtgtgggtggaattttcacatataagtacttaatatacatcagtggcatcatgtcagtgccccagagttttggatttcagagcattctggatgctcaacttgtactaaggttgtctggcatgacctctcctatgtgtgtatggagaaagtctgtcttacattttcagggtttctttgctaagtcatccctcttttaaagagaacgttcaaataattaaggtagctagatgaggtcttcccgcccctacccctatcatggtcatctttattcctgcctctgcctattgggatgtcattctggccagtgaggttggattaccacacaggcagctcccagccggcaaactgagaccacccctagtgatacgggtgactgggcttcagagttaattctgagcagctctgaaaccacaaggtaaactcattaataaaaatgtcccaatggatgagattttggtgtaaaatacatagttgtatttcccttttagtctctttcaaaaatgaagaggaatgagactgggatgaagaggaattttaccaggtatatttctacttttaacatgcttgtattccttttagaatttttaaaatgacataactttaaaaaggtttgtatgcagactagatattatttacatcacttaaggaagatttacaagggcaaggaagagacatcctccctcaagacacaaagagactgcatcctcattataagggtcctttttattaattcttcccctagggattcatgttttgaaaggagttttgcctatcaaatagcatttaaatactcagtttcttgttcaagacacacataatgactctggtcaactggagaagcataacctaagatttactatgcctttcagtgcataaaacatctagctactgtatttggcccttctctttaaaagagggatgatttctagtaaagaaacactgaaaatataagccagaacttctccatgacacacacagaaggggccattctggacatgcacgtggcagttgcttaaagatatgtttaaaatctttcctttcacaaccttcaatgttaagaaaccaaacacaccttgcaaactggtctcaattttacctcagacatggtgccctttatttctaatgaatgcaacattagattggtagaatcaacaggaatacaagtatctgtagctctcagacgccagtaggttcctaagtttcagacagtgagggcttgagtaaggagggataccatttcctccagacagcccagtctaaaaaaattgtatccaaatggatttgggtcccgagtctgaagagtaaaggttcagaaatggagggaaacctgtctttgaaaataactacttcaaaaactataaacaccctcaagcctgtaatcccagcactttgggagaccgaggcaggtggatcatgaggtcaggagtttgagaccagcctggccaagatggtgaaactccatctctaatgaaaacacaaaaattagctgggtgtggtggtggacacctgtaatcccagctacttgggaggctgaggcaggagaatcgcttgaacccgggaggtggaggttgcagtgagctgagatcgtgccatggtactccagcctgggcaacagagcaagactccatctcaaaaacaaaacaaaacaaaacaaaactataaacaccccactctccatatctagtactgctgagattttaaacagtctgactccttaaaatgagaatggggaaagctgttcagtatattttgtaacacaaggcaaaacccaacagaactaattttgagttacaaaatatcactatcatggaacattttccatccctcacctaatcataccaggaataccgggggaaaataaccagtttttcagactggttcacagtttacttgataactttttataattaaaaaaaaccaggctgagcacggtggctcacacttgtaaccccagcactttgggaggccaaggcgggtggatcacttgagcctaggagttccagaccagcctgagcaatatagcaagaccccgtctctacaaaaaatacaaaaattacctgggtgtggtggtgcacacctgtagccccagctactcaggaagctgaggcaggaggatcacttgagcctgggaggcagaggttgcagtgaaccaagatggcaccactgctcttcagcctgggtgagagagcaagaccctgtctcaaaaaaacactgaacatctactacatgccggatgccaaacaagtactttacatgtactttcttgttctgttttataatactttaaccagaataagaatctttctctgcactttctcaactcaatagcatcccaaaatgtaaaaagcatattacctaaggggctgtattgtcaaggggaaataaagggagacacagttaaagaatcagaagacaaaattatgctcatctgacatgcaagcagaagctcacacttcagtaaaaaatgtatattagatgactgtgattttggagaaaacacagatgaaacaactagaaaataggtcaagacaacagatgctgaatgtcaaaatgggttggggggctggcaaagagggcacagttctcccttctagaccataagtgcctctaaggcaaagacgatgtttcctatctcctcccttctgtttcatcacctgtaaaatgttttctaaggttttctctagctttacattatgtgcatcagctgttataagagctaatcgtaattgttaagacatagaactgtaaagaggcgggggaaaaatggctagggcagtggtccctgtgctgaaccctagctcctgcatctagatagaagaaaggcggctgatctttaagaagcaccccacgctaggcaggcattttcagatagattaaacctatttgcaaaatgcggtaagatcgctaattagtcatcactgctttcagctgagaagagtgaggccatggattaactaacattccaaagcccacagacaggcagagctgaaattcaaacccagatttatctgatgatactgaaacccacgtaggaagtatacacaagcaaagttgtacatgaagggattaaccttgtgtttggatacaataaagaattatctagctagaatggagaattcatacaggggagaagaccaagatatgtttcaaggttcagggtgaagccagttccaggggcaataaatattagcatgagggtttttttttttttttttttttgagatagagtctcactcttgttgcccaggctggaatgcaacggcgcgatctcggctcaccgcaacctctgcctcctgggttgaagcgattctcctgcctcagcctcctgagaagctgggattacagaaatgcatcaccacgcctaatttttttatttttagtagagatggggtttctccatgttggtcaagctggtctcgaactcctgacctcaggtgatccacccacctcagcctcccaaagtgctgggattacaggcgtgagccaccatgcctgccgggtttcatcatttttaaaccaatgaataggtaccagagtctgatttagaagcaggggaagtttcctagaaacgccttaaaactcctcctatcctttacttctttgaccccttttcaccagccccttaatgcactagcatttaagggctagtgcctcccagaattccacctttaccatttttaccttctcctcttctcttcctgggtgatcctatccagtctctggcttcaacctaagtgccagtgtctccaaaatttgcaatcctgtttctcaatatattcctaaaaaccagcttctcattttcagtagctgacagagaagcttcatctgaaatcccataacaatgtatgtacatttctcctcctctgaaatccaatttatcttctgaaacttgtttttcttaaatctctcttaatggcaacaacatggcatcaacaaggaaccagaaatgggaaagaccaggcttcaattgctcctctggcacttgatagctacaagatcttgggcaaataaatcaatgtgagaagactcggtgacaatatctgttatctgcctccctcataaagttgttgcattagtcaattttcataatgctataatgaattgcccgggactgggtaatttataaaggaaagaggtttaattgacttacagttcagcatggctgggaaggcctcaggaaacttacattcatggtggaaggtgaaggggaagcaaggcaccttcttcttaaggtgtcaggaaggagccgtgccgagtgaatagcagggaagagccccttataaaaccaaaggatctcatgagaacgaactcactatcaggagaacagaatgggggaaccgcccccatgattcaattacctccacctggtctctcccttgattagcttatggggattacaattcaagatgagatttgagtggggacacaaagcctaaccatattagttgttataagatatttaatactgggctgggtgtggaatcacagctgtaattccagcactttcagaggccaagatgggaggccaaggcctgatcccagtagttgaagaccagcctgagcaacttggcaaatcctgtccctaccaagaatataaaaattagccgggtgtggtggtacatgcctgtagttccagctactcgggacactgagcatgacaggtcaaggccacagtgagcttgaacatgccactgcacacgccagcctgggtgacagagtgagatgctgtctcaaacagaaaacaaaaactaaacaagatatccaatattaaaaacctgtcgtttttgactgcctttctttactccaccacatccaaactattattcaggttatctctcaaatctcacctcttctacatcattgccgagtttggttcgggctcctttctccctttacacaaaccctacaatggcctcttaaaccagtgtcaggatgtcaagatattcctccttatgaatcacattaaatggcattttgagtgtgtctgtgtgacagagagtgtgaatacgagtgtgtctctagagaagtcaaactacaacctcaaaatgagattctgatacaagtactacacctgctccccctcatccctcctatatccccctatctttgggctaaaaatcctctttgggtaataaatgatgagaagcagtgaaacagtttagaaccactgctcaaaatccacccttcacattcccaccaattctcaacaaagaacttgtcatcagttaactacttacaaacctttatggcttccccataaaaggcccttcacaatctggtccaacccttcgttctcagcatcatctctttacaaccctctaccataggattctcgctccaaaacaaggccgacctgttcccaaacaaaccatgtactttttcacatttggttctcttgcctaggtggacctgttcccactttggcttgaagaaatctcatttatttagtgtctgtcctatgaaagtcactgtagtaaaatatattttccaagatggtggcaataagatgccccattccaaatgttcttttcacaatgtgacactgatgctcctcccatcaaggtttgttctatgtcccctcccttaaaaccaggtggacctgtgactctggtagaagagttcctatgtgcttctaaggtaaggtcgtaaaaggcattaaggcttctgcctggtcctcgtgggttgttcctcttctaaccataattgttatggattgaattgtccaccccccaccaattcatatgctgaaaccctaattcccaatgtgactatatttggacgtagggcctttaaggaagtagttaaggttaaataaggtcatacgggtgagccctattccaaaaggacctagtgtccacataagaagaataagaggcaccaggagtgtacatgcgcagactaactgaaaagccagctggctgcaagctaggaagagaggccacatcggaagccaatcctgccaacaccttgatcttggactatcagcctccagatccacgagaaaacagatttgttgtttaatccacctaatttgtggtattctgttctagcagcccaaatgactgatacaataatatgtttccaacaagtgagacaggggccttgcttcacccatctctgtatcttaagaacctagcacagacctgacactaaccatgtagttggtgaatatctgctgaatgaacgcgcataaagcaaggaaggacaatttaatcccagcactttgggaggccaagatgggaggctggcttgagctcaggagttcgagaccagcctgggcaatatagcaagacctcgactctactaaaaaaaataaaataaataaaaaattggctgggcgtggtggtgcttgcctgtcgtcccagctactccagaggctgaggcagaaggatctcttgagctcgggagttcgaggctgcagtgagcagtgattgcaccactgcactccagcctaggcgacagagagagagaccctgtgtccaaaaaaaaaaaaaaaaaaaaaccccaaaattatagctaatatcgaatgctttttaaagcaggcactatgctagagagattacatgaatgatgtcatttaatcttcaggccaagtttgctctactttacccctcccggccccaacactccacagaaagtagtgagctacatggtagagggcctgcttttatgtggtggttatacataactctgagattacggcaagaaagtcaaatcgaactgagacagggactaaagttagtgtttacagtatcaatactataaagaaaataattacattcccaaggaaaagtacaaagaaaggaggtagtgtcatttggaagaaccttaaatatgcagtgtcactgaagtcaggggaagaaaagaatttcacggagaagggcgtgttcaatgcgtggaaggctgcagagtagataatgaagattcaaaaaggcaaatctgagaggagttgcagtacagtcgtgtggtttctagactacacggcgtttcgaaagtgggtaaaggcagacatcacgcgtcttcaagaagttcagaagaaagaggaagagtgttgtcatagtgggtaaggtcaagtatctttgattgcaaaacaacagtcgccagaagagaaggggctaaaagttggaacgaggaagaaggctcggagaaaggtgtcagacaaagcgggattagcaagaagctgttagggctggtcctaccgggatgagagaaaggcgcagaggccagccgagtggaaagagcagcggtgacgaaccgggttccactcagacgtccgacacttctcgccaaggggccagcgcggacagcagcgcctcccggggacctctgagaagccctgtttctgcgcggctccgcccgacctccaaggccgacctcggaggctcagagacccaggccccgttggcactcaccccactgccacgcggcgccagcgccggactggccgcacgataagcgcgtcccaggctgccgccaaccggccctcgggggagacgggtcccgggggcgcaggcgcgggccccagacacagcgagctccagagagagcgcagcgccgagcctggcagctctggctccagcaggaagacgcagcccacggccagcgccaggaagcccgcgtacgcggagccgcgccacagcgccatggggacccaggcgccgcacctgcgcgaaccaactcctttcctagcccgcgcctcttccgggctcggcgcgcgccgatgtcgacacaagcgctacgtcacaagggtgcgccacggggccccccaaggggcggggcgacgggcggcgccaggacggagcgaggggggaccccacgcctcagtcccaggcctggcactgcggtgttgccgccccggaggaggtgggacaacggcggttgtgccagtccgggcgctgcacccccttcccggaactctaatcgtatccccaaatagagggatgggaacacatttgctttcgcagtaaaacgaaacggacagattgtgaagaagcggacaaacctcgcgttaatattcgaaccagtgggtgtccccattggcacggatcacacccccatcttttaatccctccctccgcccgtgtcccctcatttgctagacttgtcctcttccaggcctagtgctcggcgcttctgagaggaataggctcacagaatagcggcgctgccgagacccctggggtacgcgaggcagggggattccgcccctttggaaggtggccgagaccctcagccactaaaggacttcgtcgagacaggagagcccgcagagatcgttctcttctggataaccagattattccacaatcaaactttaacccttttgggggcgctgttccctttaacaaactctggaaaatgtacacaatcttgtgcacaacacgagagttatggacctgggttgagaaacgctgctttcttttgttcccccttggtgacatcacttaaacccagccctctcttcgctgatacttttctgtgcatgaggctaggttgagagacagtgaagctaggctgggtaccagctcattctcatcagccacaatgcccggcctagtcttgttccctggtttgtttccacttttccaattctctcggctcctgaccttggctttgtgtccagttttccactgtgaccctgacctttggacttggcagcgaaactttatttccctaactttgatcttgggcattagtcttcattctcctcagccccacctcatcagaacttccccatcctggtcatctaccttcccgcagttcatcctacccagcctacctgaccatgccatccctttcgacaaagatattcacacaggaacagatttgggctaccttggaaaagaagccaaagagccagtcagatctttatgaagccatgaaagccatcttccctagagttgcctgtcacttctctctccttagggagacatgtcagtcagttcctagagaaactgcttcttctcacaaccctcagctgtcaggtttccctggcacccagaggggactgagccagcagctgacctgaaaacagcgagtctgctgactgtccagcgatcatttccctctattgagaattttaaccaagtttctgttgtctgtagttatttgatattggctgtggacccacaaagtcacacaaggctaaaggtcagaaccagttaaatatgtttccaaggtgaagttttggggagcacaggaagctgaactgtgggaaggtgatagaacagacagatctagaggactaggagagtgctccacattaaagtgatgtggacagaaacctgcctggggctttcttgctcccacgagaggctgctaaacttccagcactttgcacctaattcttctgcttctttctagatttgccagaattgttgatttagtcacagagacaaaacaacagcagttgaacaaagtggatgtttatttctcatgtaaaagtctaaatggggtgttggcatgttgtgggctgtggtagcaagcttggccccctctggttgctatgggacctgctgtgggcctcttgctggttagtcactcagtgtgggtttgcattgtgggtggtgaagggggccagacaaggaaacgagagagctgacctcaattccaactgagaactgaagagtcaggagccgcaggaggtgaagaacagaacaccagggacagttgccaggcctggcggagcctgatgtggcttctggtcacatacagagtcacagggcccttaattccttctcatcggggctcaggggcaggcattcactgtcttggtgccacagtccctcttgaaatatttccttaacgaaaatcagaaaagattctgatcatctatctgttcagagagtctggaatcctttgcaagccaattgtttttctagaagttaggtttctggggacaattaaaacagctctgagtgggcagctgtggctcctttgcctaggctgaacaaagaggaaagggctgggctgggcaggcctcaagacaccccccgcccccacccaaattgcttccagacatggcctttcctattggttctctctcctaggaccttgaaatgagagaagaaaagcaatttggttctagaaaattcagaggcaaatggaggctccaggtgccccacccaagatcctgacctggaaggccagggagcagatcctgtatgaacacaaagaattagcagaatcctgtcagcttccaaattagctgaaggttttggctttaacataaatacccatcagcgtcacccccgcaatctgaaaggccttaaggggcacatttgttcccacgtggagcagaaactaaagtgggaccaaatggtccctgtgaaagctgggctaacccactttccttgcagctccaggcctctggggtttcatccaagctgctctttgaaggccacactgtgtcaaagcctttgttgatgccagggacacagcccaccacaggccatgcccaaaggccagagtcagagcacaattttgaagattacagaaaactccaaagagattgaagagatggaataaaggatcccagcccccgaaaagagaaagctttgtgtctgtagccatagcccttggcaatcagacatcctcctcactaatgtgaggtcaggaggggactagaagtgctcagaggatggactgcctctggccagtgcaggggagaggcaggggtgttgaggcacaggagccagatgagaggaacgtcagcagcaaagcagtaagaagaacatgagagtttcttgatagtaatagaacttcctacacagactgggaaccgggttgtagcttgaggggatgtgacaacatagtggcccggaattttcactttggaaattaactgctttggaccaggaagaagcgctgagcctagaaaggcaggaggcacaggactgtgtgggcttctgtctggcagggacctatgagcttcatagggcgaatgaatcggggcaggataaagcagaggcctccaccctcacagtgctcttagccatctcaggcttcccggaacactgctaccaggctgcctgctggagccctttacactcacaggccttcctgcttgggttctcttctgcaggctgcgtaaaccagtcctgttgtagcccttgtagcatctgctgtagtgatctggtttgggtttcagtattacttgcaatggtttggaaggaaatgggaagtttgccttctaactacattttctttttgattcaagaaccctagcagttctacaaccactgggcctaaaactaaaataaaggaaaaataaataaaaggaagcaaaaacatctaactgggatggcctggcagcattgccagagagagtcctcaggggcccatgcttgttctgtcttttgctctgccatccctagggtggacagcacggaagaggcagtacatcttaacaaaatcagggttctggatgaagggaggggtggtgaatggttgctgcaatcaacagttcatacttcaatggaaagaaggtgggatttgattcctggctgcaaatcttcactctgtcacctgctatctgtgtgccctcaggtaagtcatttaacttttctgttcttcagtttccttatatgcaaaataattcctactttgcagaatggttgtgggaggtagagttatcttaagacagtctagcacagtgtctgctacatgctggaattcaaaacattccctgctgttgctatggttggttctgagagctatatttaattttctttttagtctttcttgctggtctgtcactctcttactataaggaagacagccatttctgcataggtcactatgcagtagccttttctattttttgacggcttagcatctatgtaatatcccactgaatgaaaatactaaaatttatctattgtactatgaatagacgatttggagttttcccagtttttttactattacatacagtgttgctatgtatatgctgtggtacacgtgtatagccatttcttcagggtagaaacaaagtaacatttctgggtcatatgatatgcctgtcttcaactttactatataatatctgacatctttccaaagtggtatgccagtttatcttcccactggcagcatatgagaatttctgttgctccagctacactccaacagattcttaaagctttgtcattttgtagggtgtgtagtggtatcttactgtggttttgacaagtttccatttgttggttatttgcaagtatcttgcctccctcccagtcacttgtctattcattctttttataatatctttagtgagtagagttctatgaaaaattattcttatttatgtatttttgtagagatagggtctctctgtgttgcccaggatggttttgaattcctgacctcgagagatcctcctgccttggcctcccaaggtgctaggaatacagttgtgagctaccatgcgcaggcttaaagttcttcgtttttagtgtagttaccgttttgttctttttttattactactttccccttatcattggtgctttttgttacttatttaaaaaatcttcccatactcaggatcgtgatggtattttcctgtacaaccttctaagagctgtaggctttcacatttcatgtttaggtatttaatctaccttggaattgatttttgtgtgttgtgagaagaatgcttatagatacccaattgacccagtgccttttactggtcatttctcaatgactctgcattcccacctctgtccaataccacgtgtctatgtatgtgtggatctgttttggggctcttcaatctgttccattggtctatttgtttatcagcgtctcactgtcttgatatctgttaatataaattctttctccttactcttcaagagtgtcttggctatctttggccttttaaaattcccatatacatttttgaatcaacttgtcgccctccctcccaaaaaaacccaattaggatttttatcattctaggactatggtagatcccttcatttatttagatctacctaaatgtctcccaatatcatattagactttttgtggaggatttgtatgtctttagtaagttttattactaggcacttaatatttttagtatgcttattgaagtaaaattgatatgcattaagtgcataatatttaaagtatacaaattaataagtttaatatatgtatacaccctgaaactgttacaggaaaggggtccagatccagacgccaagagagggttcttggatctcatgcaagaaaggattcagggctagtctgtagtgcaaagcgaaagcaagtttattaagaaagcaaagtggtgaaaggactgctactccatagacagagcgggacgttcccgaaactaagaggaggaacgcatccaccctaggtacaatgcttgtatatatggagagatgtgctctgctacaagggtttgtgataaactattaattttcttaattatcgtatttggcaagaatcaatattattatctttcaagcaaaattaggaatgcctttgttccccagatattgggatatctggacactcccgagtctgggtctgttttagtaaacattattaatttgttcccttaaccgtaaacatctagaggctaagaatgcctaactttctgggaattcagtccagcaagtctcagcctcattctcctagccctcactcaaagtggagtcgctctggttcgaatgcctctgacaaaaccatcaccacaatcaaggtaatatagtaaacatatccatcacccccaaatacttcctcatggccctttgtaacccttccctcttactccttcctgcctgtacatcctcccactccctgtacctaggcaatctgctttctgtccctacagttcagtttacactttgcagaattttatataaatgggatcatacagtacatactctttttgatgtggcttttttcatacagcataattatttttgagatttatctaggttatagtgaatatcaactgttaattgctctttaaaaaacttttaacttcaaaacagttatatattcacaggaagttgccaaaatggtagggtctgtgtacccttcacccagtttctttcaatggatatatcttacataatcatagtgcagcatcaaaaccagtaaacggacattggtgcaaggtgtatgtatagttttgtgccgtcttattatatatggagattcgggtaatcaccactcaatcaagttgcaagaactgtcccatcaccacgaagatctccctcatgctatccctttagtcacacccaacccccatcctctaccattcctagaccctggcagccactaatctgctttgcatcactgtaattttgtcattctgagaaatgttataaatggaatcatacagtatgtgatcttttgagagcataatacccttgagatgcatccaacactgttgcatgtgtcaatagttcatttttgttatttatttttattttttgactgagtaatgttctgtggtatggaaagatcacagttagcttagtcattcactcattgaaggagaactccccaacaattgctctggacatgctggaattttttttttctgttctttgttcattcttgctcatggtgtgttacaaatatcataattctcctttttctctgtgaccttgtctctcagtctcccatcaaggagtgatgtctatttctccacttcttgaatctgggctggccttgccaatagaatatggcagaagtgacatcgttccatttctgagtcaaagcctgagttgttgccagttttgggcaattggttgttgccagttttgggcaattgcaaataaagctgcaataaacaatcatgtacagagtattgggtgcacatatttcatatctctgagagaaacgcccaggaatacaattgctgggttttatgtttagttttcttttacatccccacaggcagcatatgagagatccagtttcttcacatcctcaccagcacttgatattgtcactaatttaggttttgttctaatgggtgtatagtgacatctgtttgtggtcttagtttacattgccctaatggctagtagtgttgagcatctcttcatgtatttatttgccatccatatatcttcctcagtgaagtgtctcttcaggtttttttttttcttttttgagacagaggctcgccctgttgcccaggctggagtgcagtggtgtgatctcggctcactgcaacctctgcctcctgggttcaagcgattctccagcctcagccttccaagtagctgggactatctgtgcgcaccaccacacccggctaatttttgtattttttagtagagacggggtttcatcatgttggccagtctggtcttgaactcctgacctcaagtgatccgcctgcctccgcctcccaaagtgctgggattataggcatgagctaccgtggctggctgtctcttcaagccttttgcccattttataattgaattgtttgttttttgttattgaattttgagactatatatcatatattatagataaaagtcctttgccagatacatggtatgcaatattttcttccagtcttttcatcctcttaatagagcctttcacagaataaaagtttttcttcttgatgaagtgtaatgtgttgattattttttcttctatagattgtgctagtttattgctttttgttgctgaatagtattccattgtatggatataccattatttgtttatctattcatttgttgatggacattgggttctttctagtttttgactattacaaataaagttgctatgagcatttgtttacaggtctttttgtaggctttaattgctcttgggaaatatctaggaatggaatacctgaatcatgtaacagatgtatgttccactttttaacaaactatcaaattgttttccaaagtggttgtaccgttttatatacctaccagcattctattagagttctagttcttctgtttgcttgccaagacttggtacggtaagtcttttaaatttagccattctaataaatatgtaggtatatctttgtcttaatttttattttcctaatgactaatgatgttgagcatcttttcatatcttcattggtcaagtatctgttcatatcttttgcccatttttattagattgtttttttcttattactgaattaaaaaaatactctggatgcgagtcctttataagacctgtgatttgcaaatattttcttgtctgtcttttcattcccttacctgttatattggattagtggccaccctactgacctcatttaaacttagttacctttttaaagactgtacagtcacattttgaggtactagggattaggacttcaatatatgaattttgaagggaatacagttcagcccataacactccccaacaattgctctggacatgctggaattttttttttctgttctttgttcattcttgctcatggtgtgttacaagtatcataattctccttttctctgtgaccttgtctctcagtctcccatcaaggagtgatgtctgtttctccacttcttgaatctgggctggccttgccaatagcatatggcagaagtgacatcgttccatttctgagtcaaagcctgaggaggccttgcatgcttctactctctcttgcaaccctgcactgccacatatcaacaagacttatcaacaagcctgggatagcctgctagatgatgaaagaaatatggcccgcttgctcccatcactccagctgatagccaggcaaccctaagaagcaaagtcacctagctgattagtagctgaccactgacacaaaagtaagatcatctgagaccagaagacagcccatctgagctcagcccaaattactgacccacaaagtaataataaataaatggttattatttttatgtcactgaattttgaagtggtttattattgaacaaaagctacctgatacccatcttttttttttttttttttgatatggagtctcccactgttgcccaggctggagtgcaatggcgtgatctcggctgactccaccctccgcctcctgggttcacgcaattcttctgtctcagcctcctgagtagctgggattacaggcgcccaccaccacactggctaattttttgtattttcagtagagacggggtttcactatgttggccagactggtcttgaacttctgacctcatgatccgcccacctcaacctcctaaagtgttgggattacaggcatgagccaccgcaccaggcctacccttcctaagagtctttgctctggctcttactttcatctggaatactctgtgacttgatctttgcatgcctggctgctttatgtcattcatatctctgctcaaatacaatttcctcaaaaagggctacactgaccaatcaatataataagcctgtaggtctctacggcttctccctatttatttgtttatttttagagatgaggtctcactctgttacccaggctggagtgcagtggcatcatcatagctcactgcagcctcaaactccaaacacttgggctcaagcaatcctccctcctcagccttctgaatagctgggactacaggtgcatgccaccttgactggctaatgttttttttttaatttttttttagagaagggggtctcactatgttgcccacactagtcttgaacccctggcctcaagcaatctcctacctcagcctcctgggtagctgggattacaggtgtgagccacaatgcccagccatttttttttttcttacacagaaaagctccaatattcacttagatactgcagaaggaaaagagaggctgaaagggttggatcaaggaagtaggaaagggaatttctggggcatttccttcccccaatcccagaatagccacagaaatcacagtcaccaagagctgctgcttctgaataacatgacagtgatggtaaattttccaaaatgttgattgtaacagagtttgccacatgaccaaactggtggatcatagagtggacagacatcaggagctctggaaaaaaaattgctactcagtacctactcaagttgtaatggggagagaaatggactgatatgccggatttttgttgcagagagctggcaaacttgcagtaagtaactagctgcattcaaactgactgacgcacatagatggagccctgaaatccatagctccgttgaagaggcagcagaatttatctactccgacccaggtttgcggaatttatcaactccaacccaggtgctaggctgcttgtggtagggagtgaagccatcatgctgatggatttggtggtgacaaagcaggctgtcaggaagaagtaggtcccccagattctcccgggcaaggggacaacactggaaactacatgtggtagtttccagtatgttaggcttttccttctgaaacttggcaaagtagaatttgctgaaaagtaagcagtatagcttgtttttaatttcgtttctcaagaaaacccagctaagtctcatcatgactgtttactcttgtttcttttgggaaattaacttcttaatataactttgactaaagatatgtagatttgtggtatgaaaagaaaatctatctgttggatgatgttcccagtgaagtactatccatttgttattttaaaagttattctcttttgttctaaacagtaaatagtgccaaaactaagaaaaacatgtattatagtttcaacgtcaggctgacttgcctgcagatctgttcgcaatagactgtaatgcccctttaaagaaagatttagaaataaattattaaaagtattaattcatttaaaaaaatgtaagcatgaatggggacaagctggggagaatgatttgtctgctctttctgggagggtggcgagcaacatccatgagaaacctgcaggccttgccactgctgctgagagccagtgaccccaagggctgaccacttgggatgttagctgcttctagtccaggcactgtggtctgggcctgtggtataaagaagggctattgccataaaaggagatagacacaaccagcttcagttcatcctgcttcctgtctcagaattttttttttttttttttgagatggagttttgctcttgttgcccaggctggagtgcaatgaatagcgtgatcttggctcactgcaacctctgcctcccaggttcaagcgattctcctgcctcagcctcccaagtagctgggattacaggcacctgccaccacgcccagctaatttttgtatttttagtagagacggggtttcaccacattggccaggctggtctcaaactcctgacctcgtgatctgcccaccttggcctcccaacagaatttttttaaaaaagaaatatggtatgtctttggaaacccgagattcaaatcttagcaccctatatccccaccaccactaccattaacagtgcagtttggagcaagttgcttaatcttttccagcccagtttcccatttgtaaaatggaaagaatgacatccatataatgtagttgctggaggattcattattttattattcaacaattgtttattgagtgccagacattagtctagtcactaagacagacaaggtccatgttctcatggaattcatattctaacagggtaaggtcacaacaaataaataataaacaaatgaaaaatatcagatattgataagttttagacagaaaataaaatagggagctgggcatggtggctcctttctaatcccaaaatgagagaattgcttaagctcaggagttcgagaccaaactgggcaacagggcaaaacctcgtttctacaaaaatacaaaaattagctgtcccagctacttagaaggctgaggtgggaggatcatttgagcgcgggaggtcaaggctgcagtgagcttgatcacaccactgcacttgatcagcgtgggtgacagagtgagaccttgtcaaacaaaacaaaacaacaaaacaaacacaaaacaatacagattcactgtataatattatttagaaaatgcagaaaggtacaaatacttattttataataactcttaatcttaatattcaagtttttggtgtatatctttgcagagttttaaaaaaatgtgtgcacacacatgcgtcttcacagaaatggaactttgttattgtatatgctgcattgtaacctgcttatttgcttaacaatagaatggcgtctttaatatatccaaactttttacccagaatgatttttcatggctgcgtagaataccatttatttaaccaagcggtagagagttagactattcacaagttttgctattatgaacaactagggagaagcacttacacagcaaaatctgctgagtttctgaattgtctccttagtatagaccacgcaagtgaaactatcagatcccagggcgctcccgtgcggttgtcagatttccctcctgtaaagtggatgagtaaccccaccccacatgcactcccgtccacacagctcttgaaaggccaaaccaggcgacgctgtggcccagagagaaccagaagagagggtgcgtggggtgcacggcaagccattgagtctgtggccacacctaggcggagagagacgagctcgggtgagggtgggccgcgggatccacagactcctcttcgtgcggtggatgcatcaggctccgtctctgaacctcggtttccccatctgcagaatggggatgggatctcctggtgatggggatctgtggacgcggcgccctcgggggtgcacagaactaaggccggcctgcagcagcgacctcgggggctggtggggacggaagaccggacctcctggcccgaaggctgggcgcagcccccgcccgcccgcctcttcccgccggcgcctccccggggtggcagtgtggggagagtggcttggcgcccgcagggggcgccgcgagcccaccgcgagagcggccgcggcgcggggtgggtgccgaacgggctgcgcgccgcgctgctcccgacccgcgggtcaagtctggcgcctgggaggtccttgaattccgcgggatttgtttttccgcaaaaccaaaaacgccatccacttaacagatccgtgctaggaggccctggctcagtccttccaccaaacacctcggcccagccgcggctgtacggctcccaggctcccagtgtttcctccacgctttcaaacctcagcgctgaggtgaccgcctccgggcagccttcccggactaccccaggacttgggggcgtggctccacagcgggcctagttccgcccgtgtgctggcctcttccacgaccggcagtctttgaggatggggcttggcctccatccccttgaacccctcagcgtcgcaccccagagccactctgacccctggccaatgattataagtgagggagccacctcttctccctgcgtggcacaggccagggtccgcaggaaggggccttgctcatccccaatcttaagctccgctgagatgaaggaaccaagagcaggcttggcactgggagggcggctgtcccagtggcggggaggggagctctggatctgtgggggagtttgtgcagcgtgtcagcggggggtggggtggggggggtgggggcctgtggatgcccgcaggtgtttgtgtttgtgcatgtgtaagtctctgtgtgtatatatttgtgggaaagcatcttctaaattaagaatatatttgtgtagggtaaatggtcaagtcaaatagaaagtgacttcaatacttgttacttgatggtataaatacaatagccaaggaattcagtccagaagctcacatttgagggttagggattggtgctgtatttgttacaacaggcgtctaaccttggtcaaatctcttcctcatagtcttcattgtctctggtttgtttgtttgtttttctggtttgttaaatgatccttttttttttttccccgagacagggtctcactttgtctcccaggctggagtgcagtggcgcaatcaccactcactgcagcctcacctaccgggctcaagtgatcatcccacctcagcctctccagtagctgcgaccacaggcacgtgccactaaatgattattttttcaagggagaaatcatgcctgtcatacaaataaaaaatgaacaagtgtaaaagattttatttaactcattagttaatgaagttaaaaactgattcaaaggacaacacaaaggccagatacacacactggcatcagaaataatgaaataagtttgttaattgatacaaaactggcttcatccacagtgtgtgtgtgtgtgtgtgtgtgtgtgtgtgtgtgtgtgtttggcggggggtggggtggggggtgggggatcacttgcatctccacctgacaaaacttgtttgcattgccatggacaataataatttgtattattttcagttttctacagtttacagattcaaagacaatgaaaaatggagactaccatagaatgacataacctggaagggcacaccaggcctgcattccatagggtacattttctccccatttcaaaagtctttcacaatttttcctggccacttatacaacaggcttgagttgcataaaggtttttcaaactttttagtggcggaactctctttctaagtgaaatgtaacagcaaaccctaatatctatctatatatctaatagatagatactttattttttaatttttaattttctattttttgagataggatctcactctgtcgcccaggttggagtgcagtggcatgatctcagctgactgcagccttgacctccccaaactcagatgatcctcccaccttagcctgccaggtagctgggagtacaggtgcatggcaccacacccagaaataatttttgtattttttgtggagatggcgtttcgccatgtggcctaggctggcctagaactcctgagttcaagctatctgcccaccttggcctcccaaagtgctggaattacaggcgtaagccactgcacttgacccgaatatattttttttaacatctcagagggttaaaataatgtattatacagttaatatatgcttaccgtaaagatgtcaaatagtacagaaagttaagtgaaacatttgtttcccttcccttgccctttctccctgtccccttctcattctccagagccacctactttaacagtttcttatgtacccgatagacactctatggatatatacaaacatatacatatattttttgagacagggtctggctctgtcacccaggctggagtgtagtggcccaatctccgctcattgcaacctctacctcctgggctcaagctatccttccacctcagcctcccgagtagttgggattacaggtacacaccaccgcacctggctaatttttggggtttcaccatgttgcctaggctggtctagaactcctgggctcaagtgatcctcccaaagtgatgagattacaggcgtgagctgctgcacatagcaaacacacacacacacatacacacacacaaagacacacatacacacgcgcgctcgcgcgcacacacacacacacacacacacacatatatatatatatatttttttttttttttgagatggagtcttgctctgtcgcccaggctggagtgcaatggtgtgatctcggctcactgcagtctccacttccctggttcaagcaattctcctgcctcagcctcctgagtagctgagattacaggcacccaccaccacgcctggctaattttttgtatttttagtagcgatggggtttcaccatattggccaggctgatctcgaactcctgacctcaagtgatccacccaccttggtctcccaaagtgctgggattataggcatgagccaccacgcccagctgcaaacatatatttttaaaaacacaaacaggataaaatacattgtggatatcttctgatgtcagaacatagaggtccacctcagcattttaagtgattaagagtgttccatggtatggctgccccttaacttatttggctaggcttctattaacagactttttttagttgtttctaattttatggtaatataaacaaatgctacaatgaacctccttaatcagtattgtgtgtgtgtgtgtgtgtgtgtgtgtgtttgtgtaaactttttaggagtggaatcattaggtttaagggtagctgcatttaacattttgatatatcttgctgagctctcttccctggaattgcaatcatttactttttctgctacatgctgtatctttacacccccgcctacgttgtgtattatcaaacttctaaatcttagccagtctgatagagggaaaatgacacctcataatttcagtgtacttttctacaattatctctagctgttacaatattccctttggtgggaaattgcttcattattttctgtgacttccctttgcagaaaaactcacgcggcatagttcgaaaacccttgatcttgacagattccctgagctctcatattccaggaggcagattctctgcaagtgtgtgtttgtctccgctctgtgtcagtgtgtagcttgtgtgccacctctgtgtgtgtgatgtgtgtctgactgccgatgttcatgttagtgagtgtttacctttcccttccttgaggatcagagacctactcaggagagcccaggttaccaagaagtttactgtaggatacagagatctctcccagttgggaaaagaagagcaactggattttctgtaaccaagaactgcatatgggaaagggatagaggacagaggctgccttctctctgcggacccataaacttgcccatgggccgaagccagccaccctggtctgactctgcatgcctttcagctgaaggaacaattgctgcctgcaacagtcattcagtttcccaaggaatcaacctctctgtgtgactggggaaaaggaaacagacatcaagaggtctgctggcaggggctgatgcaaggattgtaaatctctgcttcatcacatgtgcattatttgggaagtggctggaagttcaattcatgcatctactggcagtgcatctaggggaaagagcgggaacacaggaagaggaacaggctgtttcatccttaattctgccacttactggctatgtgtccaagggcaagctgcttaatttttctgtacctcattcccttatctgtaaatcaagggaaacaacgcccacatcatgaagtcattgtgatgagtaaattaaacaatacgtatcatggatcttaataagcgtctcagtcaacacagaagttccctctcttaagggtgacgttttgataatgacaccttttcaaaatgaggatctcaaagaacatccccaaacattagaggaggagggagtcttttttcctttagtgtgtccattcagcagcagccttgtgcctgtgtaccaccgtgagaatggcaaagtccagtcctgcctgccctcctgtgccactcacggccacacgtttttaattttcaccacactcatgcaatctcctgcacacatcgtgatacttcgtgcctccgtacctttgcttgtgcagctcctgcagcctggaatgttctctcccactccactgtacctggcaaatgctcacttatacctcaaaacatatcaggacaaaggacatagtatttagtctaacacatctggctgtttgcctggaagagaaccagagtgaacccctatctctagccatatacaaagataaaattccagagggattaagggcttaaaaatgtaaaaaataaaatgttaactatctgtcaagacaagccacaatgcaacattagcgtgtacctgccagagtagctaaaatgcaaacgtcagatgatagaaagtattggggtgggtgtagagcagctagaagtctcttacattactggtgagagtgtaattgataacggccactttggatgactggcaatatccacaaaagctgaacatacacgttctctatgacccaaaaattacactcttgggtaaatactcaacagaaatgcagacataaattcaccaaagaaagtttgcaagaatgttcatagcagcactatttgtaatagccccaaattggaagcaacccaaacgtctatcaacagtaaaacataaagtgtggtatgttacatacaggactgctgcacagcaacgagaatgaatgaactacatgaattcatctcacaaacataatgctgagtcaaagaagctagatacaaaagagtacacatggatatttcatttaaataatgttcaaacactaacctacgatgttagaagtcagggtagaggttaatctttgaggacggttgtgactggcaagggggtgtgaactgaaggaatgtctagggtactggtaagattctgtttcctgatttcagtcctggctacatgagtgtgttcacctcgtgaaaatttattgatccataaaaagatgtgcattatttcatacatatatctcaataaaaattttggcaaggaggcatcatataatctaaggttagaataccttctcaaccaaggttggaaacctagaagatgaaaaaggtatttttgcatatatatacatatacatacacacacatatatatagcatttttgtgggaaaagatactgtaagcaatgtcaaaagacaagcagacttggaaaaagtgtaatgcagatgatggacaaaggctaatacctatagtatgcaaaaaactcttataaattgatgcgaaaagacaaacaatccaataatgaaataggcaaaatgatatgagtaggtgattcaaagaagaaaaatatccaactgatggaaagatgctcagattcattagaattcagttgaatgcaaattaaagtagtaataagatactcatttatgctcttcaggctggcaaaattaaaaagagtttctataggtattgtgtgtgaggttgtggggagcatgctctcattcattgctggtggagatgtaaattattacagcctttttgcaatcaatctggaaaaatccattagaattaaaaatacatatatcctttgacctagtgatcccactcctgggaatctattccacagaaatagaaggatccacctaagggtccatgtagaagggtggttattgcagcattgattgcagaggtgcattcgtggtgtgcatgcatgcacacacatgcacacacacagaaaacaaagcctgtgcctctcagcagggaaatggtataaatggtggtactttcccttgaggctcacagtctagagggctggggtaaactcttgctggttcacaggaggtcttcacatctggagggggtggtctgggagtggggtgggcagagtcatggatgatgagaagccctcttcctcctagcctgagctagtagcattgattccagagcaggctttggagaagtgactatttagagttcagacattcccatgtcccctcttggcgggactcagttcctatccctccagtatcaaagaagtgacatcaacaaaggatcacagaggtagctcttattgacacccactgcgggtctcatttaaaatggctttcttaagccaaaggcaggcaaatatctctactaactgaagaacaaaggagacatggaatcaattgcaaataattatttctaaaaatcatgcctctcttctgaagtttgtgtttgtcatatctctgtctacctaaaaattgctctctcttaggtgaattaaaatatagagtcaattccctaacattcggtcagttgttgggcagccctggcctagcttaggaaggtagccctaagcaggcctttaacactaagtgaaagcccccgtagcatatgtataaatatttaaaatcataaactaggccaataaactattagataaaaagttccatctttctgtcttgaaaaatatgccctcttaagatcaaaatttttaaaaagtatagcactacgatttttatatgaacaaaaattggtaaaatagtaaagatgacagaatttaattatgtgtgcatctatttggatattctgttgatgggctggtgatgttttggtaagttataaagtcagcatataccaaatttatattgtaaatcattcaaattattatttatcttttcattagatttgtttttcttaccttccttattgcaaaattacctaattatgttgttataatcaagatttttgcacaatttgtgttttattgatgatgacgccaaattagactaccttttttgagttgtaattcttagataattaaaaaaattaatttcaatttggagaaagtttcaggaataaatggaattttcattaaaatcttaaaacgatgtttacatttggaaatgaaccatgaattttacatatcctgttcaaatactttagtagagttgtgttaggtaaactgtaattattgcagaaaatactacaaaatattttaacttcataatagaaatttctatcatactgcaatttttgctatcttttaaggtaatagtttatgcactaacatgaagaatagcttcgtacatattacatctacacttatacctctactgatttgaaggtaaaataaagtgttcatattgcacacatgttcctcagccactgtacaacaatcaataccacactaattcatgagacctcctgaaccacgaactggagcacaaagagaaacatgaaaatggacgtgtggccctactgggaaatggtatttcactgtgcaagaaacgattgcgttcttgctatcagagataaaggatttgacaagctaataaatttgtcttttcccttacctaagtgcttccgccactcaaatcctccctgttctctgaagcagtgtctgtctccaatattggcggaagcacaacccagaaacctccgtgacgttcagacatggttgctttctgttttgaggacacagggcaaaaggtgaggagccgcatttccctgggacctgaccggtgttgtcattggaactgacgtttctgttgccagcagcgctatgccagcgctgagcactcgatcccatgtgctccataaccaatacattttatgggtgtttgtgatatatgcaaccttttcaagtagggcttcttagtttctaattattagtttttaatttcccaacccaatacagatcaattatttgattcaataattcactagaaataattcactagaaaaatgaaattaaaaaaaatctatatgaggacctgtggggtgactcacgcctgtcccagtactttgggaggctgaggtgggtggatgatttgaggtcaggagtttgagaccagcctggccaatatggtgaaaccccatctctactaaaaatacaaaaattagccaggcgtggtggtgggttcctgtaatcacagctactcgggaggctgaggtaggagaaacgcttgaacccaggaggctgctgcagtgagccaggatcacaccactgccctccagcctgggcgatagagtgagactctgtctcaaaaaaaaaaaaaaaaaaaaatctatacaagttacaagccccaagttttaaagattcaacagatataaccttactgttagtttctgtgtgtaactcatcaagaacaagtaacagaccacgtgtgggctggcactggtccaccgaccacacttctctgtggaggactgcttcgagtcactggagtcaccagattcagggtagggaccccctcttgcctctgtctaagagtggtgccggtaaccacgaggctgaatcctgccccacagtctttttcagtctctgtgtgagcacttttgcctgtgccatgcagctctcatttcacgccaagttctctgttctcttactgtcctgatacaagtctagctccccacggccccttcatttccaccagccttgcagccccttctccttcctgagggccccatatcagtgtatgatgaggggccttgaatgcatgccgagaaaggaagcttctgagctgggggtcaactctgagaatgtgatgtggcctttcacccagccaggacctctcctgggctaagctgtcagcaccagggagtccacgtacagctgatgcctccctgcggtgggggaacagaaaggatggggcagctccccagaaggccttgggatttcttagcagagataggaactcccattcacactctgccaggggtcagcagcagttctagagcttaccacgtgctcccaggaaatcatacatgtttctaaaatcatccatgtatcttttttttgtcacctacattttttatttatttatttatttttatttatttatttatttatttatttattttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatgtaaccctgagtggacacagcacatgtttcagagagcacagggttgggggtaaggtcacagatcaacaggatcccaaggcagaagaatttttcttagtaccgaacaaaatgaaaagtctcccatgtctacttctttctacacagacacggcaaccatccgatttctcaatcttttccccacctttcccccctttctattccacaaaaccgccattgtcatcatggcccgttctcaatgagctgttgggtacacctcccagatggggtggtggccgggcagaggggctcctcacttcccagtaggggcggccgggcagaggcgcccctcacctcctggacggggcggctggccgggcggggggctgacccccccacctccctcccggacggggcggctggctgggcagaggggctcctcacttcccagtaggggcggctgggcagaggcgcccctcacctcccagacggggcggctggccgggcagggggctggccccccacctccctcctagacggggcggctggcagggcagaggggctcctcacttcccagtaggggcggccgggcagaggcgcccctcacctcccggacgaggcggctggccgggcggggggctgacccccccacctccctcccggacggggtggctgccgggcggagacgctcctcacttcccagagggggtggctgccgggcggaggggctcctcacttctcagacggggcagttgccaggcggagggtctcctcacttctcagacggggcggctgggcagagacactcctcacctcccagacggggtcgcggccgggcagaggcgctcctcacatcccagatggggtggcggggcagaggcgctccccacatctcagaggatgggaggccgggcagagacgcttctcacttcctagatgggatggcagtggggaagaggcgctcctcacttcctagatgggatggcggccgggcagagacgctcctcactttccagactgggcagccaggcagaggggctcctcacgtcccagacgatgggcggccaggcagagacactcctcacttcccagacagggtggcggctgggcagaggctgcactcggcactttggggggccaaggcaggcggctgggtggtggaggttgtagcgagccgagatcacgccactgcactccagcctgggcaccattgagcactgagtgaaccagactctgtctgcaatcccagcacctcgggaggccgaggctggcggatcactcgcggttaggagctggagaccagcccggccaacacagcgaaatcccgtctccaccaaaaaaatacgaaaaccagtcaggcgtggcggcgcgcgcctgcaatcgcaggcacttggcaggctgaggcaggagaatcaggcagggaggttgcagtgagccgagatggcagcagtacagtccagctttggctcggcatcagagggagaccgtggaaagagagggagagggagaccgtggggagagggagagggagagggagggggagggggagagggagagggagagggactcacctacattttttaaggacccaattccaatttcctgcccttatcatctctccttctcattgatatttttccagtagatgtagctttactcattaccaactactgccaattcacttaagctttcacctttaatgttttaaaataacaagggaattcagaagtatagaatgtggaagtctgccttcatcatcctcacaggcctgtgctcctcaatcccatttccatgagttaaggacttttagcaactattaacagcatgtccttcccagttcttgcctacacatttcaaaacacctatctctctcatcactcaaactgggggagcaggatcatgagcagccctgtggagaggcccaagtggaggggaattgaagactctggccagccaccatgtgagtgtttggaagcaggtcctccagcctcagctggagtttctcacggcaaccttttgagaaactgagtcaggactgctctgaagcattcgttaccctcagaaactatgagataataaatttaagctgctaagtttgggaggttctgtgttacatagcaatataatacaactttcatttctctccaatgaccgtgttagtttttagcccctctgtagcaaagcccctcaaaagagctgtctgtacacagcgtctccctttccaccctgttttctcccacccaatcccatctgttctaatatacattcactgaggtctgctccctgtgagactaggatgtgtagttaaaatgtcctcatgttccctgttgcagaccctgagatgaggattcttatgcaagcaatttgttgtggaagtgctcccgagagaaacagggcaaggaagcagggaagcaggacagggaaggggaggaagtcaggtaagggtgaaatttcaggcaaagtccaggtctcagaatgatcttgatggctctggagaaaaggacactttacagctatctgcatcctgctggtggggcagagactcagctactccccacaagcctggactccaagccactgctgcctactctcaccccaggccccgggagctttaacccacagccctcagttcaggtggcattaaagtgagcccttcctaggagtactgttgtcccttcctgaagtgaggctctgtctggggctgccccggtccataagacatatttttctgtactcaaggggacaagaatgataactgtgcttgtcccatagcaatgtgtggtgcaaactacactaaaggctagatactaaaggctcagcttaattctactgtcagcagctctcaggcccacccctgtggaaatagacattggagggagtgtgttacctgacacggatcagcatggcaccctcagcttactaacacagaaatggatgggtaggcttgaagagaaggggaagggtgtggttagcgccttttcccgcagtctgtgggaagccagctgccacccagccagcatgtcttatgacttattttagttttcagaactgcccttagacgattgaagcatgaacatcttttcctgtaaaaatggattattctacttccttgctttagtctgggactctgctcttgtggtctggtgagacttttgtacatgtggggcctgagaacacttttggtagagctgtctctgctgaggtcttcagaaggacctttgggcagcctcatgtctgtcttgggctgccaggacagaaatgcccaggtggcttctggaaggccttgtggccagagtgaacattcaagctgttcactcatcctcagcccaggccgcgcactgtgctcctcccagagctctgacattcgttcactatggaaaaggtgtgatgtagaaatacaatatttgttatttatgacccctcattgctttctaaagaaaatgaagtcccaggactatttgttgaaagtcatggaagggagaatacaaaattggaagcaaggtggggaagagttaaattgttctgcagaaggagagggaaatatatggggaggggtgggaagtagaggctgaagcttcctggaggaggatcaactgggaggggaatgcgcatggctggggagaaactttgtagggagagttacacaaaaatttagagtttgctgtgtgctatgcgatgtgatcctttactacatctctcctgttgacacttcagaacactatcagtttcttactcgaatgcattgtggactgggttttctttgaaggaacgaagaggaatgctgagtcttgcttcgaggttggtgaggtgtggatcagaggctcccagtggaagctgccaggcctaggttcagggttacatggagcactaggtacctgtatgctatgctctccagcctggccattcccttctttaaggaaaagaacatttcaggtagagggcacgaccagagaaaaaggtaagtttggagagggagagagaaaccagagtgggtggggaatgtatgtgagtctgttgggaaatggggtgaggaacagaggcagaaggtggtgctaataggtgaattagtccatccaggctgctgtaacaaagcaccatacactgagtggcttataaacaacagaaatttatttcttatggttctggagtctgggagtccaaggtcagggtaccagcatggttggtggctgaattcctacagtgggcccacttctggttgcagactactgacttctaattgtagtctcatactgtggagagcagagagaagcaagctctctcggggttcttataagggcactagtcccattcttgagagctccaccgtcttgaagtcacctaatcctaattatctctcaaaggccccacctccaaatactatgacactggggggtagggtttcaacacatgaattttgtggggacacaaacatcccgctcataacagtaggttaggactccaggtagggccttgcttatcttccacatcagaggtcctctcagctgtcctaccactcaaaatcttagggtaatccaaatacacctcaatgcaccatgtggcccaggcttgattcagtattgcattcaaagcaacacaattcaccttcactgtgcaattcatattgtctcttataatccattagcgtcttccaaatggaaccctcagttctatgggtaagaaggctcccacctgcaggggcaaccaccaccttaggaactgggcatggcactgggcaatcctaggctgctctggatggttcataaggcataccccagtggcagatggactggcactggggaaagtggtgtcctgttggctgcagggaggcatttcggacaacccactgcctctctgtacgttcttgctaaggtccccaaagaacttcctggcaaagacattttagaccttttaactacttggcaagtggcttacgagtccttctaaatacagcagattagtcaatggaaatacaaaactttagaagaaattcacggaaagagctattgaattggggaggttttgccggagtaggtattttctctatggaattctgatctgttcatttagtaatcctaattatggttttgctaatttggaggtaatttcagagaaagggttttattccactgggaactgtcaataggttaagaggattttgctttttcatttgtaatgtttcaaaggaatgtcattcttgcaacagcttcaactattttttgcttatgtctgccaccttgctgctcaaggttgacaagaaaatacctctgcttgttagctcccatggctggtttcttttataccagctgtgatctctctaccagctctcctagggaccagcagaagatatgtgcaaaggtgaatgtactgcattttccaggagtttccattctcttcattatcttcaaaaggatggccagactatcagagtagaggccaagccttcctgggcctttgggcctctgtgtacccagtgcctctgtgtaccccatgcctttacctaagaacactctctctccttcctcttaccaggctctttttattttattttattattttattttattattattattatttttgagacggagtctcgctctgttgcccaggctggagtgcaatggtgccatctcagctcactgcaatccctgcctcccgagttcaagcgattctcttacctcagcctcctgagtagctgggattacaggtgagcaccaccacacccagctgatttttttgtatttttagtaaagacggggttttgccatgttgaccaggctggtctcaaactcctgaccttagctgatccgcctgcctcagcctctcaaagtgctgggattacaggcgtgagccactgtgcccagccaccaggctctgtttaagtcatgcttgggttctcagctgcagctccctttcagaagtcttctctgaccccatgtcaatatccacagccatggactcttctctggggctccagacctgtgcactcattaatatcagacatttcattggatgtttcataggcacctcaaattcagcatgtcccaaaccaaatgcatcattgccctctcccttccaccttcatcccttccctctcttctcctctgaacctgcttcttcttccatgctctgtgtttccaggcagggcactattgggctatccttctaaatacagcagactagtcaccagaaccagaaacccaagggttacttcagaatcctccctctcccttaccctcacatctccctccattctactctattccgaaatccagtagatcccacttcttaaatctctctcagatcctttcttcccttttcttcctctccctggcctgggatgccatcctcatttgcttgaattactgtattggtgtcctaactggcctcactgcctctggtcttatctctcatcctggccactgtagtgatatctgatgtgaaccatgcagatcacaaaattatactccttgctctggcttctccactttccacaacatctctcccattggatatcatctaaattcccatctggtgactcctgacttgtctaacttcatcttctgtcagtttggaccagttaagatttctaacattgcaaggaagagaaaatccaactcaaattgacttaagcaaaaaggaaatatattggttcacacaactgaacatccagggaaagatgtggctcggtttcaggcatggctggatccaagggctcaagcagtgtcatcagaaagctgtttccatctctcagctctgctttttgctttgttagctcccattctctggcaggcttcttttcatgttgtggtgagatagctgccagcagctctagactgctacctcctcacaggaacaaatccagcagaaagagtatccctctcccattgctgctcaaaccaagtaccaggattacctttgcttggacctgattggcttgccttgggtcaggtgcgcaccccttaaacagtcacagtggtcagaggaaggcaatgctctggtaatccaggtctgaatcatcatatgctcatccctagagcaggttggaatcagcttttcccaaagcacatagactaagagtcggggagggcagctttccccagaaacaatggagaagtgactctaggagcaggtggaatggagaatgggctggccagcacaggcgagcaccgcaccctcccttcttgcaggaccgcccctcgtgccagctctctttccagctctccccactggctgactccttctctatcaagttgcaggcctatgtgctgcctccttggggcctccttccctagctccccagagacttggaggccccgcctcctgctgttcccagggtcctttgctttgcagcagtgatgctgctacattgtaactttttgtttgtttgtttgtttgtttgtttgagacagagtctcgctctgtcacccagtgtcatgatctcggctcactgcaacctccgcttcccaggttcaagtgattcttgtgcctcagcctccccagtagctaggattacaggcacgcaccaccaagcccagctaatttttgtatttttagtagagacggggtttcaccacgttggccaggctggtctcaaacacttgacctcaagtgatccgcccgccttggcatcccaaagtgctgggattacaggcatgagccaccacgccccgccgctacattgtaattttgggctttcatgcctctcccttctagactgtgagctccttgaagacagactctctctttatatttcggtattgcctgtatctggtacagggtctggcctagagtgggtccctattaagtgttgaatgagagaagttataaggagaatgtggatgtcacgtgggccctaatcctgcatgtcatcaaggtaggaagaatagccaggatcatggataacagaatgagaatccataaagagctcagtagcctggaaaaatggaccaaatctgtcaagaggaactgaaatagaactaactgtggagccctatattgaggtctaaaaagcatttgtttgggtatagggtggtggtggtaggagtatctggaaaagatgcttagttgtctttatgtggctacctaaaaatgctaagataatcttgggccacattaatgggaatatactgtttctccatatctctttactgtgtaaactctgattcttggcacaccaccatcgttagtccacacaatatccctttcttgttttgtttgtgtattccttttatctccattccattcccatatggaatacattctttttgtctgtatgccttcctatacttacaaagtttgtattgctgttgttttgaatttgtgtgaatggtgtggtgtcatggagcacattctatttcttatttttgtcatccagcattttgttgttaaatttccacttatgttgccatgagtataccaacttcattgcttctaaatgctgaatcccccctacgtgttacctatccatgctcctggtgatggacacccagattgctttcaatttcctgcaaccacaaacaattgtggtgaacattctcatacatgtgctttatgaatctgaatgagaatggaattgagatatatgctcaggtgaggatctgctggaacagaggctagtccatccttattttacctggcagtgctaggttgttgtcccaggtgggtgcactattcaacactctcacaagtggttagagttccattgttcccacaccctgctgccaatacttgttactcagcttctgtttttgccagtgtaacaggtatagtcatatttcactgttgttttcatttgcatttcttggattactgatgtggtttgcacattttttgcttttattagagaagggttttccctatgttgcccaggctggtctcaaactcctgagcttaagcaatccctccaactcatcctcccaaagtacagggattacaggagtgagccattgctccttgcctgattatattttcaaatgctactgagcctttgggttctctactccataaattgtttggtcattatcctttgctcattgttctattgagatgcctgtctttttgtattaattttcaggagttcttagaatttcctagatatcagtccctatctctacctggttttggacaaggcaaatacttttcaatggtcctgcttactctgatttgtctggtccgagaattgtgttgagttctgaggttcatatcttaaagagaccatgatgagcctgggacggagaatagacacttggtttatgaaactcatcaaggaggagctgtatcagtaagcgaaatttacaggggtgttgatttcaagcaatataaggaaggtatttccagtgattagagccaccgatgatagggtatactctctggagcagcaatgagcaccagaaacagcagcaggggtgcataaagagaagacagacagtgacttgttggggaggttgcagaaatgtttcccgcattagatggttcattccaaccttgatattttcagagcttttctgagtcaccatgtgttgaaagtcagagaaggaatcatggaagaggagaaggggaaaacacaactttaattccctttttcttctgcccttatgagctccccatagtcttcatttatcacacggtggcacttcattctgccttgtcctatacgtgagttacacacacacacagacatgcttgtgcacagccatgttcatacaatcactttcacattatgagacacacatacatgccatgtaagtacatagatacacaccaacatcgcaataaagcagtatatgcccccaaaacacacatggctatacacgtgtatgaaggaacagaaaagatgtgagatctttccttcaccatcataaggctcacagctgacacttctataacaaaagacaggttaacaagagaaaaacataacagatttgtttaatcaaagttttatgtgacatgagagacttcagaaatgaaaattccaaaatactgggaaaaacgatctatttttatgcttcggtttgatgaagctgggacagccatgtagaaataggattgtacagaaagggtatgatctcatgctaatagacttagtggggaaacccagcaaggcctgtctgtccagattcttgctgggcctctctgtgcagcatcgcctctcccaggtataggataggaccctttctggaataggggtcttatgactcccaaacaagttgtgtcagagaatttctttatggccagctgttacaccaaaaggtgtggggggaaggtaagagtaatagttttaggttttatgactggctttggggtaagggggttttggtttcttcaatgacccatctgggggaagagggcttttagtttctatggctggcctcaggagagaatgaggggcaagagacaggagggcaggggaatgtcacagagaaactttgctcctgaggcagcttctgaggtcttcactttggggcatcatttcctgagccccaacgtgttcatgtgccccatgcatgttgtgtgtgtttgcaaagtggagggagcggttctgggttaaatgtgaaaggccacacagtcctccatccttcttggtgtggaggctccattcgtggtggtccaatcctgccttcacttctgagagaacccagagcctgtgttctgcaggaaggtaaatatttgataatttacctcattccagaggctagaggcctgagcagggacaaggaaccggaacccttggttccaaactcccttcgctcccagcccagtgtcttcctggacttcccttcagtcttttctgatagagctaaataaaactctagaattggcctgtctcctcccaggaagaccgctttcagactattgcttcctaatgttgtagcatcttggtcattgagcttccaggccttgcacgaccctcaccctggcttggggctattctcctaagtgcatgtgaatgagatggtccaggaagcagagtgtctcagggttgggctgggggtgaggggactgcaaatctggccaatggaagctgtcttgtgggttgggggtaactctggggctggactggtctttttgatctttttgatcctgtacctctcaagagcttctggacagagtcaagcagctgagaaactgcctgctggacgtcggacttaaatacccaaggcaaggcagataacactatgcaccagtatcaatcacattgtctactgcaccttggccaatttccatcacttactcgagtccagtgaacaggacactctcacataacaagttacatggagcagggttattacttatagataggcagcaagggacaacagaaacctaggattcatggcgagccaatccccatggctcaggaaagaagcaaaattggatggagtcttgtctgagtgggctccacttgcactgcagctgagggacccctgaaagcagcctgctctggtttttctaccccatggtaacatgacttgctgggataaagtgttaaaggatatcctgttctacgagggagaaaaacagagccagaactgttgcaaccacttcctccctatctcaggatgttgcattcccaggacattctacagttaatcttttttttttttttttttgagacagagtcttgctctgtcatccaggctggagtgcagtgacacgatcttggctcactgcaaactctgcctccttggttcaagtgattctcctgcctcagcctcctgagtagctgggattacaggtgtgtgccaccacacccagctaatttttgtatttttagtagagacagggtttcaccctgttggccaggctggtctcaaactcctgacctcaagtgatctgcctgcctcggcctccaaaagtgctgggattacaggcttgagccactgcacctggtctctacagttaatttgaaaattgtaagtgaaaaagtggggagaactggttcaatccaaggccacctggacacctggagaactgtcctgcacctaaaagctgcaaagatccagtgcaacactgcagacaggctcttgctgattgcggaggagagaagaaaagggcactagacaacttggctgggagaagatttctcgaaagacgtgatggggataaatgtgccaccaggagccctgctgcaagtggtcacccactgaggctttgtcggatcagatggatttgtataatttaggccccttctatctccagctctagctggttgtcagctagctggttctgagccctgcaggaggcagccaggcacccagtaggctgcccagacagtttgaatgcaagaggtccggatggagatgcagggagctagctgagttatgggcgcctggggaggtagagatatgtaacatgaggggcgagcaaaggccactgcacttcatgacaaagactaaaaaaaataaaataaaagaggccatgaaaaggctttccccaccatgaagtataataaagactaggaagcatttaagcatgatcaaagacctgaaaaactctaagattgtggaactgagcaccaaactaaaatacatgcgcctctaagtctgatgcttattgaggaaaaactcaagaagtttgccgaaggacataaagtgtctataaaaccttgtttgttgcctgtaaggtcgggtttctttaatcgaaagattgtcctgatgtcatagtgagtaataaagctgtgtgctgatgcagacaatgcagaaatctttaggaaagggagagcctctctctttggaagtggtctctgcatttcccacctggataagatttgtgcaaggcagagccttcaggaatgtggcttcaagttgttatggcaggtagttagacaggagcagggcaggagagggctcaccacaaaccaagaatgtcaggcgaccatcaggtgatggtcaggtggttgttaactgtctctctaaaataataatttgtcacagcaagctccagggaaaagcagtctcccaatagacagaaatacctgaaaccggtgatcagcagcttcctaataagatctcaggaatcgggccagtgggttcaagcatgtgcactaagaggcaacatgtcagagtttaattggtatacgaccttctaggaacaggtgactggtaaaggaagaacgcctcaagtgagcatgtgtacaactccagtaaacacactgcacatgcagcccctcccaagtgctggcaggccactgtgcacgtggacagcccaccccaagaagagaatcaggagagaagggagacttaagactccagaagtatgccaacatataaaaccccaagtcaaagctcaaacagagcactcgactctctcaggttgcccgcttgaccctcttccaagtatactttacttctttccatgctggacctaaagctttttaataaactttcactcttgctcttcatcttgcctcggtttctcttccttatgcctcttggtcgaattctttcttctgagaaggcaagaattgaggttgctgcagacctgttctgatctaccactgctaacaatgtcagactttgggatttcaaaaacgggtaaaaaatgtttttaaaaagggaggtaatactaggttgaaaatttttattttgccaactgaggacatgaaaaatacatcattccaccatttcataaaaataggaagggcataatctaagataaaggacaacccttgaatggaacacatttagctttaagtggaacccaggtgtaactgacttagtctatttcccacatccacgctggagcaggacttgtcatttgatcacatcccccaaaagtcaaataggattctgcaaatcattagcaagtaatgcagattttactgatgatttggtgaagcaatgggatagagtggccttgtaaaccacaaaacagaactaaagtgaactcccctcgccgtgactgtgaacttctccttggtgacctcatctccagttacctcatctccagctcatcattccccttgctacctcccagaaaggttgaggtgggtgccggaacatcagtttattgcttttcataaaaatgggcagacccaagagtgaaatagttgaaatctgtaatccaaacatctcagccttccagcttcctagggtgccctttccaccaacatctaggtaaaggatgccagcctgctgtgggaaaaccagtgctgtccccagcagtgccatcggcaggggaacagggtggtgggggaagcctgtgctcctcactggccacctttttccttaggcccctgagttttcctcttgttgggggcccctttcttcaggctacctcctgggagaggttcaaaatttctgtgagtttattatgcagtgcgatttagcttcttctttgtctcatcctttccagtccaaagcagccctggggcctctctttgcataattaaaagatccattaaggtgttttcccaaacaaaagagcagttttctccctcagaggaattctatcattctcttaggacaaccatctccaactgcggtgagatttaattaggacaaccatctccaactgcggtgagatttaaaaataatcacacacacacacacacacactcgaactcagaatgagagcgagagagagagagagagagagagagagagagagagagagagagagagaaacatcaggcatctcttccctgtggttgaggtacaggtggaacagattgtaaccagaagctgctgggttgatttactagaatgcatgactccaggaaggcatatgtggccagcagtttctctgtgtctgcaggtagagactgaatgtggagtcaggtagatggaatgtctggtgcttccaccccaggatgagagatgtctccccttcaggtatggaagagctcttggtctgctgctcccaactcctgcctttaccttcatgcatgaatctcctcaaggccacagccaagtgcctttcttcctgtgcagtttacatgggccctgctgtccctgtcctccatgaccctcctggttcctgtttccccttttgggctttgccttttggaagccttttctagttccccttctgggctgacccaaaggcaggctagtgcctcagcacaggctacagtggagggccctaccctgggtgttgtttcgtcgtatttagggcactttccatgtcccttgtagtgctagtctcagagcttaaccaagttaagctcaagctggtctccacggtctggtcctcagggcagctggagggtcatagccctgagctggccccatggtcctcagggttggggtatcatatccctgggctggtccccatggtgctcagggtttggggatcatggtcctcagctggtccaaggctgggggatcatacccctgggctaactccacattctcaggggtggagatccactgactgtgaggccttcctctctctttgtgctggctgcaactcaatcctactctttcagaggcctcttctctcccaggaagccttgtcaggctgcttgagcttgagaagaacaccactggggatgttgttagcatcatattcaagaagagtgtggatatttgggtgatgtccagtggctctgtactggaacttccctgtaaatgcagaaaccaaaggtaacggggttaagcctttcaggagagaatcactccaggccagtctgaaggggaaatgaggtgggagtgttagcagagtcccctggggaggtcagttcccaaaactgcagggtcatcagtcttcatggcctgtctctgagcagcagtgcaggggctgggaagactgagcaagtgtcctgaaggctggagctggaagcttggggaggaagaatgttgttttctagcatggatcagtgttttagtctttccaggctgtaacagaataccataaacaggatggtttataaacaacagaaatttatttctcacagttctagaggctgggaagtccaagaccaaggtgttggcagatttgatgtctggtgagggactgcttcctcctagatggacttcttgttgtgtcctcacttggtggaagaaggaagggtctctctggggcatcttttatattttggtgtttggcctttttttttgagatgaggtcttgctctgtcatccaggctggagtgcagtggttcgatcacagctcactgcagatttgacctcctgggctcaagtgatcctcccacctcagcctcctgagtagctgggactacaggcacacaccaccatgcttagctaatttttttattgtttgtagagttagggttttgccatgttgctcaagctggtcttgaactcctgggctcaagcaatcagcctgccttggcctcccaaagtactgggattacagatatgagccactgcacctagcctggggcatcttttatatggtcactaatctcattcacgagggctctgctcccatgacttaatcacttcccaaaggccccgcctcctaataccatcaccttggaggttaggatatcaacatatgaattttgggggggaaacaaacattgagaccatagctgttggtattccctcccttcttccacaccagtagtcttcactttataaggaaaagcagcaagtggggtcatgggagtgggaaacaccaagaccttgagaggtcgtggtcccattttagcctttagcagagcacaagcgtctgcccagggcagacaatattcttgccttttgggccattgcagttggaattggtggtaaacagccccaagcccagctcttgccccgtcattattagggtgtcgttattacttttgcaggctgaacatatatttgggtgtaacagggttctcttgagccaaaccagtgtccatctcttgaattcagtgaggctagatatctctggcaacagtgggacaggatgctcttttgtgtggattatggtcctttgggaagagtcctcacctaggggaataggcggccaggccaatagatttgctcagcagaagtcattaggggacaggaaagttctgggtcctctctctctatcactgacttccatggactcatgtctggatgctaaggtatgggagagcagatgggtggcatggttggaattgcaaaagtcattttcctaaaattccgtgaggcagtgaggcacaagcaactctgttccagatccctttgatagagtggcatgggaggagggaggttctgcctctgctttcaactgctgggggcacagctttgcatctggaggaatgggccctggccccacagtgatgccaggtggacccagcagtacccagcagaagcgtcagtgtcaggcagacacagttcccagcagaagagaaatacatcagctgtcatatagcaactgaccagccatgtccatgaacatatgtgggacacctgctggtactcccagaaacactttgggttgggggatttgcttgtcagcagccttggaatgacatgagaagaaaaagaaaccaggttttctgttgaagaaaacagaaccccatttttgtccacagacggatccttccaagcagctgctctgtagaagggctgggcctgtaggttcctgcctcgcatgtaccctagagatgagaggctgcctggcagaactgccggtggctgtggcttgggctgtcggggtcttggggcctggatgcaatgtgatctgaccctgggctgcgcagaccacccagctcatagccctggctgccgccagtgcctgcaatttctcaaggtgaaagcactctccagcgggtcattcgtccgcgtctgagtggttttctgttcgtggaatcatttatttctggtgtcagggaggcccagggcgacttttcccactggctgtaaatgctccgagcatcatcgattcgtctactcccatctccggaaatctgctggagcagcaagtctgtctgggattcctggctggaagggcatggggcagggcaggggctggggtggctttggttccctccctctcagcagaggcaagtggagggatgctgaagcctccccatctctccagagagcagcctcatggtttgggccctgtgttggagtttcctgatctgcagctggggaagtgtggctagcttggcttgtaatgacatctgacactcttgaagcccacccttgaagcccacccagggccactgaatgtgccccagcttggctgaggactccctcagagggcattctcctcctctcaaagatgcccccagatctccattaatcctcctgtcagtaggctggagcccatccaggtagggacggcagcaaaaccccagactgtaggcaggggcaccacccagccccaggtggagcaaagtggactggagtcagtgtaatgcactcacctcacagcgtgatcatgagactttggggacctcatgcgaacttgcctgtgtgtgaatgcctgtgtgtgtgtgtctgtgtgccatggctgcagcatgtgtgggcctccatgtcatctttgtgtttgcacatgatcttgtgcgatgaggtgggtgctcgtgggcttctatgtgtgtttatgcatgcatgttcacttgggtgtgactttctgtaggtgttcatgtgtctaagtatgcatgtgtgtctgtgtgtatgctggtatgtttgtatctggttgtgtgtctggtgttcgcattgctgtgtgcgtgcatactcatggtgtttgtgtgcctgtgtctctgtgtgtgtgcatgttcctggcatgcgtttgtgtgtgcatgctcatggtgaatgtgtctctgtgcatgtatgctcatggtgtttgtgtgcttgtgtatctgtgtgtgtgcatgctcatggcatatgtctgtgtgcatgctcataatgggtgtgcctgtgtgcatgcatgctcacgtgtgtgtctgtatgtctgtgtgtgcatgttcactgtgtgtatgcatgctcatggcatgtgtatctgtgtatgcatgttcatggcacatgtgcgcctgtgtgcatgttcatggtatgtgtctctgtgtgcatcctcatggtatgtgtgtctatgtgtgacgcatgctcatggtgttcgtgtgcctgtgtctctctgtgtgtgcatgcttgtggcgtgtgtgtgcccatgtccgagtgggatgtgtgtagggcttgtgcctatgtgtgcatgaggatgcctgagagtgtgcacctctctccagttctctctctcttcttaatcttttttacccaaggatttatggaaaattccagggtggaggtggtggctggggagggagacccttagctatagtctcattggcctcagagctgctctggagccagaggggacaacatttcccaggctctaagagcttctcctgacagaaaagcatcaatctgcttgtcaaagggaaaatggccatttgtccttgtctggaaggacccgagggcagggctggacctgagtaatctctgtctcctgggcccagcaccaagtagggtaagtgacggatgagctcaggggctggcaggctgttcaccctgggggctgacacaggcaggcagcctggtgggggtgggctgcagcttggaagaggtgggagggtcaggagaggtgggggctgagggaactggcctggtggaggttgtgttggggctgcctccgttggcagctggggcaagaggctggggatgatgggtgagccttgagggtggggtggggccccattccttactgataggccgggaggaacatggcacgctcagcatctagagacactcccagccctgaccctacttgtcaggccctgctgtcaggaggccctgggtggggaaagggtctgtttcggggtttccctggggaagggacaactcttctccatttcctcacctttcccctgcactgtctcctaagtgttttgggcaatccttgcaggtcttctcatctgggtgggtgtctgctgtgtgactgcctgagaaaactgatgaactttgagatcaggcccttatcctgggatgtgactctgccactgacctctgaccagaggcttctctctctgtgcctctatttccttctgtgcagtggatagggaccttcctgatctgcccatctatgatcctagggctggtaaggcctttctgggagcaggagtggggacacccctatgcacactcttcccctcctttccctttctgtgatttgccccacgagagtgaggctgctgtgccggtgggccttgcagaagagtcccttcctattgggatagtccaggcttcatgacaccccagaagcgagtgggcaggaacctgtggttacctagatgatccatctgagcttggtcctacatccgggggtgagcgggtagaggagggagccacatgctagggctcacattgaggggatgaggatgccacaagggtgggactagatgacgccttcctcctggtacaagtgactcttcagccggtgaggacagcacattgcacatgtttatttggcccgttcgtctaatgctgactgaactcttactctgggctagagactctcctttggcccagagaacccagactattttcaatctttgaggatcctggtatatcgagaaatgaaggtcctgaattgctgcccttctgtagttctctccttgttgaatccgggccagtcttgtggcttgcttgggcaacagaatgcagcaaaagggacatcgtgcaagttctgaggcacgatggagccttacagcctctgctttcagtctcatgttgccctaggactccctgtaaaggagcccatgctaacatccttgaatataggaagccctgtggaaagagagtgaggcctagcccactctcagccatgtcagtcatcccagctgggcctaagcaggtgagtgaggctgtcttggttcctccacctccagttgaggtaccagctggctgcaagtgcaagagtgagtcagctgaaaccatctgttgcagaaacaagttgctcagttgagcacagcccagattgctaattttaggctactaagttttggaatagttgttttttttttttttcatgtagcagaggctaactgaaatagaaatttgaaataggagtagaggtgctactgtagcaaaaatttaaaacatatggcagctgggcacagtggctcaagcctgcaatctcagcactttgggaggctgaggcaggaggatcgcttaaggctaggagttcgagaccagcctgggaaacatagcaagacctcaactctaaaaaacaaacaaacaaacaaaaaacaattagctaagtttggtggctcacccctgtagtcccagatacttggaaggctgaggcaagaggattggttgagcccaagagtttgagggtgcagtgggctgtgatcctgccactgcagtccagcctgggtgatagagcaagactctgtctctaaaaataagtaaataaataaaataaaaataaaatacacagatagactttgggacttcatggcagctggaggatggaaggatgacaaagaaactgttattggacaatgggagaacagtgaggaagctgttattggaggctggagaaaaggcaacctgtgttatataacacaattagtgttgtttggaggatagaaaatgcagctaataaacctgtggatctagctaaggagatttccacagagaatattgaaagtgcctactggcttcttttagcagcataagataaggtatcataagggagggaagaattcaagaaggagccattcagttttcaagcaaaatctagacgcaatatagacagtctaggacagtctctccagcaaaagatactcaaaataagaaatggtcccagggtaaagaacgaatcaatattgtggctgtaagactctgtttagacctcagaaagatttaagccagtacctcgtagatcctcttagctagacaaaggagcttctgaaacaatctggacaccaacccaaagtagaaagagatgtagctcggaaagtattataaatgtggcttttgaagcatggagtcgctcccacccagattcatgggaaatccacacaaaaaagagaattgtcttgggaaaaaaaatatactaacttggattaaaaggtacagaggctgagtgtggtggttcatgcttctagtcccagcactttggtaggctggagtgggagaatggcctgagctcaggagtttgagaccagcagcctgggcaacatagcgagaacttgtctctactaaaatttttttttaaaaattagccagctgtggttgcgtgcacctgtagtcccagttacttaggaggacgaggtgggaggattgcttgagcccaggagttcgaggctgcacttagctatgatcacaccactacactccaacaccccagcctgggtgacagagacagactctgtctcaaaaaataaaaataaaaagacagaaacaacaaaatgaaaaacgatctctaggcttccaactttttacaggcagaaaacagagatccagctgtaaataggatctattcatttttgaaaagggagatgtctcagatagtggagcccagagtatgaagccaagaaccaaagagaacaataggttaggaaatcactcccaggaagcacaaaataggtcctagtcaaagaaaactccttgcctttagagtagagggaactgataatatctgcccagctagatttcaaaatcactatggaatagtgactacatgtacctcccacttgcctctcccctttgttaaattaattaattaattaattaatttagagacagggtcttgctctgtcacccaggctggagtgcagtggctggatcatagctcactgcagccttgaactcttgggctcaagtgatcctcctaactgggactatagtcgcatgccaccatgactggataatttattttttgttgttttattttattttttggagagacagtatcttgctatgttgcccaggctgatcttgaactcctggcctcaagtgatcctcccacatcagtctttcaaaatactgggattgcaggcatgagtcactgtgcctagcctacccccgccttttagatgggggtttctcttgagggatattctatccccatcttggtatggtatgttaagtgtgtcgaggtcaaataactttttaattcctgagtctttggatcaacataagctctacccacggaactacacctaaggacccccatcagtctctgcttctgtggttccttgatgttcccctgcttctgtgctatatgtagggaacaagaattgcttcacaggagccctaatatcttgggtgacactttctataggggaagcacaggcagccctgatgggttcccccagtcatcttttccttttttgaaggataatacatgttcacagctgaatcactctattggctggtttcctgcctatagaatcccagaataatggcagctttctttcattttttcctgtctctgttccatttagcccaagctggtagtgttgttggtgacatgacattctcaaaatcctggtgggtctcctgtgtatattaagaggatccacttcattagacacagagttctttacagatccttcctcggtagccccatctctattcctggctcctgctgagatggttggttggatccgtaatttgtacatctaacggcaccagaagattgctcagccacacccttggtgttcctctagagcatgccttatcatcttttataatatggatgagttgaaaatattccaaataatcaagttctggttcctttttgcttagtagctccttctcaatttatctctttccccttgcattttactaaaaacagcaaggagaaaccagactgcaccttccatattttgcttggaaatctcttcagctagatatccaagttacttaccagttctattttccacccaacactaaaacacaactcagccaagttctttgccactctttcctccagtttccaatgataggctccttatttcaatctcagatatcaccaaagatctttaatgttcatatttcaactgatattttttcatgacaatatacattttctctaagatgataggtgctttctctgctgtgctcttccttctgagtcctcaccagagtatactttaatgcctatatttgtactgataatctctttcgacagtctaggcttaaaattcctccagcctctacccatcacccaattccaaagcccttacatattttaggcagcaccacttcttggtaccaaaatctgtatccgttgtctagagctgttgtaacaagttaccaccaactaggtggcttagaccaatagaagtttatcatctcacagttcaggaggccagaagtcccagattaagctgtcagcagagttggatccttctggaggttgtgagggaggacacgttccatgcgtctccctggcttctggtggtccctggcaacctttggcatttcatgtcttgtagttgcctcactccaatatctgtctccatctttacatgactatcttccccatgtttgtcctctgtgtcactttatggccttcttagaaggataccagaaggtccaccctaaaccaatataatgtcattttagcaaattacatttgcaaagaccttatttccgaataaggtcacattctgaggtcctggggttgacatgcattttggggggcacactattcaaccctgtacaaatattcattaatttcttaactcctacaaccctctgaagaatacttgcatagatgcgtgagagaggaatgaatttatttcagaagagactgtaggaaatacctggtcccatgtttggtccaaggctgtgataccctccatagtattcattgtgatctttcttctcttcctggactttttcagtgcagtgttcccgggttatcccaactaaaaattcaacccatcttgtaccctgattgggattgacactaagtcccttgtccttgctttattttctttctagcatttatcactattaacaaaacttatattttacttatttcttttgttcattgtttgccttccccactgggatagcctctgtgagggcaaagatttttgttcatgtatccacttctatattctcagcactcagaacagtgtctggtgcatagtaggtgctcaataaaaagttgtcatataactgaatgcatgcgtgaatgaaaggactcctggaaactgggcatctagctgttgtggacagggagcccgttctttcactgggcaaattttgccatttttagtcatgtagtgaatccttagaagaggcagggccaggcctccagagtccttgctttgagcctcatgggtctgttggacagtttcagaatcttaggaaataattggggtggttggttggctggaggagaaaatgaaataagagttgggattctctggggctgccactgacccactgggtcatcttgacaactttgttctgtctctcctggcccctggctccctgacctcagcctccttcacttggctatctggaaagcagttactttctctcctggccccccgttttctctctttggcatgtgggaattaaagacaaaaggtctcaaaatcactttgaactccatggagggtgccaaataatctgaggacattattagtataagacaattcctttgaaaatggaaattgcgtatcacacaatctctcaaacacagggtggaattaatgagcaatttgctcaagattcacaacttcaaaatgatcttccaggtggccaaaggaaattcacatttacacttcaatcagaaatttttttgtagaatgtaaggggggagggtttaattttctgagatcacaaatgcctatccccatcccaaggagaagagagcccgtgataaagaccgccctggtatctgtgaactctccagctaattagaaaagtgaatctaatttcatggatttcagctcctattaatttatcctaagcttgttggtaatgaagccatgtgtttgtttcttaagaaggaaacatcagagaggaagagaatgggtgtgaggctgtgctgtttattcccttaccttcaatctattaattgaggaaataacatatgatttaatatatattacaatgtcatcaacacagcacttgctttagctactgatggagccctgtgtggttatctcacataggcttacagtgcctgccacagctaagaaagaaggaataactgacagggaagtgaccaacagggtctgctaccttcctaatttctactgcttcattctatcctgtaatattcagcaaacatctattgaacaccttccatgttccaggcaagctaggcttgaacaagactgatagggattttagaacctatgtacgaccatcttaaacacataattattccaaatgattatttacaattgtgataaggactttgaaaaagaagtagtgtgttttgtacttcccctttccacatagatatcttgttagccagctagagaggaaacttaagacatcagagactggcctgagctgtctttcataaatcctctgtaatcattacaagacaaagctcaccttggtacctagatattatgtagagtattaactgctcagagtttagcagtagagattagtaaaagtaagtaaatgttcaaataagtgtaaaattctgaaacagactagtatcaacagtatctggacaaacttggcactaaacaaagcaaactggaggctctggcctctgagatgagaaagttcgtccccagatacaacacagagactgacaagagtagacaacagagtctagctcaagacagaagtgttaaattctagtgccatggccaacattagccccttgtttcaggagatttacatgtaagattttctcaacatcagccatggttagaactgtagtcccgagggaaaccagccattcatttcagggaaatgtgggtgttgacaagggaacccttgcaggagtgttctacaggtggtctccatcctgcccagtaagacttggctatgggagtgagctgtgtgaggggggccaggcaaacagcgatgagatccctttatgtggaaaattatattttcccaaagtggccacaatctgtttcctgttttttgagaacttgctactgctccatcaagatgtggattctgtgtctcctctccttgaagccggatggccctttgtgactgccttgatgaattaaatgtggtgcaagtgatgctgcatgactttgaggctaggtcatgaaaggagatgtgacatctgtcccacttgcatatttatattctctctctctttctctctctctcagtgcttgcccttggaacctaatctccatagtgtgaggaagttcaggccatggaaagactacaggagacatgaggggaagtctgcagggggacttttgagaaacgtttcctcacttctaataaatagctcaggaaaatatggtttctcttctttgtccagctgtgatgcctgggaacttctgtggcaaccttgcttccagccaatacacagagtggggcaactctcagaaaaccattgagaagagagtcagagtgctgaagtaccgtgtctggaatcctgtcttcccaactccgtgtttcctgatctatcaggtaataaaccctcttacatgctaagatactttgagttgaggcgttctgttacttgtagctgaagtaacattctccctgatttggaatctgctccctgagggctttggtcagttcctgccctctatgtgtgttctggggacctgggctctcccacaggagtcattaggctgcagagagccccccagagctgtgctttgggagtcagaacagagacttctggagttggatccattttctaggagtgttcatgatttcagcagaacctgttttattacttcttctagggttacatgtgtgagctgagcctttgtactttagagatcatttcctgagaatgagaagtggagaagggggcagggagtcatcctttatttgttatagtcccagagacaggtgacatgagagactttccttggtggcagaggatgaaggaggagggcatgaactgtggagtcagatccaggattgaaccttgacaccttccttgcaggctgtgtgaccttaggatggtcacttcacctttctagttctcagtgatcacatcttaaagtggaagtactagtcctatttcagaggatgcaattggaggtttacagcctgttatctgatctgcaactatgtttagtcagctgactgagtggttttttttgaaaaaattgagtttattcacgggtgtttacaaatataaaaacttaccaacttgtaaacttcaaatatctggagtgtgttgtatgtcagttatacctcaatgaagctgttaaaagttgaatttgttgtttacaatcaggaacgctggaatgttggtttctttgggggaaaagaggggaaatatttggcaatgctgagcccacctttttgtgaggttgcagagggctacctccttcagacaaggcatccctgcttcagtttgccatggtcccaccagcacctcttgctcagagtgagttttgctgctggccctctggatttgagtttgtgacctctgacctacctcatgtatttatatgtaagcctggatactcagagagtggtctgtagaccagctgcatcctgagagcttgttagcagtacagaatctcaggcctcaccccaggcctcctgaatcaaaattgcctttaaacaagatccttgcacattccttgtgatccttgtgattctttgcaccttcaaatttaaaaagcactgcctctgatgatcagaaatcatgtctaaaagtcatctggcccagagtaggcacccactaagggtaaactcttgctgtgtcatttaatccacagggcagttcattgttcagaggagctcacacttaaactgtactcagtgattctcctggatctcacagccaatagggggcagagctgggattcaaacacagggctgtgacagagatttatgctcttccctctctaccacctgcccccctaagaagagaaagaaagcatatgcagagggagaagccatagaaatcacctaggagacccaagcttatctctggggataagatcagccctgtagagcaggtggcaggctctccccagggctacctgaagtttcactcctttctctcagggcatggcccagagcttggtgcagagtacagtctcaatgaggaagggggaaagggaggagataagggaggagggggaagaggagcaggggaggaaggagggatgatatcaaacaggcatgtcttcagttacctgcccagccccatgccctgggtgaaagatagtgcattagtccatgttcacactactataaagatactacctgagactggataatttataaagaaaagaggtttaattgactcacagttctgcatggctggggaggcctcaggaaacttacaatcatggtggaaagcaaaggggaagcaggcactttctttacaaggtggcaggagagagagcacgtggaggacatgccacgcttgtaaaccatgggatctcataagagctccctcaccatcgcaagaacagcatgggggaaaccgtgtccatgatcctgtcacttcccaccagatccctccctcaacatatggggattacaattcaagatgagatttggatggggccacagagccaggccataccatatcagatggtttatccattaggacttgcattcagtcaagagatggaatttaaacctgtaagtatttattatttttttaaccccacacaacaagagtgataagtagtggtagtgttttagtggttcaaagatttggatccgcagtctctgtttctcttggccatttcctcatggtcacaagatggctgctgcagccccacttatcaggacgtgggcaggaagagaggaaagcaagtctttcttagaaaccttttaatgtatgtatgtcttattggccagaggtaggctagaaaatataatgtttaatttagcctttttttttttttttgagacagagtcttgctctgtcacccaggctggggtacaatggtgcaatctctgctcactgcaacctccaccacctcctgggttcaagcaattctcctacctcagcctcccaagtagcttggattacaggtgcgcacaaccacgcctggttaatttttttttttttttttttagtagagacaggttttcaccatgttggccgggctggtcttgaactcttgacctcaagtgatctgcccgcctcagcctaccaaagtgctgggattacaggcatgagccactgcgcttgacctgtttaatttagttttgtctttagctgggactctttgttctgttgatccctttctccacccccaccttcctgacaaatgaggtttatactaacaagaaaggaggacacggttattgagtagacatctggcaatgtctgccacgaatgggaacataggacctaattcctgattccttgttgacctggagtagttctccctagtctggaggtagcttgcgcactctcttgggctcagctttgctctgggaatgagaagctgtgcctccttttgtccctcccaatgctgtggcccagcaaggcctttggagagaatccatgtgtctggggacagctggaccacagcctccccaccctggctgcacacctgttggaagctatatttagagcagtaagtctaaatcttggggcaaggagaagagagaagccaaaggggcaagaaaaaaatgaaagatgcagcccagaaaaatgggatgttattccctgttgtgcacagccacagcctactctgggctggttcttaagaagaaggaaggaatagctgtgggcacttgtgggggccaggctggaattaggaaaaccgctgttcacaggatttggagagttataaactctgcctgcgctggcatgaaggtctgtcctgaaaagtcctaaaaccccttctagaattgtagaactggggcccctgaaccttttgactgtggcactcacaggcagggtataagacttcgtgctctcccctcccctcaaatttccactcaggaaaaaactcaaggattataaagaatggaaagaaataaaacagattgaatttgccgtgctgctagcaatacataaatgattcacttagtagttactttagaatacgaacatactaggctgggcgcggtggctcacacttgtaatcccagcacttcggaaggccaaggtgggtggatcatttgaggtcaggagttcgagaccagcctggccaacatggtgaaaccctgtctctattaaaattacaataaattagctgggtgtggtggcaggtgcctgtaatcccagctactcaggaggctgaggcaggagaatcatttgaacccaggaggtggaggttgcattgagccaagatcgtgccactgccctccagcgtgggcaacagaaggagactcaatctcaaaaaaaaaaaaaagaatatgaacatactaaaggatttttgtactataaaacaatttcctaaaaacttaaaaataactctcaatagttttgttttacttatgaaagtagctgatatttgctaacagcccatcatagggatatgagtgattaagggttgaacatcaaacttagacggccttgatgaaatacaggaaaattgcaggttaaatattatcgctgccaatctggattattgtagactgtgaagtaaacctagcaacccactaaaaggtgaatggtcacattaaagctaaactaaaagaagcttttataataaaaatagcaaggccatcagtaacgaaacaaaaaccacagccagtgggcaacactgatgaagtcgtagccatgagcccttccggaaagttgtgaaattctaaccatttgcaagtgtgcttgcagggtaggagcttgacagtgttgccaagtgttgtgtggcagccaggttttttagcaaaggacacagtcagagtcctaggtaattttagtttatggatagtacattttagtaacttttcatgactcacttattacgttactagtaagtaacccttctaagccaaaagtatgagagtctatagaagcaggagtcacttgcctgtaagaagtgaagaagagacatgaggggtcactgtgacccactgtgggagctcctgtggcctggcagggagctgcagaccacatgtgggaactctgctttgagaagtaggtcggctactggaggcttttctcctgcagtgatctctgtctgtatggtgcagcattatcaaaaactttctccctactggattatttccattcgcacacacacaggctgtaattactcctatcttaaaacttaacttgctggacaccctatcccccccacctccccagttactaccgcaattctctccttgctgctggaacaaaaattctcaaaagagttgtctatattcagtatccccaattcttctctcattctatcttgaactattccagagggtttttgtccccagagtcccaccgaaacagcctttgtcaaggttgccactgacttccatgacagatgcccctctcatcctgtcagcgtcagcagctcatccctgattgcctgggacatttccaggctttaaaatggaaagtcttgtgttccaggaaccaccacagtcctgggcaaatccagactggaggtcgcctagattaatgacctccacattgctggatccagtgataatttttttttttttttttgagacagggtctcactctgtcacccaggctgcagtacagtggcatgatctcagctcactacaacctctgcctcctgggctcaagtgatcctcccgcctcagcctactgagtagctgggactataggcacacgccactgcacctgcacccgggtaatttttttattttttgtagagatggggtctccctatgttacccagtctggtctcaaactcctgggttcaagcgatctttccacttcagcctactaaagtgctggcattacaggagtgaaccaccgtgccaggcccattgataaattcttagttctctcttggacctcactgcacctttctaaaacacaactttttttgagatatcatttacatataataaagtgtacatattcaaagtgtatgaattagtaagttttgacatatgcatacactcatgaaaccatcatggtcatcaaggtagtgacgctatcctttacctccaaaagtttcttcatgcccatttgcaacccctctcttctgcctttcatacctgtgttccccccaattctcacacctgagtattaatagcaatacctaatagtagtagtaattaatagcattactcaatctacagatgtattacttatctatttataaaattggatctatttattatatataacttatgttttattatatgcaatccatatattataatctatttattatataaggattatatattatcaattactattaatagtaatagtaattaatagtgatacccaatctacagatgtattacttatctattgctgtacaaaaaataaccccaaaattcatcagctgaaaactgcaaatgtttatcatctctcatcttctgtgggccaggagtgtggggcgcaacttacctgggtgactctgcctcagggtctctcccaaggttgtaaccacgggatccgccagggctgtgatttcattttataggcaagacagaagtcaccacctctttgaaacctaatctcaaaagcgacatctcatcatttttgccatattctgttcattagaagtgggtcacaaggtcccgcccactctcaaggggaaggagttacacaagggtgtgagtgccagggggtgggtattgcagggagacgttttagaggttgcctaccacaacaggcaactattgatctgctttctgttactatagattaatgtgcattttttgttttaagtaagtggaatcatacaggatgtagtcttttttgtctatcttcttacactcggcataattattttgagattaatttatgctgttgcattgatcagtagttcattctttctattgctgaatagtatttgtacggatacaccacaatttgtttattcattcacctgttgatggacatttgagccacttattaatagttttgggctattacaaataaatctgctgtggacatccatctacaagtctttgtatggacatatgctttcatttctcttgggtaaatatttagaagtggaaaggctagaacatacggtaggtatatatttacctttttaataaactgacaaaccattttccaaagtgactgaaccattttacattcccatcagcagtgcatgagagattcagtttctctgtttccttatcaacacttgatacggtcagcctttttaattttagccattcttgtggctgtgtagctctattttgttgtggttttaatttgcatttccttaatgattactgacgttaaaaatctttctgtgcttatttgctattcacataccttctttggtaaagtgtctgtctttagaccatttttaactacgttatttgttttcctatttggttttgaaaattctctgtatatgctggatacacgtcctttggcaggcacatggtttatagacattttcttttggtctgcagcttgtcttttattctctaatggtgtctttcaaagaacattatgtttcaattttgatgaagttcaatttatcaatttttcttttacagattgtacttttggtgtcacacctaagaaatctttgcctaagtcaaggtcacaaagattttcttcatacttttttctaaaattttttgtagttttagtgtttacatttaaatctagggtcatttttagttaatttttgtaaacagtgcaagctgttggattgaagttcattttcctttgtgtggatggtccagttgttcctacatcacttgctgaaaatattatcttttctccattgaatttcctttgcaccattgccgaaaatcagtgtgtatctatttctaaattctattttttgtttcagtgatctattttttgtctttacagtagtaattatattgataattgtagctttaaaataattcttaagatcaggccgtgttagtcctccaactttgttcttttacaaagttttgcttttctaggtcttttgtgtttcaacacaaattttagaattagcttgtcaatttctaccaaaaaagcctgctggaattttcattgggattgcatggaacctacacataaatttggggagaacaaacatcttgagtctttcaacccatgaacatgatatatctctccatttatttaggttgtcattggtttttctcagcaatattttacatttttcagtgttcagatctttcatatctttctcctaagtattccatatttatttatgctattgtaaatggtgttttaaaaatttcaacttctgattgttcattgctggtatttagaagtagaattgatttttacatattgatcttgtgtccttcaactatgctaacttacttaagaattctagtagctatttttgtaaattccatcacattttctacataggggatcatgtcacctgccaataaagactggtgccttttttcttttccttggataaactccacttggtcatgatgtattatcctttcttacttattgttgaatttgatttgctaaaattttgtttagaacttctgcatttatattcatgaggaatattggtctatcttttttttttcttctgatgtctttgtctggttttggtatcagggtaatgctagtctcatggaataagttgggaaatatgccctgctcttcaatgttttgaaagagtttgtgcagaattgataatgtttctccttaatctctggcataatgtttgaaggaaattttcctcctataatgtttggtgaaaccacctgggctggagttttctttgtgtgacttttaaattttttagttaaatttaattttttcagagacagggtcttgctctgtcacctagggtggagtgcagtggtgcaatcatagctcactgtaacgttgaatcctaactcctgggctcaagtgatcctcctgcctcagcctcttgagtagctaggactacaggtccatgccaccacaactggctaatttttaaattttttgtagagaaggggtcttgctatgttgcccaggcaggtctcaaactcctggtcttaagcgatcttcctacctcgacctaccacagtgctgggattacaggcatgagctgctgtggccagcctttttgtgtgaatttttaattaacgaattaaatttctttaatagatatatggctattcagattatctattattcttgagcgagttttggtaatttgtgtcttttaaataatttgttcatttttatctaaggtgtcataatattaatttgttcataatactcccttattatccttgctttatctgtagaatctgtagtgatatcatctctctcattcccaatattggcaatttttgtcctttttctttttttccttagaagcccagctagaggtttatcagttttattatcttctcaagaaaatcgcttttgctttcattgatttttttctattgctttccattttctgtttcatccgttggccttctgatttttatttttttctttcttctgcctactttgcattttttttattattatactttaagttctagggtacatgcgcacaaggtgctggtttgttacataggtatacatgtgccatgctggtttgctgcacccatcaactggtcatttacattaggtatttctcttaatgctatccttcccccagcgcccccgctccccaacaggccccggtgtgtgatgttccccaccctgtgtccaagtgttctcattgttcaattcccacctataagtgagaacatgcggtgtttggttttctatccttgtgatagtctgctgagaatgatggtttccagcttaatccatgtccctgcaaaggacatgaactcatcctttttatggctgcatagtactccatggtgtatatgtgccacattttcttaatccagtctatcattgatggacatttgggttggttccaagtctttgctattgtgaatagtgccacaataaacatacatgtgcatgtgtctttaagtagcataatttataatccttttgggtatatacccagtaatgggatcactgggtcaaatgatatttctagttctagatccttgaggaattgtcacactgttttccacaatggttgaactaatttacactcccaccaacagtgtaaaagctttcctatttctccacatcctctccagcacctgttgtttcctgactttttaatgatcgccattctaactggcgtgagatggtatcacattgtagttttgatttgcatttctctgatgaccagtgatcatgagcattttttcatgcatctgttggcttactttgcgttttataagatcttctttttctagtgtcttaaggtggaagttgtaaccatttctttttttttctaaaaactgtggctctatgtcaacctttcttttctaatataggtgtttactgcttaaatttctctccaagtactgctttagctgtagccacaaattttggtatgttgatatgttttcattttcattcagttcaaaagactttgatgttcttggactatcacctccatctcctcaagctggggtgtctatcaggctctgcttgagacccatccctcttttgagtctggaaattcccttgcagcaggaagctggggtaagaagatggctgaccttatttatttcctgtctctgagggagacctgtctttcattgcttgatgtccagtgctttgaaaaccttgtttcatatggttgtttcatgttgctgaattcttttttgttttttgagacggagtctctctctgtcacccaggctggcatgcagtggtgccatctcgactcactgtaacctccacctcccgggatcaagcgattctcctgcctcagcctccttagtagctgggactacaggtgcctgccaccacgcccagctaattttttgtatttttagtaaagacagggtttcaccatgttggccaggctgctctccaactcctgagctcaagtgatccacctgtcttggcctcccaaaatgctgggattacaggcataagccaccacgcctggcctcatgtggctaaattctactaaacagtgaaagaacaataatttcaatgccatgtaaattctgccagcatatagaacacggtagcatacccttaaacaacttttaggagacttgtgcaggcttgattaaagaaaaaaaaaaaacagacaggacagtatgagaaaggaaaattatagggtaatttcgagtgggtaacaaagtggaaatcccaaacaaaacagcagtaaacagaatcccacacgggtaaaaaagataatacatcatgatcaaatcggatttatcctaggaatgcaagattgacttaatattagaatttttcttactgaaatagagattcatttttgttttacttgtttcattttagttttgattttagatgtttttttaacattaaattttatcattatggagaatgtttacatggttccaaagtcaaacctacaaaaccaggaacattctaagaagtccagccctgtccctgcccttgccacatttttctttctttcctgcccttttttctttttttttttgagatcgagtctcaccctgtcacccaggctggagtgcagtggcgtgatctcggctcactgccacccccaccttctgctttcaagcgattctcctgcctcaacctcccaagtagctgggatttcaggcatgcgccaccacaccgggctaaatttttttttttttttgtatttttagtagagttggggtttcaccatgttggccagactggtctctaacttctgacctcaagtgatccacccgccttggcctcccaaagtgctgggactacaggcgtaagccactgtgcctggtctctttcctgcctctttagtaaccattttttaataataaaaaaaaccttccattaaaaatatgattgtatcctacccctttttggataagtggtagcatactatacacacatttgccatcttactttatgtacttatatgtgttggaaactcctttgtcatgtacagaaatggttctcattcctttttacagctgcatataattccattatatagatatataggctgagtgtcccttatccaagatgcttgggaccagaagtgttttagattttggattttttttgtggtgtggggggagggtttggaatatttgcatatatataacgagatatcttggggatggaacccaaatctaagtgtgaaattcatttgtttcatatacaccttaaacacagagactaaaagtaagtttctataatatttgtaataatcttgcatgtgaaactaagttttgactgcttttgactgcatctgtcatatgaggtcatttgtggaattttccacttgtggtgtcatgttcatgctcaaaatgttttggattttggagcattttggatttcagatgtaccatagtttattcaacaatcccctgttgttgggtgggtcagggcaggtggcttttgcatttacaaataactctgtaatgaataagcttgcacatgtgttttttttctttttgtcatatttgggagatgtttctagaagtgagattgctgagtcaaagagtgaagacagagagaattttgccaaattctttccatggtgattgtacaacaattttgcattcctgccaccaaagtatgagagtgtctattctccagagcttcattaacagaattatgttgtcaaagctttgaatttttaccaggaataggtgagtatgagatctcagttttcatttgcatttctcttattaagagcaaggttgagcatcttttcatatggtcaagagccatttgcatttcttttctgttaatggtctgttcatctgacttgcctatttttctatctagttgaggtcttttctattttaggacgtttgttaaaatatcgggaatattaactccttgtattagaagttgaaactatttttccccagtgtattggttcagattttttccctaatgcaagaagtccagaggtggggactgtccacattggctccgtggtcccctgtgtcagggccagcttttctgagattctccaggcatctccccaacagtcacgttatgactatgtcaaaggcaagtaggaccaggaagggatggctccagagatacttgtctcttattaggaaggcaaaactttctcagaagccccaacagatttgcattcagatttaattggccagaactatgttataggcctctcacctccagcttcagggaaagctgggaaagaaaatatttcatcttcccagtctctggagtggaggtgggcaaggcaaaggagattagaatgcatgttgagttatccaaccaactaccacagacaagaggggtgagtttacattaaataaaagacctatcttttctcctgttctgtgacatgtctgcaaatccacagtaaatcagtagttgggcttacaactccaaaatggaattcagtttgtttgattgtttgtttttgagatggggtctcactctgttgaccaggctggagtgtgttcacagtttactgcagcctctacctcctggggtcgagatcctcctgcctcagcgtcctgagtagctgggaccacaggtacgtgccaccatgcctggctaatttttgctttttttttttttttttttttttttttttggagagactgggttttgccatgttgcccaggctgatcatgaacttctgggctcaagcaaccctcctgcctcggcctctcaaagtgctgggatgacaggcgtgagccactgtgcctggctggaattcagtcttggatgcctctgtagaggtttcgtgtccttccttctgaagcaaggaaggtgagatgacatctagagaccggtgtttccccgtaggagcctatttgtaaggagtactgctaaatgggatcatgtccagaggcaagtcaccagggcaggggagcaaggaccttaggaaccctgccctgccaggaaaagcctgaagattcagagatgtcatcttagcgaagatgtggaagagagcaagacatgcctcactgaaaacccagaggactggcatgtggaaaaaatcagatttgatctgtagtaacagttggtgcatgttacagtgaggcggattccaattcattttaaacagtagtttttactaattcgggatgggttgctttgtgaggccgtgagcttcctaccctctgtgtgatcagtcttgccactctcatggctttatccttcattactctctggttttatcctccacctctatgtcagtgattctctaacctgtgtctctcctccagaactctcccctgacccctgtcttcttcaacccaccacaaagccctttcttattctgagttggatcagtcagggtctcaccaggaaatggaaacctcttgaatatttaaaaacagagggactttaatgcagggaatttgttaaacaggtaatagtcagtcgcccagcctagaagttaaacagaggacagtgagacaattcaaagtaacagcagcaggaagcactgtcacccccaggctgcagggtcacccagcaagagctggaaccacagtgggcttgtcggggcagcatctataggaatggaaaacacacagcaactgtccgagattctcttaaagcagaggcagagtgagaaagagcccagcacccaatttcctgccaatgctccccagtggccaaacaaaataaaaaaccagatgatagagaaacctgagaaatgcagccctgcagagcacaagaaaggtgaaggagaatgggctgagcacagatacacaaggcaagaaggggtggaaggtctcctagattttctggggtctgtgggcagggctgggacactaagaagaaggttctttcagaagcagcctctgagccagggatttgtatgcaaatgatttttttttttttttttttgaagacagggtcttactctgttgcccaggctggagtgcagtggcacgaccttggctcactgcaccctccacttcttgagttcaagcgattcttgtgcctcagcttcccaagtagctggaattacaggtgtgcaccaccatgtctggcttttaaaaatttttttattttttaattttttttatttttagtagagacaggatttccccatcttggctagactggtctcagactcctgacctcaagcgatctgcccacctgggcctcccaaagtgctgggattacaggtgtgagccatcatgcccagcgtgcatgcaaatgacttataaagaaagtgtcccaaggagagctcagtgagagagtcaggggaagcagtgttggaaagggaagaagccaatggaaggagagatttcaggggaagactgaacatcgtttgatccggtggagaggtctgaggtataaactgcttctgagagtttgtgcctgctcaggcaagagggtgggctttttaaccctgtacctgtcagtccttgctggagggtgggaaggggatggacctctggctctgagtctggtggatgcctgtatgctccaggagcccaaggatgagccgctggagaaggtcacagctgcgaacgatgagtagcaaagcacatagaagctgggggtgggaccatagcattagaaaggggatgtgtgggggatctgggtagatgaccgagcatgtctgccagagagtgtgcaggtgggaggggatggtggacctttcccatagacatgcacatggtaaagcgggaggtagaaagcaatacacaacctcagagagagacagataaagtgccacgggtgggggtgctgtatgggaaggagaggttgcctctccgctctggtttgtgatggcaattttgctgtagtgactgtcgtagatgtagaagtacccttaagatgctgcacaagggccaggcatggtggctcacacccgtaatcctcgctttctgggaagccaaggcaggcagatcgcttgagcccaggagttagaggccagcctgggcaacctggtgaaaccccacctctacaaaaaaaaaatacaaaaaagtagtcatgtgtggtgatgtgtgcccatagtcccagttactcgggaggctgagatgggaggaaatcacctcctctgatcactgactgggttcttaaagccctggggactttggactacgcacgttgtgtcctttgttgttgtctcctggctctggggccatgttccttgtgctctaactttgcttctcacaccatggcaacggaatctggtgccttctcaggctgtctggggttgaccctgcagacccctggtgtctgtctctgcctagtccccaggtcattctgagtgcaactccggccaccttttcttttccaaatggtctggaactccccccttcatataacagggggctctctgttctctctctttaagaagctaatttctaaatataatcctgctgtattatgggtagatgcagcgatacagttaatgagtctctaatgtagacaattataacctagaatacagcttggcttggttctctaccactcacgtgcacagacagttgcagtaacacatacccactcacaattataatcttgttctctgagaaaataccatacccaggcctcacaggcagcagacccagagttgtgtacctgcacacacacacacaggcacacaaacactcaggggcccttacacactcagaaacatccactgtagtagaagcgaggacctgccactgtacctgcgagagaggcagaggaggtagctgtgtttatagcaggcggtcctgcctctgctcccaccagccacctctaattggaccagatggttacttgcccttggttccataagcaccagtacttttaggaattctttggtggcagaagcagaaaccaacttagagtttcttaggaatcagaggtatccacagaacacaagggcagaaatgatggaagggtcttacgtgggactttaactgaaaactggaagccgccttcagccgaggcagttagtttctctctctctctctttttttaaatcattctggggcagcaaggtcttccatctgtcatctgcttctcttttttctttctctcttctgtcttgctaaaatacctacattcaaatcacttgaagcatttattaaaaatttagagccctgaatctctggggatgaagccaaagaaactccacttttaacaaatgccctaggtgatccttcaacatgcaaaagtttgagaaccactgtgctaaggaggtacataattcaaacattgacacgtgccttcgagacatgccctcctagtcacagcaccaccaactaactaatttgcatgtctgtgtcccagtttcaaatttctgggagtcagaagccaactgaatcagcatgggttggatgtcctggtccagtgagctgtgggtgttagtgaggggagtggtttggtcccattggaaggtgtagacgctgacagagtagggacattgcccaacttgtctgttacagtgagatgttcccaattcctcataacaaattctcttttacagaagttggtttgggtgggctttttgtagtcaaatgactgctgaggcacaaattgtcagaaatactcaggcacacattgtcactcacacatgcatacatacgcacacacccatcattctgagcactgtggagaggtttgcttggtaatgatctctttgcagcttagtaagactataaagaaggtggggaacctttattaattatatatcttacattcaatgaaacataatatttaatttaaatacttgcgggaggcgtctttgatactttgatttgcttcccagaacaaatggcttctctccctccctggcctgctgagttgatctctcatgatgaaagaccaacctggtttgtccccttcacaggatttttgtcgtagaaaatgatgaaatgctttcccaacagagtgtaaagccaaggctgcagtcatgttgccaggcttgacaaggaaatgccaggaaaatctatccattttatgttttctagacaacaggctggggaggtgaggcttataacaggatcctctgggttgcagcctgagaggctgactgcaggaggcaggtgttccgtgcagatgaccccacaagcacggtaacggtggacactaccccccgctgtccctcaccctacatcagccatgcctcctgatcttggccacaccctcctttgtgcggggaactgttgatctctgtgggctctcaggagtgaaagaaaaaccatctcctgggctgggtgcagtggctcacgcctgtaatccccgcactttggaaggcccaggcgggcagatcacttgaggtcaggagtttgagaccagcctggccaacatggtaaaacccagtctctactaaaaatacaaaaattagccaagcgtggttgtgtgcacctgtaatcccagctactcgggggctaaggcacgagaattgcttgaacccgggaggcagtggttgcagtgagccgagatcatgccactgcactccagcctgggtgacagagcaagactctgtctcaaaacaaacaaacaaacaaacaaacatcatctcctgaggtgaaagtttggtggcctggtgacaattccagacaacctccaaacactataatgctacagaacctcttataatactagaaccctggcaaaacaggctaggaattcttgttttgaccaaagcttccagagttcagatagcccaagatctgattggaagaaggaatctcagagtacttccttagctgggagtttccaaagcaatgcatctggccgagtccaggccagctggctgaatgcatccctggaattgcctctcttcccttcctgaaagacgagagacttggcactaaatgtaggtcaagtttctatccgagattcttttctctttttccaagacaaagtctgggaagtagctgggctggggatggtttgggacatggaggaggaaatctaacattagttgagtgtctctgatgtgttagacactgtggctggtgtatgaatgtcactgcatcagatcctcacaagtcttgtgaacaagagaggtttgtcccccacttcacagataaggacactgagattctggaggtagtcacttgcaaagatcacgtaggaagaggcagagacaggattttaagctgcattgtttggctccagaaggtcgcccttttccactgcacctgccacaggagaaaggtaaggtgcaggcttctctggctgggtctgctttccccaactacttcttctttttttttttttgagatggagttttgctcttgttgcccaggctggagtgcagtggtactatctcggctcactgcaacctccgcctcccgggttcaagcagttctcctgcctcatcctcccaagtagctgggattacaggcacgcaccaccatgcccggctaatttttgtatttttagtagagacgggtttcaccatgttggccaggctggtcttgaactcctgacctcaagagatccacccgccttggcctcccaaagtgctgggattacaggtgtgagctaccgtgccccaactgctttccccaacttctaagggctcacagcagtggaggaggggcccggcaggaactaggagctctttggctttcacagggccaggtcgctttgctggctattctctctcccacctcttcattctttccctcttccaatcaaacaacctccaatcattctgaagcttaaacaaacaacaatgacaaaaacaaaacctccttgaccttcctctacttctaaccaccattttctctttacaggctgatgaactcctcttctcagttgagctactcaaaaaaagttatcctaatgtctcatccctaccttccccccccatcctctcttcatcccattccaaagtgggttcctgtctcactgctctactgcaactgccccagcagggccactaattaccctctcattgttgaattcattagacactttccattctcatattatttgatttctcagcagcattgacctgttaacctctcggtccctcatgataacttattttccttttctttcatgatgacatagtctctggattttcctccatcctcttgcctactctttctccatcttatttttgggctctttctcctccatccaaccttcaaatgttcaagtttttcagggcctggcctcaacctcttcccttctcattccacacttgctctccaatcccacccatttccttggcttccatgcctccacatttatgtctccagcctgcatgatccccctgagctccagatccacgtatccgactgttgacagaggagttggcaaatttttttctgttaaggaccagataataaatattttatgctcagtgttgtcttctgcaacaattcaactctgtcattctagtgcaaattcaaccatagacactaaaagaacaaatgagcacggctgtgctccaaagaaatttgtttatggacattgaaattagaattttacataattttcatgtgtcaggaaatagtgctcatcttttgattttttccaaccattaaaaatttgaattttatataatttgaattttatataattttcacacatcaggaaatattattctccttttgattattttcaatcatttaaaaatgtaaaaaccagatgacaagccagaagtgacccatgggctgtagtttgttgtcccttcatctgcgtgttggttcactgggatgtttcataggtgtcgcacaccagcatggccaaaatgtcaccctggacttgcacctccagatctcagtgtccacagctacgtcaaagaccctttaatactcataactgctgtgcaagaaactgagagtcacccttgatggagccttttttctcatccctccctggtctcaacttccaatccaagtcctattgattctccctcctaagtaagtatagcaggataatattgtgaactatctgctatgtttttttttctttttttcttttttttttttgagacagagtttcactcttgtcacctaggcaggagtgcaatggcactacctcggctcactgcaacctccgcctcctgggttcaagtgattctcctgcctcagcctctggagtagctgggattacaggcatgcaccaccatgcctggctaattttttgtatttttagtagagacgaggtttcaccgtgttggccaggctggtcttgaactcctgacctcaggtgatccacccacgtcggcctcgcaaactgctgggattacaggtatgagtcatcgcacccggccctgctatggtttttattctgggaattttgagtggtctcgccttctcctctccttcaagtcttttctcaaatgttacctctacacaaggtctcgtctgactgaccacccttttttaaatggcaacctgataccccttaccctgttttaaaaatcttcctttttgcacatatcacctattaatttactatgaaatttaagatttgctattgttattgctcattgcctgtctctctcctggctagaatgacagctcttcaagggcagagatttttgtctgttttattcactgctgtgtcccaagcacctagaacagtgcctggcacatagaaggggctcaactaacatgtgttgaatcaatgcatgctgctgaggcttagcttccttcatggggagggagggcaggatccgcagcgacaaagaagtcattgctattcttaaatgaaactctttgaagctggttctcggccctggctgcaaggcggaatcatcaattctgccctgcagaattgattaaattgatttattcatcaactaaatcaattgaactttaagatcaattgatcaattaaatcagaagttctgggaatggaaacttttcaggtccctacaaaaattaagccaaggttaagaaccactgctttaaagcgatagaaagacaatggtcagaaaagcaagactttcatttgtagaagccaggctttgtgggggtggaagaaagcatgcgtgggctctgaagatcctaagcttagatgactggccttagatgggtgtctgaaaagggaagaaaacagagcatgacacagatggagatgcaagtgccgctgggtggcaagagacgaggatcagtgaggacatggaggaggctggcacctcagtccctgtgtcatggttcagactaggggtgggctgggatgtaaagatggaggaggctgtctcatttcttccagaatctgcaagtatcaatgggggaacactgaagcagggaggacctgaagcatcctctcagtccatctcaccctgagaccctttcccttccagtagtgtgtgaagggagtgaggaaatgttcccgggccccagagaggggtcacgcaggtggctgatattgggatccactgtgctgtggtgcaagggaacccaagagacagtgggagggacagctccaggcccgtgcaggataggctcagtctcagaggattgactaggtccatgattgcaaaactgggtggtgggtcagaggaaagtagaccatcatacacttaatctgttgagaaaatgcagcaatggtcgctgttgctggaatggagggggagccaaggctgacactcagacaggcctagtcacctctacagggctcagcaccccctggctccataatgtcttccaaaccatggtaggtctgtgttttttgttcatgtaactctcgtaactgtcatcctatggtgatgtgagtattgctcaatgattattttctatctaaactgttaggcccatgagtgctaggaccacgtctgcacccccagaggctaatgcagtgcctggcacaggggcatggataattattttaataaacaaagagaggaatgagtgggagtcatgccgttagtcgttggctgagtggagctagaatcccaggtcctgggtcggcttgcatagttcctcaaggtgctactggaaggaggaaagcctcctccttgggtgccttgaagacaagacccacacatgtttgctgatttgagcaggtctgggcttgtctccacatgagtgggtcttgcatgggattcgtcagcttcggacacaggtgtattaggctgggccacatgtcacactgtgtcctgcctcagccctctcaaaacttggctcccctaacacctagaggggtcctgtcctggctaagggctttcccagctcccttcccaccccactctgcccttcccgctggctgtagggcttctccccacctccctccaccaggggctcctgccttccagtctcctcccagtctctttcctgtctctggactgaaggccccataaaaagtcactttggcctcaatcaatagaccatctctttaacaagggagatgctggtttgtaaaatggagcctccaaggctgggctgggtgcagagccagcccttgcagacagctctgcctttccggatggtgcattaggcagcatcagcagatttttgccttttatgaggacatatatgactccccaaagaaaccttaacagagaggggatcgggaaagtgggagagtagaaagaaaagtgaaggaacattattctgaaagtgcagagaggctgctcaggtttggttctctctgccaccttcctgttccttttctagagtccttaagtgcatcagtagcgttatgcaactaagaaattcactcacacagtgtgaacacacaagttcacccagatagagaacgcacacaaacatgcacacgtgctctgggctgtcacccatcaccatcacatacccatgatgctgttctttaggccagaagtgctgtctgtctgtcccctcccttccatactgcccggctacctcccggtcctctctcacgccttggcccacttttcaatcatcatcctcagggagtccccgggcccagtcccctggttaaaggcacaaggtgcctccctcttttgaggcattttctgtacttggaatttgacatttatttgcatatgacacacgcctcacctaccaggctgtaacctgcaagtgacaaggacagttttgttctatcttccacccttagcatgttgtcttgtacatagcaggtcctcatgaaataattgctaaatgaattaatggatgtgatagacaacttctaaaccagcgcccagtgctctttacccctgacattcatgcccttgtgtaatccccttcccttgagtgactcacttctaatgaatggaagacagcaaaggtgcagtggactgaatgtttcccccaaacatttacatattgaaatcctaactcctgctgcggtggtattgggaggtgggaccctggggaggtgattaggtcataaggttggggtcctcatgaatggcattagtgtccttataaaaggaaccccagagagctgtcttgccctctctgccatataggatatgagaagatgacagtctgcaacccagaagagaaccctcacagaacctgaccatgccggcaccctgatctcaggtttccagcctccagaactgtgagaagtaagtttctattgtttataagtcactcagtctctggtactttgcaacagcagcctaaatggactaagacaaatggggataggtgttgcctgtgtgatcaggttcccattctgtcctctctctctcctcaacttgcttgccctgatgcagctggcttccatgtgtaaagtgctctatggagaggcctgtgtggcaaggaactgggagtagcctccagatgacagccagtaaggaactgagaccctcagtccaccaacccatgaggaacccatgcaatgaccacatgagtcaaactttgagatgactgcagaccgagccagccccttgataagagctttgtgagaggatcagagccaaaggaccaggtaagttgtgccagattcctgacgcacagacactacaagatgataactgttgttcatttaagccactaaattggggtcatttgttatgcagcaatagatgagttttacaacaaatggatgactgagaaacaaccaccaacgccccatcatgcattgaagcctgtcctcatcatgtagttgaatacaatcaaatctgcccctccacacagctcaaccactttaccatacaggagcaatgttttgcatagacacacacacacacacacgcatgcatgcacacacacacacacattctgaaaggtactctccctttctctatttttgctaccttactaccccattcaggtagatagcacccaaaaatctcactgtgtcaggccagagtgccaggcccacttggaaaccaccccctggcctgtcactgagcccatcatcctcatgggccctcctgtccgtttctgtgtcaccactaaggccagagttaccaactgcccagtgatctcatcacagagactaagtgttaaggctaaggagctgcagcaagggtgggcaattgcaggggaagttgtccctcgagcaccccccagccacccaggtctgcctcacagaaggccgcctgtgcttctgtggctcagcccctctcctgctgtcagctgcaggcctggcctggccagcgtggaggaaataaaagagaactgttctcggcctggagcttccactagggcagcattgggaggtggcagtgcacacccttcccctgttgcctcacttgccctgtcccagcctccctaggctctggaggggagcctctgctggcccacggctcacagggcccttctctgggggttgtttctataaggaggaccaccacttaaactgtaacagaagaggctcacatttctggtgtggggacgggctaatttttagagactctaagccaggcagatcttccagcagtagcacagtatcctttattgaggggtggggagtggagtgaaggctattgacaagtcaaagtccagaaaacctgcatttcttctcctctctccctatcattaacccagagggcctgccttgtcctgggcctaatgaagctattcggagtctagagctggcttccctgggaaggatagtcgagggacacctgcaggcgttttgcttcttgctttctcagaccttgttctctctcaaatctgctctccgtaggcaaaatatggggaagattggtgctcttccatcaggccccatgaccctcctttgtggaaatgagcagcacgggccagtcttctagaaagattgtctttccgacgcttcctgtaggcaggtccaaggctgttgttctttgcctgtcacctccgtggagccactgcttccgtcccaagagcttgggtagtaggcttctggtctggaaagttcttactggcactagcagagtcacaggcattcactggggagggggccaggtgaggctggagtcttgtttgaaaagcagagttgggatgcctttagaataatcagtggtgaatcctcacatggcctcagtccctgcgtccctgagccctgcacccagcatgttgtacgtccacgtgtttttgtgtgtttgcgtgtacagatgctccttgacttatgatggggttatgtccccatcaaccccattgtaattcaaaaatattgtaagttgaaaatgcacagccgggcgcggtggctcacgcctgtaatcccagcactttgggaggccaaggcaggtggatcatgaggtcaggagttcgagaccagcctgaccaacatggtgaaactccatctctactaaaaatacaaaaattagccgggtatggtggcatgcgcctgtaatcccacctactcaggaaactgaggcaggagaattgcttgaacccgggaggcaggggttgcagtgagccaagatcatgccactgcactccagcctgggtgacagagtgagactccatctcaaaaaaaaaaaaaaagaaaaagaaaatgcacttaataccctgataaacctatctaaggttgaaaaatcttaaatccaaccataataagttggggcccatctataaaggcgataaaagtggggactcctacctggcaagtagccccatagttaaagaaattgaaaattttccctaatgcagatcatctgtcatctatctacctatctaatccctaataaaatctactatctatctatctatctatctatctatctatctatctatctatccatccatccatccatccatccatccatccatccatccatccatccatcaacatctatctatcttcaatggccaagtagctctgcatatcaaggaactcataatctagttacaaagaccaaaatcacaaatgagacgattaacagataccatgagactgttatacagttatgctgagataccttttataaatgccccagggattcagaaaaggaaatcagaatagctgataaaagcttcattaaggagaggggattgaccagggccttggagggtaagagagaatttgaatgggcaaaaagtgtgtgtgtgtttgtgtgtatggagaagttataagggggccgggatagggaggacatgaggaagggcccagaggcagtaaggatgcggaatgtagggtgaggagggaaggagacagctgaccatgtgcagagcgtggggggagaagttgtgaaatcagggacagattgtgaagacagacttagcgcaggtggcagcggggcaggcagtgggtctctggtccacgtcagacaggggctgcatgagtgatctgagctgttacatgcccttctcacctgttcttcagcctcccaggcaaaaatggggacttaccaggtaggagtccccgcttttatctgagtcctagaccttctacttcaagcctctcagggctgctttctctcttcccttccatctttactcagctttccaagagcctctactccttgtccttcagttctgttatactccagccatttgctgtctttgtgcctatattgacacagctgagcactaccccaaagcctcccatggccatgtgcattggagccattgtaacttcattgtctccaacagttccctccatgactagtaatctttctatgtctctaatggcctctgtttcctgctccacacaggccattacaattcttctctcagactccaaccccaccattcccctgcctgctgccctgcagcccctgtcaccatcagcaataaccttgcgaatgccccaacttcctgccatcaaacctaaacctctctgaacttgcacctatattttccttctctctcctgacaccacagataaatctgagcccttctctcatttttcagggaccactcttccctcccttgcttatatctgtaagctttacctctctgctggtctcttcccatcaacatttcaatatgttcaaggctttattatcttaaaaaaaaaaaccctcaagttttctcctttactttccatctttccccctttgtcatctcctttctttctttcgcaaccacatttcctgagtgttttctgccatcattgtctcactcccttccatgcctactcttcaacacttggtcattaaatttctgtcccatcctgtccattgagattgatttcctcaaaatcattgggacatgcttctgctaaatccaatgggcatttccatttcctgtttgtgtgacccgctagctgcacttggcactgtggaccattcccttcttccgagtctcacttcctttgtcttctgtcactctccctattttcttcccatctctctggtcactaattttttgtctcctttaatgcttttgctgaatgttgcttgaatgttcctgccctttgggatccttccttaggccctctgctcttgtcagccttcatactttgaccaggctctgtcagcgtctaaccacgatgacatctatatagtcaggactttgggttgcaaatgacagcaacccaattcacactagctcaagcaaaactaaagagaaatgtttggctagcataataggctagtttagaagtagagtgaaactcggcatgtctggatctaaggactcaaatgatgttgtcaggcctctttctctctgtattagtttgttctcacgctgctaataaagacataccctagagtgggtaatttataaaggaaagaggtttgattgactcatagttccacatagctgacaaggcctcacaatcacggcagaaggcgactgaggagcaaagtcacatcttacatggcagcaggcaagatagcttgtgcaggggaactcttatttataaaaccaccagatcttgtgagacttactcattaccacgagaacagtatgggggaaaccatcgccatgattcaattatctccacctgggcccgcccttgacatgtggggattattataattcaagatgatatttgggtggggacacagccaaaacatatcactctcccaccatttccactccagccctgtctctatcattgtcttggcctcattctcttctgttgcacaggatttctcatggagtctggggagggcacagggtgatcataaatgactcggccttttagcatcctagataactactctggaggaaagaaagaacttcttctcccattcctgggaaaggacagtggttgatctaactggagtcacatgctgactcaaaggacctgaatgaatttggggtagtaagaattgccagcccccctggaccacatggaattgtggaagaacagatccctaaagaaaaaaagagtgctactgccagaagaagggagaggaatacaggatgcacaaagcagatatttaccataaaagctcctatttatgttttcccatccagacctttaccctgcatttcagaattatagatatcttcatttggatgttgcaaactcagcaagtctttctttacacaaatttcctagaaaataaatccctacacaaaatgcctatggtaaggctgtattgggtggtacaaatccagggtagcaaagtataagagaagtaggcacatggggcagaggaggagggaagcaaacatgagatggtgtgttaccgagtgtttggggttgaattgtgtcctcagaaagatatgttgaagtcctaactcctagcactgcaaatgtgcccttatttggaaatagggtctttgcagatgtggttaattatattaagaggaaggctagctggattagacgggatatgattggtgtccttataagaagaggaaagggcacgcagaggggaggaggccatttgaagacagaggcagagatggagtaaagctgccacaagccaaggaacacctggggcccccagatgctgtaagaggcaagaaaggattctcccctagagccctcagaggtagcatggccctgccagcatcttgatttccaacttctggcctccagaactgtgaaagaataaatttctgttgtttcaagccacccagtttgtggtacttttttacggcagcactaggaagtgactgcaccaagctagccacaacttcgttaaaaatgcaggcaattttgggaggccaaggtgggaggattgcttgaggccaagagttcaagaccaactggggcaacatagtgagatctccatctctaaaataataataaaaaaaattagcagggcatggtggtgcttgcctgtagtcccagctactttggaggctggaggctgaggtgggaggatcatttgatcccaggagtttgaggctgcagtgagccatgatcacaccactgcattccagcctgggcaacatagtgagaccctgtctcaaaaagaaataaaataaaaatgcagcctgttgcttgggcacatggaaagttttataaacaggactaacagaagaaccatgccttggaacacttctttggggttgggggtagagagaaaaagatttagctggtggcttctttctgtacttataagccaggtctgtttcatggttaactcccacccatttctgggttgtgttaattggcccctccagggatccactggagaaaccagaccgcaagctttcagtctggtgcttcagctggaccaaaaagtgatcagagaagccgtagtctccaacgggttcagccaagtccagggatgactggagcttgaaagagctgttgatgaagacagagtgggatgaggcagaaaagctgtagtacattatggcatacaaagaactagagatgcagctttgcctaggaacctggtggatgagctgcaggacctgggctggaaaagaattaagcatttgtggcagctgcccatggaacatgtggagaatgtgctggtggcattgctacccaagtccacctcctgcctactacatgacaagccagtgtccttgttacggctgcactataagcagttcagatcgccaaagggcactgctctaagtccaacttgatgtgggatgagatgagcgtacactcatgattgcagctggagatcctcattgaccaatgattaagacctgtggggtagacggagatcagcaaatcttggggtatgtatataacaaggcttagtataacatccaaagtgcattcatcttccctctactctaaacacaaacctgctatttctgtgcttcctgattcaatgattggtagcaccagagactcagtaacttgagccagaaattcagagttgttcttgacttttctcttttctcccgtgttcaatcctttaccaaatgcagtcagttctgcctccaaaatatctcttgactctgaccactttctgtccccattaccacatactcttccaggccaccttcttttttaccttggatattgcaataggctccagatgcactccttaccttttgtctcattcacctccaaaatgtgcccctccctgcaggcagcatgatcttcccaaacacagactaatcaagttacacccgatagacagttcttccaaggctctttgttgctctttgtataaagatccaaacacaagtcccctgaagctctggctgccatgtaatcccttgcctcttgtcttgccacttcttgtcttaagtgctacaatacagccaggctgaacttcttgtggcctttgtacctatgatctcatttcatctatctgttcactcctccagcgagtgtctggtgagcgcctgctatgccccgcagtggcaggcactgcgatcccagcagggatgctcttgctcttgagcctttgcacatgctgtacctcctgcctggaatgttctccccttgtgtagaaaaagcaaacagactgctcacaatcttctcccttgccttcctattatagagattagaaaacgaagactcagctttccttgtagaggacacacagttctggccagtgagatcaaggcagaagtccatagagagggcatcctttcctgaataaaagtcctcactaaaggctttctgcctttctctctgctttccaccaggaacacgactgtaaagccaatgggtacaacagctgccctgcaactatgtggctgcaagaatgatcaatgatcagtgataaaggactcgatgctaaggagaatgggtggaaataagggcctggttctaaggccgctgtgtatagccatgtaggttgtgtgttgcacaattctaggaggcaccattgtcatagactgtaacatggttaggctgtggtcctggtccagcctctggtctagtctctgaagggaagggagtgaagggaatggcagaaagcttggaattctgtgaattgtgaattctcccaaatctctctagcaaccaaattgtttccataattctttatgacaaggcttttgaaactcaaaggctgagaattgatttcatcttctgctgtgtcaacttttgcctaaggcaatgagtgatgactcacctggttcagaccaggagagaaatccaggctgaaggaaaatacagggagaggggtagaattccttggttaatatttcaaaatcttagtctgcaacaaatgtacccataaagtgtgtgccaagtaatataaatactcttaatagcaaagaaataattctacttaaattggagtaggaaatgaggaaaagttggagaaagctccccagggagggtgacggttggactggactttgaagactgcatttattttggcaagacagggaaggcattctatacaaaggtctggcataagcgaagtcagagaggcctagtgtgcatggtacattggcagaagtaatcaagcgtggcaaaggagttgccaggagggaggttggggcaagggtgagaaagttcttgaatgtgcaactttcagggagctgaggaaaggatggagaagtcctgactgtcctctcacggacatccccacctggcctcaggtgtccgtacagccccttcaccttgcttgataagcaactgcccagtgctggccactctggaggagtcatgggagcccacactggctctgggagagtgtgtactctaggcgatggggttgcccctggctcatgggctcactgtctcctgacagcttggcccctggtgtctcctgggaacagcccttcttgcttaggccattagcacacccttaaagagggagagaactgccgtcagcagacctctggcttctcccagccatggctggggagaaggagcttcccaaggtgctttgcagctgctcctgtgggcccacagtgctctttctgcaccatcttggcactcagcactgtgtgtactcaccctggagacacagattgagccctgatctgtatttagtcttagtcacagtcccagtgtgggattccctcccctgcccaccccacccccacccttggaaacaagtgagtgggagcctttctcatctccgggggtggatcaaaactcccttgcccagagtgggtgggaagaatgctgagcctggggaaggattctggggtgcactctttccaagcctccctgcttcttcaatggatcatgaatcttaattccccatcccagcaagggctgcttccagagctgagagagaagctgtgtagttgggatcattgcagccctcaaggatgcactcaagccagtgaggaggagaaagaccacttgaccacccatggaatcagggatcattcctgaacccctttcactgtctatttggatagaaggatagaaagtaaaggtggtgatcatcttttgattctactcttatcttgcccaaatccccacttgctagagtctaggaagccaacaaccccttcatgggtatagattttcacccaacctacttcagtcaggtatgagcccataaagcctaggccaattcctgcttggttcccagcacccatttacctcctgatctctggtagggataagagtgtgttggggatgtattagtttttctattgctgctgtaataaatgatcacacattcagcagcttaaaatgatatctgcttcttagcttacaattttgcagggcagaagtcaaaattgaggtgtctgcaggctgcattccttgctggaggttcaagggaggatccatgcttttgttcattcaagttgttggcagaattcggctccatgcagttgtaggactgagggttctttgttggctgccatctaagggtcacattcagcttctagaggttgccagcattccttgattggtggtccccttcctccatcttccaagccaccaatggtgggtagcgtcctctcacagtttacatttctcctgtcttttctttcgttgcatctctctgagttgagcagggaaaggctcccagccacctgggtggccccagtctaatcgcctgagcccttaaaagctgggagcctttctctgctgaactttcacacttgactttgcaggtgtgattaaatttaccaatctttctgtctcaagatcggtaaccttaatcacacttgcaaagtccttttgccatgtaacataacatatcacaggttctggggattggagtgtagacatctttggaggccagtatttggcctgccatagagtgtgattaagagcttcatctctgcatcctcttcccctccccctcacaaattctggtcctttaacctcagggtgaggaagaagcccaggacacaagagaaaagccaggtctcttcttggcttacaggtgaaggtttcccttatttgaagttgtctgcacaacttcttcaaagagaggctggtttgagagctggaatcccactaggggtgttgaaagtaggaaaaagtgaggaagaactgaggttctaactaacctcagcctttatccaaagccttctccatttaccagcaacacagaaacaaacattgatgtgtgaatattctatagattcctctgcccagtatgtagcttcaagtagactatgaactctcctcccttgctggggagcccaggccagacaaccaggctctaggaaagcatttatatgtattaaagatgttcatatgttaaaaaatacaatttgggggggtgtttggaaatatgaaatattttcaccaggggctagctgagagccaggcgaccctgcaggaaccggttcatgggctgcttctgtgtaccctcccctgtgtgcctgctcagcatctgggccccttgacctcctgctctctggaagggtctgtcagtctcgcaggtagcaagcctgtaggatgcaaagcagtcaatctgtggacactgttaaggaccaaatccctagccatagacaccatctgctcccaggaggattggtgtttgtcctgtaggaccgacctctacttctaccccagctatatggggagccagggcagctctggcttctgggttgacctccacttcgggctcttgggctcccactgcttggggtgtgtcatcacctctcagactctcagtggtgtgattacactttgtgagcaagaaggagaaatgtcaaggtggtgccttattgggtacagggctagggaataagacctcaaagtatcccagaaacctaaacatcttcactaccaccaggggaggtcgagtgataagaaagactaatcagtactttctgggttgcttatttcaggagcctaaccttcacctccctactcaattcccttttctattctcaaccttcctgatatccattgctatccccaccttgcttgtcctagttctgatcctctttctagcttcactataaataacaccactaacacgccacacacacacacacacacacacacacacacacacacacacacaaaactagatatattaccataataaaaaagtcactatgttagggatccttaaactttggtttgcttaggggttgcttaatagcaatctggcagtggcctgagccccacccctggacattttgatctgggtctggggtggagtctgaactactctatttttaacaagctatatttttaacaactacccaggtaactgttgactgatgcagctcactgtctgtgacctggatgatcaggctgcagcctgacctccttttaggggtaggtatttttaagctgttttataagcactttgttctagtctctttcctttataggttagaaatacctctgatttgaaccaaggccagttcagtatttggtacagatcttaatacactggtaattttaaataaatacttacactggtaattttttataaatactttttaaatatcagaagtcatttttgcttgaaacaagcctttcaactctgaatctaaatagtcactagtggatgcaaattcatttggaaaggataaacattttttatttgttttcacatacagtactctggtgtctctcaatagacaatcatcaatttacattcatttattcaacactgattaagcagggacattgtattagtccattctcacattgctttaaagaactatctgagactgggtagtttataaagaaaagagatttaattggctcaccattctacagactgtacagaaagcatggcaggggaggcctcaggaaacttacaatcatggaggaaggcaaaggggaagcaagcacgtcttcacgtggccaataaaagagggagtgagcgaagagggaagtgctgtatgtttttaaacaaccagatctcgtgagaactctctcacaagacagcatgagggggatggtgctaaaccattagaaaccagccccatgatccaatcacctcccaccaggccccacctccaatacttgggatcacaattcaacatgagatttggttagggacacacagccaaaccatatcagatataaagatgaataatgactagatgcctttacgagaatttcaggccctgtgtgctctgatcctgacctgcacccccattgtcattttgccatgacaggaactcccagccctgcaccagccacacttagcttcttacaggtccttgaacttgctaagcttcctctcaccactgagtctttgtccatgctaatccctctgcctagaatgttcttccctcctttttctaattcatttctacttatttttcagccttcagctcaaaggacacctcgaggaatatttctctggtctcccagacctaggttaggttgggctcccacatcataagatctcttagtttttatgcctttttttttttttttttttgagagagagtctcgctttgtagccaggctggagtgcagtagcatgatcttggttcactgcaacctccgcctcctgggttcaagtgattgtcctgcctcagcctcctgagtagctgggactacaggtgcacgccaccacaccaagctaatttttgtttttttagtagagacggggtttcatcatgttggccaggatgatctcgatctcttgacctcgtgatccacccacctcggcctcctaaagtgctgggattacaggcgtgagccaccgtgcctggcctatgccttcttttaagaatagttttagccattcttatgtgcctaatgcacagtgggctctctgtatttgctgaatgaatagatgcatgtgaacatgtggatttctgaatcctcaggctgtcacatcctagtgggagaaacagacgtgtgaagtaaccatagtaataggtgctacaatagaggagcagacaagatttgatttgtcagggaaatcaaaacacaaagattgtttgatcagtaccacttgtgaggttgggccagggaagactttatacagaaggtgatgcttcagatgaattttgaagggcaaccagttttccaggcagaggagagggtatttttggctagaaaggaccatgtggtgatgctgcagggtggcctcaagcagttcactgcacctggagggatggggtttaaactcagtggcaggactccacccaatgccatttgggagccagatctctccctggaggggttggattgtgcacccccaaccaaaatgtccaagtcctaactcacagtacctgtgaatgtcactttatttgaaaagaagggtctttgcagatgtaattgagttaagggttctttgaaatgagatcatcctggattaactggatgggcccaaatccaatgacaagtgtccttataagaagaggaaaagacaaagacaatggaagaaagcccgaggaagaccatgtgaaggagaaggcagaggttgggatgatgcagccacaagtcacggatcactgaggattgccaacagccactagaggctagaagagaagcagggaacaaacggtttctccctcagagtctccagacggcactgtgcagagccttgccagctctgctgacaccttgatttttagtcgtctggcttccagaactgtgagaaaataaatttctgttgttttaagccactcagctcgtgataaattgttatggcagccacaggtaactaaaacatatcctcagtgctcagcccagatccagcatggctctgtgaccagcaacccgcaagactagaatccaaagaagggctctcccgagcatgggatgccagaccttcccctttggctgcttaacacagaggaaactgtggctacaataaacagagaggggtctttgtaaacaggcaaccggttggctgcccaaagtggacaaccttttcaggattgagaaatggcagtcttcttgacattttagaaaatcttttcctgggggatttggcttcacttcctgcttggatttgaagcctgcaaatacatttacaaagtcaagcatttccctggtggctcccaggctcttttcagcagggagagggtagtggggtgtcattggtgatgttttctgccaagaacgaaagcaaaatttctcctgttcaccaacctccttgcccaaagcaaatctgaagaaggctcttatgacgcacctttcaaaagaaaaaaaactttttagaaacgtaagatttgtttaatgcttttaattaaccagacatatagttctcttggcaggtttgtggtagggagaataatggctccccaaagacatctctgtcctaatacctgtcctaatatgttaggtcatatggtagaggagaattaatgttgcagatggaattaaatttgccaatcagctgcccttaaaataagattatcgtggattatccaggtgggctagatgaaatcacatgggttttcgtaagacagagggaggtgatatgagaaagatgcttcaaccagacatggttgcctttgaagatgggagggggcatgagccaaggaagcaggcagtctctagaggctggaaaaggcaagataatgggtttatacttagtctgcagaaagaaaagcagccaagccaatgctttgattttagcccagggaagcctatttcagacttctgacctcagaactgtaagataatacattcatgttgttttaagcctctaagtgtgtggtaatcggataggaaactaatataggggagaaggaggagattggagagggaattggtggtagttccttttggtgtttccaatgaggccaccctaatgggaactgttgatgaaatactggcctgagctaccatcagtcgcagaaggagattggtgataacaatctttcaaacacaattccactgccaagaaaactggcaggaccccctcccttccttccctgaagtggaaccagctcagactttctgactatagcaaagccccatggggttcttggttgggtatggccacatcctgactcgtgtccgtggagtacaaggatgcatgggagtctcctctcactgcccaggacagctggctctgcaggagggcactcctgtgccagccacgctgacctaatgaagccttcagcccctacatggtgtctggttcctcctgcaaaggatctttgaggcttccctgtgtctgcttctttctcttctggttcttgcaagctctcccaggcctcatgagacatgctggagcacctgtcactgctgggccacgtgcctgctctgggatgatttggagaagtagttgaacctgcagatatttcaggcatgccctcatgcgtcacttttcccaacagcttttgtcttcatcttctcaaatgtctctcggagcactggctcccagcctcctggcttggaattcatgagaacgatgctgccgaaatctgagcttgtcagcgatggccctgcctgcatggcccagcggcagaaacaggaggagaagagcttgtggaggctgggcagggcccagcagagtcaggagggctgggggtcactgcaactgaacttatgccagcatctctccagtgctatagaaaacccagggctccctgcaatctgttccagaaactccccagtgatctggttaactgtgtgggatccaaatccctgttccacctctcaccagttctgtgaccctgtgccagttgcttagattctctgggcttcatgtaccttcccttgtgtgaaatgataaaatagtaggcagacaataatcattagctataataacaattattatttctattattacctattggatccttcaccttccagagtcatgaatctcaatgttctctcagtgatattctccaaacatcttagaccctcccttcctagtgttctgtgtctatttctaacagttttattgagatatagacatccaatgaactgcatcttaacatgcatggtgtggtatgttttcatgtatgtgtacactctggacaccattactacaatcaagataatgaaaatatccattatgtccccaaattctgttttgtaatctttccttcccactcctccctgcctacacttcctgcccccagtcctcaaacaactactgatttattttctgtcagtatagtttgtattttgtagaattttatgtaaatggaatcatagagtatgtactctgttattgttttctttttcttttgaaacaagttattggtctgtcacacaggctggagggcagtgatgcaatcacagctcactgcagcctcggcctcctgggctcaagcaatcctcccacctcagcctcctgagtaactgggaccacaggcatacaccagcatgcttggctaatttctaaattttttgtagagatgagctgtccctttgttgcccaagctggtcttgaactcctgggctcaagcaatcctcttgcctcagcctcccaaagtgttgagatcacaggtatgagccatcgtgtctggcctattgtctgtcttttatttcattgaacataattatgttgagattcatccacattgttgcatgtatcaatggttcattcatttttatttctgagaacttgtctactgcatggatatatcataatttatgtatgcattcacctgttgatggacatttgggttgtttccagtttttagctagtttgaataaagctgctatggacattcatgtacaagtctttttatgaacatatgctttcattttcttggataaacatataggagtggaacagacaggttatatggtaggtgtaagtttaatgttttaagaaactgccagactgttttccaaagtggtagcatgatttacatttccaccagcagtgtatgaggcttacaatgatggcttcacttcgttgctgatgcttggtatgatcagtctgtttgattttaaacattcaaatgggatgtaatggttataattcgcatttctctgatgattgatgatgttgagaatgttttcttgtgccgtccatatatatcttctttggtgaagtgtctctttaaacccttttacctattttaaaaattgggttgtatgtcttattactgagttttgagagttctttatatattatgtttataagtcctaacagatatgcttctttgaaaatattatctctaagtctgtggcttgtcttttgactctcctaataatgtctatcaaggaatagaagttcttaattttgctgatgtctgatttatcaattttatctttttatggattatactttttgttgcatttaagaaatctttgcctaaatcaactttacaaatatttttctcctggattttattctagaagttttatagttctaagtttacgtttagctttatgatccattttgagtttgttcttgtagatagcgtgaggtgagaattggaggggattttttttttggcctatgaatatttaataagccaaatttgggcatcatttgtttaaaaggttatcatttccacaagtaattgcctttgcgtctttctttaaaatctatcagtctatctgttttgggtctacttcaggactctattttgttccattaatttatttgtctttctttataccaataccatgccttcttgaataccataactttagaagacttgaaatcagtagtgaggcaagagaatagggtctggaggcagggaacctaaggccaattcatgctgacttcccaggactgaatcaaaagaaaaacccccacctctccatatccatgtaacaaaaggatcagaggctattccctttgcaaccccttcacttttctgcattgcagatgaaaaacgaaagtacctctgattggtcccctcctgcaaccaatcagactggtctcaggccaagtcttcatgtgtaactttgtaacttcacgtcagtctctgattagttatcttccacaaccaatcagactggttgcaggccactacttcatttacataggatataaaccaagtaatcaatgggaaacctctagaaggtatttatactccagaaaattctgtaaccagacctcttgatctgcttgctcaagcatgctcctactctgtggagtgtacttttatttcaataaatctgtgttttcctttccttgctttgtttgtgcattttgtccaattcgccaagaactggacagcctccaccagtaacagtagtgtaaatcctcctactttgttcttccttttaaaagttgtttttagctactctaggtcctttttttgacttacatgaatttttgtttttagctactctaggtcctttttttgacttacatgaattttaaaataagcacgccaatttctacaaactgtcctgggcttgtgattgagattgcattgaatctacggatccatttaaggagaattgatatcaatattaaattatccaaaccatgaacatggcatatgtcttcatttaggttatctttaatttctttcacaggtgttttataattttcagtgtacagtccttgcatacctttttttaaaatcagatttactgctaagcattttattaatatttgttgatgctattgagaatggtgtaggtttttaaatttaaattttggattcttcatttctggtataaacagattgatttttctttacttattttgtcctacaacattgttaagtttgtttattctggtaacttttgaagactgcgtaagattttttataaggtaataatgttgtccataaacagagacaattttatctcttcctttttaatctgtatgtctttttttttttcattgccttatttcactggctagaatctccactacgatgttgaacagaagttatgagagtggatatcctaggtttttctgattttaggaggaaagcatccagtctttcaccactaaacatgatgtgcttaggtttttgtagacttttgttgatctcctttattaggttgtgaaacttctattcctagttttctggaagtgttcttttccttaaaaaaaaatcagaaatggatgtaagattctgccaaatgtttttttctgcatctatagagatgaccatattttagtcaatgtattttttttgagacagggtctcactttgtcacccaggctgaagtgcaggggtgcaatcagggctcactgcagcctcgaccttctgggctcaagtgatcctcccaccttagcctcctgagttgctgagaccacaggcacatgccaccatgcccaggtaacttttttattttttgagatagggtcttcctgtattgcccagactggtctcaagctcctgggctcaagtgattctcccacttcagcctctcaaagtgctgggattacagatgcaagccactgcacccaacttattcaataatttttaatgttcaaccaatattacattagtggaataaacccaccttattgtgatatatcattgttttaggctgtttgggctgctataacaaaatactatggactaggtggctaataaacaacagaagtttatctctcacaggtctagaggctgagaagttcaagatcaaggtgccagcagtttcagtatcttgtgagggtccatttcctggttcatacagggtcttcttgctgtatcctcacatggaggaagggtggagggctctatcctcatgacctaatcacctcccaaagaccccacctcttaatgctaccatttcattagttaggacttcaacatatgaatttcggatacaaacattaagaacatagccattttccttttaatatattgccggattcaattttctataattttgtttttgtttttcttttaattgacattttgtttttaattgacattttgctcttaattgacatttactagagatgtagattggtaattatctgttctcacctctgcttttctaatgtctgtctgactggtagcagtgtaataatgccttcatcactgaataaattgggaagtattccctcatctttaatatctagaaaagtttgtgtaggattggaattacttcttttttaagatttgatacaattaatcagtaaagccgtctagacttggaatttgttttgtgcatgtgggaatgtttttaactacaaattaaatttctttaatatatatagggttatctagattaatattctcttacccttttctagaatctcttatttatctctttcatccctaatattggcaatttgtgtcttctgtttttttttttttgtggctatagatttatcaattttattgatcttttcaataaataccgaccttttggttttattaatttttctctattgtttctccgatatcagtttgatttctgtttaccttgggtttaacttgctatttttttcttagttccttaaagtggaggcttagttcaatgacttgagatctttcttttctaacatagacagttaatgttataaatttccctctaagtattgctttaattgtatcccacaaattctgatacattgtgtttttatttttattcagttcaaaatactttctaattccctttgatttttttctttggcttatgggctatttagaagtgtatcatttagtttcccaatatttggaggtttcctagggatatatgttattgatttctaatcttatttcactgtggtgtgagaatatattttgtatgaattgactccttttttttttttttgagactgaatctcactctgttgccgaggctggggtgcagtagcgcgatctcggctcactgcaacctctgcctcccgggtttaagctattctcctgcctcagcctccctagaagctgagactacaggcgtgcaccaccacacgcctggcaatttttgtattttgagtagagatggggtttcaccatgttggccaggctggtctcgaactcctgacctcaagtgatccactcgccttggcctcccaaagtgccgggattacaggtgtgagccactgcactcagccaaattgactccttttaaagttactgagagttattttatagcacagaatatagtctatctctgtaaacattctgtgtgcacttgagaagaaggtacatgctgctgttatgtggaatgttctataaatgtcaattaagttgtcagttgatactgcttttcatgttttctatattctacacattatctttctactcattctatcaatttggacagagtgtcaaaatctccaactataattgtgaatttgtctatccttccaattccatcaatttttgcttcatgtactttgaagttgttattaagtgcataaatgtttagaattttgatatttcttgattaattgacccttttaccaatataaaatgacattagttatccctggaaatatttgttgttctgaaatctacttcatctggtattaacatggtcaccccaggtttcttttgtttagtgttagcaagtttagtgggttgaaaaatgtccctccgaaattcatgtttatctggaatctcagaatgtaacctttttttggaaatagggtctttgcaggtgtaattaaggtaaggatggagatgtgatcatactgaatttagtgggccctaaatccaataagagtgtccttataagagacagaaaaggatatcagagaagcagggagaaggccatgtgaagaatgagggggatattgaagttgtgctgcctctagccaaggagtgccaggagccaccagaagctggaagaggcaaggaagaattcttcttagagcctttagaggaattatggccctgtcaacaccttgatttcaggcttgtggcctccagaactgtgagagaaacaatttatgttcttttcaggcactaagtttgtggtaatttgttaagtcagccctaggaatctaataggacatggtgtatctcttaccattggtattaccattctgtctccagagaggtagaaccgagagagagacaggagcagggaggtgcgggggtgagagagggaggaggagggaaggggaggggaggggagggaaagggagggcaggggaagggaggagaggagagaagagggagagaagagagggagagaagaggagaggagaggggaggggaggggagaggagaggagagaggagaggagagaagagagagagagaagagaggaagagaagaggggaggggaggggaaagcaggggaggggaggggaggagaggagaggaaagggagagaagagaggaagaaaagtggggaggggaggggagcagaggagaggagaggagaggagacgagaggagagcagaggagacgagaggagaggagaagagagatttattaggggaattggctcttatggttacagaggctgagaagtcttacagaagactgtctgcaagctggagaaccagggacgctgttagctcagcctaagtccagaggtctgagggccagaggaaccaacagtgtaactaagtccaaggctgaacgcccaagaacccagggggctgctagtgcaagtcctggggcccaatggttggagagtttggagttctgatatccaagagccggtgaagaagggtgtcaggccccgaagacagagagaaagtgaactcacctttgcctttcctctgctttttaattctatcttggcctcagccgacggaatagtgtgggcccacattgagtgaggatgggtcttcctaacccactccatggattctaatggcagtctcttctggaaacaccctcacagacacacccagaaataatgctttactagccatctgtacatcccttaatccaatcaaattgatacctgaaattaaccatcacatcctccctttccttttaacctatttgtgtctttataattaaaatgagcttcttgttggcagcctatagttgtagcttgctttatttatccaatttgataatttttgcctttttctgggactcttagaccataacatttaatgtgattttttaatatggttagatttgatagagcttttaaactctaataactcgctgttttctgtattctttttcagtcttcttttgaattaattgtgtatttttaattatttctttttatgtccttagtagagttaccagttatccttttcttagggctgcttcaaggtgtatagtacacatttttaataatcacattccaccttcaaatgatattataccatttcatgtaagtgtaataaccttacaacaatatacttccatttttccctcccaaataccttgctatcatttttgctataaagagtcagctggctgggcatggtggctcatgcctgtaatcccagcactttgggacaccgagatgggtggatcacctgaggtcaggagttcgagaccagcctggctaacatggcgaaaccctgtctctgctaaaaatacaaaaattaggtgcctgtaatctcagctacctgggaggctgaggcaggagaatcgcttgaacctgggagacggatgttgcagtgaactgagatcacaccacagcactccagcctgggggacaagagcaaaaatccatctcaaaaaaaaaaaaaaaagagtcagctgtgctttaaagagattaaacaagataaacagtctatttagacgcatagttatatcctctccagtgctcttcattcctttgggtagggacacatttgtatctggtatcattttccttctgcctgaagcacttgctttaacgtatctgtagcctgcttgtgataaattcgttcagcatttatatgattttaaaagtcttcatttcatcttcacttttgaaatatatttttgctgggtataaaagtctaggttaacttttttttctgtatttttaaaatgtggtttcactcttatggcttacattgtttttgattagtctcctgccatgtttatctttgttcctctgtacataggggtattttactccagatactttaaagatttcctctttctcacaggttttaagcaactgcttataatatatggtgtagttttcttcatgtttcttgtgcttgagtttgttgagcttcttgaatatgtgattatatagttttcatcaagtttggaaaatttccagccattttttttctactttttttttttcttgtcttctcctcctttgggagcttcaactgcctgtgtattgggcttcttgaagttgtcccacagctcactaatgctttgtctgtttttcagtctttttttctctcagtattttattttagatagtttctattgttatatcttcaaattcagtattcttttctctgtggtgttgaattctatccagtttatgtttcgtctcatacattgtagtttttcatctctagacattgctttttttttttttgttttctatctgccacgtctctactaaacatgcccaaactttcttttcctctggcttcttgaacacatggaatgcagttataataacttttaattcccccatctattaattgtatcacctgtgtcatttctgcatcagtttcaatttattgattttctccttattatgcatcttattagccaacttgttttcatatttaattttttattagacatcagacgttgtgaatctgacttgttgggtactgaatatatatattttttattcttataagatccttgagatttattctgggattcagttaagttacttggaaacagtttgacctttttaggtattgcttttaagctttgtttgaaccagaaaagaatttattctaggactaattttgcccccacaaattaggtaaaatccttttgggtctcttacccaatgcctcataaatcttgaggttttccaatctggctgttgaaagcaagaaccatttgcagccttgtgtgatctccaggaatttcccccctaatctttattctttccctggtcttgggttgtttcctcacttatgtgaactgatgagaagtagctgaagactcaaagaggactctctatagattgctggagctttctgcctgtgtagccttttatttttcattctctggtgtgtgaattctagttgtcttggcaccccacctccatctccccatctcaaggggacttctgggttctgcctgggttcccccttcttgcaacgtggcctggcagataggtggggcaattgtgggactcctataatttgtttcccatctcctaaggatcactgttcttccagtatccagtatcttgaaaactgctgtttaatttattttgtctggaatttccttagttgtttcaggtcagaaagtagctggcaacagaagttgtacccttgcctccctctgtatccattctcccatatcctcctatgcccctcaagccctgctactgccaagaaatgtcatttatttagagcctttctatatttcagcagcaggtaatatgggcagcgactggttatatgtccctggagtcatatatactggggttcagatctcagctctgccagttcctgtgtagccttggccaaattacttcatcagcttgagcctcagtttccttatttgaaaaagagaaaatgatacctagctatagggctgttgtgagggttaaatgaggtaatgcatagaaggtaagtagcactacacgatggcatccataatataattcaatgagtacaagcaggatgagttttttaaactgcctcaaatttctccattgtctgctcctgcctctgttccaggggacaatcccaccattcctcttaagctcctggaaaggggcgtatgaccggccctaaatttcttgcaccaacagaggggagcagtcatgtggagaacttccaataacacatgcagcacatcatggacatttggccgcacgaagcattataatgatcttttctttgcggcagattgactttactaattaggttgggttcgaaccaatgttaaatacagtttgcatgtacagaacgcaaaccaactggcagcaacagggaactcagaaacatttcaggtaacaggacaagccagctatgattaaaactttgcttcagataatcctttctctctcccttggcctccatttttatgagctcagtaaatattgaagatattaaccctttatcatatttgctacaaatacactttccccaagtgttgttcaattctgttttgaaattcaaatctgtctcaaacagaattttaaaatctgtgtgtagttagactatggatcttcccttttctaatttactctactgctttcaggcctaggaaaaccccttccaatgactgaataaacatccacctttattttctgttttcaacattttatttcttatcctaactagaatttattttgattttaatatgtggtataaggtgcaaaggtgttggtatttgagataattaatgccagctgctacaatggccaaaccctgaaatctaatgccttaacacagcaaagccttaggtttcactcacattaagcccagtgatgtttggatggcattccttgtttggtgctcttccaggcagtgactcagggacccaggctgcttctacctgcaactctaccatcttaaagtcttttgtttccagctggggggatcccatagaatatttgataagcactatctgtctctgccgcaagacttaactggatttttcaaaataactaatcaacaattacatgacccggaggcatttactaatcacatattaagttgttatatgtgtactatggtctgactgcttatcttgttctatcaggcactgtaccactttttttctttcaaactagttttatatatgtcttcacatccggtggggtgagctcttctctcattatttttctttatcaaaatgttcttggctattacatcatagatcatattacatattgcacatgatctcttagcatatgagactgcactcactgcccagaagctcagctaacatctcagttagaggatgtcaaaatccatgtatccatcttctaccccttttccaaactccaggcccacatttccaggcacctgatttgtagttggaaatacctggaaatttggccaggtctggtgggagctagagtacacagcagccaatggctgattttttttaagtcagaagtagacataaatcagaaggaaaagagccgatgctttaaaatatttccccatctccattgaaaagctcaggaaataataaggcgtgataattctgggatccccttactcaggagggcctaccgcatttgagaaaccttgagcaagtcgtttcagtccttcatgagtctacactctcctcactgtggctgagttgaggggggaggaagagaaaaagcacagtaagtggctggtggtagtagctcagagcaacggttcagaggttggccccagatgccagcagaggtctttaagatttgagtacccttgcacaatatgcagtgaaggacagatgtcaccaaaacaagaataatagtaactactcccagtttttgagcaccgactctgggctggtcatctttgaacataaactcattagaccctcacgactaccctgcaagctaagcaatgttacctctagtatacagatgaggaagcttaggttcagaaatgtcaagtctcttacccaaagccacagagctaatgaggaggaaaaccaggatttaaacctgggtcagctgactccaaagcctgtgccccatctactcagctatgctgtatctgccaactttcaaaatagtagggagatctggaatgttgaatagctcatgaacataattaaaactggccttgaacattttttgcagttgtgtgggaggggtgatggtccgtgttaactgtgcagtggagggagaatttacaatactctccctggatcatgctgaagaggagtaatgtgggtggtgaactgggaaccagttgtccagaacaaccatactgagtttctggacactagacagttgcttattttgctctttgcctcaacagatagaccggctattaaggaagaaagccatcttctataacatacaacacaatggaactgtttaagaaattgggatgggtgcattgactcgtgcctgtaatcttactttgggaggccaatgcgggtggatcgcttgagcccagaagtttgagaccagcctgggcaacatggtgaaactctatctctacaaaaaataaaaaaaaattagtcaggtttggtagtggcatgggctgaggtgggaggactgcttgagcctgggaggttgaggctgcagtgagccatgactgcaccattgcactccagcctgagtgacagagcgaaaccctatctccccactgcccctcgcaaaaaaaggaagaaatcttaatgaaacttgaactgaacttgggctagaagaaacccgaagtgtgaagcaggactaagaccaattgctcttagtctcctaaaggccaaataagaagcaaaaagcttttatatgtatcaaaagaaattatctgtcttctgaggagacccttctttcatggcattcaaacttcggagtattaggcttttaaatgcagaaaagcagtagtcctaattaggcatcacatgattctgaccaatttgaattaggaagcagaaagaagctcgattgatagaggatattattgcaagagaaatgcttgggagacagtgtggagtgaatctaggcctggcctgccccctctgctgccctttggcatcaacctatgtcactcacatagttaaggagagtctcagacaaaggaaatactctaccatgattgggatttgctgagcacaagtctatttccacagtgtttcaggcacaagaaacaattatgcattttgctagagtgcctgttgccttaatgattacatccatgtgtattttaggagaacgtctgtcttctgcttcttattcatttacactttacacttcaaaagattgttttgtaggagctactcaatgcacaagaagtctcatgagtttttcttctaaatgagccagcaactttccaagaatcaggaagctgaaagttgccaagaataaataaatgaactccagaaggttcaagtttggtttaaaaactctgtaaggtttaaagtaggttctatatctggcttaactccatgtcctcatctaagacataaaccacaggagggaatactcctcctggcatgtaactttttcccaagcattccatctaatagtcatttccaataatgattgattggaaaatcttagcaaagtagtcctaatgcaatgctataagcagaaatagaggtatggtggaatagctcttgcctgacagttaggcagcctctgcctcggttctgccacaaaattttctggacaaggtaaagcgtgtctctctgtgcctcggtttcttcatctatgaaatggagaaacaacactagatggtgtctaaaattcggtggtaacaattccaaatgaacccttgtctagtccatggaagcagggagtctgggacttcagtattattgatcaagattggaattagttggttgtgttcatgtccaactatgaagattaaaaaaaaaatgagtaagctggtgacagacatgtcaaaagaaaatatgtgtgattgagaaaaagtaaggaggtacaatagatattgttggtgtctcacctagacaccctttaccgagccagtgctcccatctctgagctgctgtgggtgttggctgctaattgcacacatctgtacccttccctggaggctggaggtgtgggaggttacaagacccctcttaccctactctggaggcattgtggccaatagctgataggtgtgtggggggggtgtctaccagcccagccctgttgcctctgggcaggatgaccttgatggtgcactttgtgctccagggcaccccaggggatcaagctgtggctggatttcccctgacattctcactgagctccttcccctaccttctcctgctcctctcactcccctatgggtttctcctgagagcactccctcaaaacatcacttgcctaagaatctccatctctgactctgcttctagggacctgacccataatgaggggaggaagaaagtgagccaagccagtaacccatttgtgttatgagaaacctcctgggctcgtatgtcctgagcctggcacagagcaggtaatgatggagactgcagggttgcaggacatgagacagccatgcacacagagttttgtggtctgggtaggaatttcatgtctccatccattcagcagccattcactgagaatgagtaccgtgatgggtctgggtctgcaagcagcttggctcagtcaatttggttgatgctgtaacttgaccaagctgggctttgctgctgctgaggcctcagaagcaggccgagaaagggaggggacaggcattgtagcagggtgtggatggcatacattcttcccaggggatgtctgaatacagtactagggaatttgagaaggaggaatgatgacattcatctggaagagcacagaagacttcccgaaggagatagcatttcttccgggtctgacggatgtgcctgacttaaaaatgtggaaacatgccgggcagagcattctaggtggaaaaagagtctgagctaaatggacgtgctcttctctccagtcttctcctgtcttcctttcacctgcttcaaggtgggactgtgatcttcccccacctttctgatggtgggccttagagccttaggaccttgtccagggagggtcccaccctatacactgggggaagggacactgacatcatgaagcttccataaaatctcaaggggactggggtcagagagcttctagatagctgaacacgtggaggctcctggagggtggtgcccagggagggcatggaagctccgcgccccctcccccatacctcaccctacacatctcctcctttgtaatatcctttataacaaatcagcaaatgtgagtgttgccctgagttccatgagccgctccagcaaattaattgaacctaaagaggggatcatggagaccccaacttgaagccaggtgatcagaagttccagaagcctagactggcgactggtgtctgcggatattaggggcagtcttgggcactgagcccccagcttgtgggatctgacacactctccaggtggatagcatcagtaattgaattggaggacacccagctggcgtccactggttggtgtgtgtgtgggaaacttttggtcacagaagccttctatgtaggtgactgttgccacggtggtgtgagagcagagaaagaagcagtgtgaagagagtgttccctacacagataccaaagtaaaatttcaactttggttatgattcacaggtttgagactccatatgggaactgaaactaagatcccctgggacttggagccccaggatctgttttcctcctggcggaagctataagtcccctgtgagctctctcaagcacttcccaagatgcacgccctctgctatcaccccgtgtgatggcatagatgacagtaggggactcatcagggagggctccagatctcgggcctcacggggaaaccagggctatgctaagtgatggggagagattatgaaagctcccagaagataaggccccctcctgagcaagggcgggagagaataccatgggcctgaaagtcagggtgttctcaggggagacagagagctgagacggcagctggtgggaggcatgagcagatggtgtgcctcgctgccggagacagcactgcgatcgagacaaagacgcgtcctggagagaggaggatgcctcactggcccttctgcaggagtccttggccaagctgggaagagagccttctggcaggaagtgggatgaaaaaaaagggatactggctttctctagttttcatccttagtagagtcaggaagcaaagagagggatggagagtgtcaagaattgcaattgcttcatgccaaggtcaagaagggtgcctgttgcaccagaacccctcaggttgtcttgcaggagaggtgggagtgaagggaatgaatgacgagggccaacctgagctgggaaggcgaggggactggacgaagattaaggccagtgggctgaatggttaggaggcttatgtcagcatatcttccaatgtgtggagttacgccctcaggacttaagatgcttttctgaagacaatattacacaatttttacatagcaaatctttttctttgtgatttctcttaatattcctaagttttgaaaaccactcccttcaagaggtttgattcgtatttgattttatgttctcctagttcactaaaatttgtaaaattaattctctaaaatcactggaattaattttggtgcatagagtgaggtgaggacctcactttaaaataatctgtaactctcttattgataaaaaagaaaatgatttatcataatagcagtaattaggaaaatatggaaacactgaaagaagaaaaaaacatcatgttctcaccacccagaaataatcataatcatttttatacattatcttttctgtctgtagttttacatgattttgatcatataatacatgtaaaattataaggctgattttaaaaattgcatccatattgataaatgtaatatatgcttattagagaaagtttggaaaatacataaatttatgaagcagaaaatgaaattcagttgtatatattttcttaaatataatttttgtagctatacttgagtgtttttcaaatcactgagaccatacagtatatgctgaactttaagcattgtgagtacatattaacagattccagatggaaaaaaacatgaagcaggacatggaaatttactatctatctatctaatctataactgatctctatctgtatctatgacatctgtggtttattagcctttcccaaataacctattcaatactcagtttgctcaatgtgattttttttcaaatgcttctgtaatattttatttcttaaggtttataagtttcttaataatacaagaaaaactgtttcttggattattactctttttttagtattattacttttgtaattaacattttggagttattaaaatgtgtgtagtttctttcaaacttttaatctgacaataatttctaacttataaaaaataaaaatagaataaggaacactcatatatcttaatttatttattgataacatcttaaactcatttgctttattgtgtttttctctctctctctctctctctctcagaatatttttctgggaaacctttgaaggtaagttatagatcatggtcatttacccctaaatactttggtatttccaaagaatggagatattttctcacataaccatggtacagttatcaatttcatacatttatgacttgcattgatacaataattttatttaatctactgtccatattccagttttgtcggttgctctgataatgtctgtaatggcatctctctccttcagcacagaatctagtctagggtcaagtattgtgattagttgtcataatttggaacattttcacagctttttttgacttttatgacaatgacttttctttcgagaatgcagtccctcccacctacatttttaactaggatgttactcatttatgtaaatgtttcattttgattaaattatggctatgtcttcatggccagaatactgtattggagatcctgtgtccttttcagggtgtcacatttggaagcacataatgttcactgatccctcatagctgtgcttaattttgatcatcctgtcaaggtgtcatcctatttctcccactatagaattagtttcctttttttcttcattgcaactaataagtggcctgtagatagacactttaagaccatagaaatattctgtttctcatcaaaatttcctctagaattagtatctactgatgatccttgactgatccaatctttagcatgatgattacaaagtgatggttttctaactccagcactccttccacattcactggtggacttctggccttcttcaagagacctcccttctctcccatttatgtgtttactatttgttatttatcattttcagtataggctaattattatttttttcacaacaacctgtttataacacattattgtatttaagtattttggtgttcagggtgtcccagagatggccagagggagccccttcaagctggctcatgtccttgtgaactgcttccagcattcctcgagcactttgttactttctggcacaacgatctgctctaggcttatcttgtacccatcctgtcctagccctggaatcagccatttctccaaggagctaggtatcacatgctgggttttcagaggtctgcaagacttgttacaaaaattacagtcattacgctttcccttaatttcttgcttctctggagcaaccacattcaactctttagctgattccattttcctctaaattattaaataacatgcttctactgctacttcaagattttttcacaagcacgcatattttccatctccttatgctctcaattcatttacttcataaatttggttacattaatattcaatatttataatattttgatgatgtaagcattattcatagctgaactatgagtgtcctataattaaggctacttttcctttcctgaataaggttttatttgccctggaatgacctgtcttaatttttctatttgcttagtttttttgtgcattattatcaccaactcaagcccaaattctcagttgcttccccaaatctgctcacggtatctccagatgcatcagcaatttattcaagttcattttcttgaagtacctgcccctgtagccctctgacctgctctagtttgagctggctgtgatacagatgttatctcgggttcttcctcaccatcatctggggagttccctcatttccttcctagatactccagtctctgattcccactttttttttttgaggcaggtctccctctgtcacccaggctagagtgcagtggcacaatctcagctcactgcaacctctacctcctgggctcaagtgatcctccctcctcagcctcctgagtggatggaactacagtacaggcacatgccaccaggcccggctaatttttgaattttttgtagcgatggggtttccccatgttgcccaggctgaccttgaactcctgagctcaaggaatccacccacgtcagcctccaaagtgctgggattataggcgtgagccactgcacccagcccccatctctttctacatttaatcttttgttttgatgaatcacaatctctagtagtttcctaactactaatattctaaaaagaatacataagaagtacatttttgagaccctccatgtctaaaaattcattataccctcatcaataatcgactatttggctagattttaaattctacatcagttagaattctccctcagaatttttgaaagagtccctgtcttctagcttctaatgctgtaaccaagaagcctaaagcaattctggtttttgactattccccctttctagaagcctttcctttttgtctttagtttctgaaattttgtcacgaggtgatttagtctgttttcatccactagatattcaatgggctccttcaatctggaaatgcttagcctccagttctggaaaattttcttgaattatttctttgatgatttttttcctctctgttttctttcttttctctttgtggaactcctataatttgcatcttggacctaaattgggccctaattttattttctattttcatccctttagttttctccttctactttctggaagattttcctataattttccaattttcctttttcagtttaaaaagtttttactattgtagttttaatttacaaaagttcttttttgttctctgaataatcttttcctatagcaacctttcttgttttgtagatgtatcatttttgaagaagatatctctgaagattaatggtgagattttattttttaatgttttcttatccataaaaggtctgttttcttcatcttgcctcttctatgtgttttccctaggcctctgccttccatattacatgctttccttcaatgttcagtgatccttggctgtctcatgaattatttttcagtcaacctcactgagatataatttgtattttcattccattggtataatttacatacaacaaatgttctaattttaatgtaaagttcaatacattttgacatgtattggcaggtatgtgacatacattggcaggcatgtgaaaaataaaatgtgacccccaccacaatgaaaacatgaaacacttccattacccttggggcccctttacagtccccctcccactgcccccacctccagccccagggaccactgatttgctttatgccattatatattactttagctgactctagaatttcatgggaaagtagtatatctaatgtttttgaaattcaatcatgtatgaatctgtggtttactttcctttttattctattctattaattaattctattatattaatataccacaatttgtttattcattcatttattggtggacatttggcttgctttcagtttggagcacaaagctgttatgaacattcatgtacaactctttatatggaaaaacatttctatttctcttggctaaataccaagttttgaaattactgttttatggcaagggtattcataactttataagaaactgtcaaactattttcccaagtggttataccacttttacactctcatcagcaacatgagcattcttttttttttctctcatttggcaacagtttattcagaggtatgtaaggtagaaatcaaagctggatggcaaggcactgttgggagctcctctcccatgggagtagttcttggagcagccatgcagcagccacaccacttcccaggcttctcaaatgatgtttcaggtgtgaagcaacaagatccacatcaggcaggtgtaagaatcaccctggcctagaagctccatgcaccacagtagccaatatcttacaataacttcatagacacagctttcagggtccctatggaggcatatggagttacaggagtcaccacactcaggggaaccaaaagctatgatgtcccaatcagatatgatgtcccaaatgattgtcccaatcatttatggttatcctgagtccagatgcaatttatccaataggagttatttctaccaaaagtaatgttgcctagagacattgttgacattttacctttatcaagttattagaggaacagagaaaggaaggtaagtgaaggtctgtaaatgacgagttaatgggtgcagcacaccaacatggcgcatgtatacatatgtaacaaacctgcacgttgtccacatgtaccctagaacttaaaagtataatcaaaaaattaaaaaaagcaatgtgagcattctaattgctctgaattttcatcaacagttggtattgtgagttttttaattttagacattctagagggtgtgtattgttacattatggttctgatatgcatttccttgataattaatgatgttgttttttcatatactgtctacctaaaggagtagggcactgaaaagctggttagacattcaggccagtggaaaagtcttgtcaactgagggtttcacaatatagtggtcctcctgggtcattttgcagagaatcctgttattaatttcttagtttttctttttctcttagagactagttagagtcccatagaagtttctcccagtttccttctggaagtgtgtatatggtttctagaattctgaaatccaggtgtgagaagaaagctagatgcatcagcttccattatctcatccttgccttcaattgtgtctggtattttttagcctagagaacttgttttgtactctccagagaataaccctacagttttctacagagtgagggagagactgctccctagctgagctgagtggatgagggtatctgggggatatgtgcttctttaacagactttcacccacttttctcttttcagatcaacttttactcctacttcccaaggtatctggtgctgtctgtatctgagcctttgggcattggataatgtaaattgactagtttctcagctattcagcttccttgattgtgaaaaaggttgctatgtcactatgtgcggctccactgttgtaaagggaaagataaaagtctttagtgattctcccagcatagaataccaacaacataaaggatgtgacctctgttagtaagaactggaccagaagagaattgtgattgctcaagagccatcaaatagggcaagaaaaatggcaaacagagttctcacatggcagagcttgaagaaaacagcagaaaaccaagggaaggactttggggtctggctttgccctcagggtactgaagaccactgaatacatgcagttcaaccgaatttgggatctaatttaagaagacttgccaatccgttgatatcattacttccacttaaatcaatatatttttttggagtagttttaggtttacaaaaataaaaatgagaggaaagtaaagagagatctcctcactcatatatatccctttattcccaccccaatttcttgtattatgaacatcttgcattagtgtgatacatttgttacagttgatgagccaatagtgatacattattattaactaaagtccatagtttactttagggttccttcttgatgttgcacattctacggactttgacaaatgcataacaaccatgtatctgccttaaatattccctgtgtagcacctattcatgcttctctccctccctcttcctaatctcctggcagccattgtctccatagtttcaccttttccagaatgtcatatagctggaatcagtcagtatgtagcctttttagattggtttctttcacttagtaatatgcatttaacattcctgtgggtcttttcatggcttgatagctcatttcattttagtactgaataatactctattgtctggatgtcccagtttatttatccatgcacctactgaaggacatcttggttgcttcgcagttatgagtaaaggcactataaacatttgtatgctttgtggggacataagctttcaactcactcaggtaaagaacaaagagtgcaattgctggtttatgtatagttttgtaagaagccgccaaactatcttcttcccccatttgtttttgagttcttggtttggtttgtcttgaagtctgcaggagcacatctacgggtaatttttaaaagaaggatatataagaaggcgatgttgatggtatattttctaaaaatatctttccatggcctttatccatagaagtcacggtggccacgcttaaccatgttgtgtcacaaagctttcctctcaaatatttgtagctattactgtcatgttctctggcatttaatgttgttgagtctgaggtcaatctaattttgtccctgtagataactgattttgtgtgcctatatccttaaaggaatctttgttagtagaattcaagagtgttatcaggatgtgcccagatgctgattctctgtgttaccttttgaatgtaggaaaattttccaatatgcaggcttaggacattttaccacttagggaaatctttttagtgggtcttcaattattgcttatttcaaatgttctgattgttgccttgaaaacatctaatttacttaaggcagattcctaatatatatatatatgaaatatttataaataatgtatattataaatatatgtttctaatatatatttgtaaatatatattcctaatctatatacatatatattatatatgtgagactctcatatatatatttatatatatagtgagactctcctatatatataatatattatatatgtatatagattaggaatatatatttacaaacatacgtctcactatatatatatatatatatgtatatagtggactacaggcacccgccaccacacccggttaattttttttttttttttttttttttttgtatttttagtagagatgggttttcaccatgttggccaggctggtctcaaactcctgacctcaaatgacccacctgccttagcatcccaaagtgctgggattacaggtgttagccagtgcgctcagccagattcctaatttttaaaatcctccttgtgtatctttatcattttcatgactttctttttctcttttaaaaagtttctcagattttttttcgtccttgacatcactatttgggtttctgagggtcaattctcttttttactgtctccaatttgaatttgcacacaggtcattgcatttcttaaaaattttagtgcttcctttggatatgactttctgctcaagctttagagagcagaaatgggatgtcttcttgcatgccttaattaaggatgccaagtgattttctattttttttgatttatttttattaaaatactgacttttatttcacatgtatatttttgtctccccaccatttctatgtctgaccactgctactactatgtcctatcataacattccatacatacttaaaaccaagcaaagggtggattttcatctttaaaaactaaacaggcattttggacaacacattcttggcaatggaacctggacaacatttatcaaacatggtagggaaagttctcactctgcattataaaaagtacagccagatagcaactgttagagaaatgaagtaagatggaaaatttttaacaaattgttcaaacgattttcttaaagagacttcctccactgccagagatcttgaatagcctcctggtcattcatccagagacaattctttacataattgacgaacttggcttccattttgggaaacaaaccagctttttctatacttgtttgcatttttgctttaatgtcttctacagaactaggcccttttggtgttttaggaggtttttttttttcctgtttcttgaaggtttcttgtccttttgatcttggtgttgacggttttgagtcttttccattctgatttgacttctgtgcattttcggctggagcatctttatagatttcttcaccggtgctttttcttcaatatcctcatcatcaaaatcttcttcttccttcttctccttctccttcttattcttcttcatcagcggcaagttttacttgtttctgtggaaccttgctaccacctccaggggcatcactttccagatatacttaagagtttcacatcctccttctcttcgtcttctgattctgcagcttcctccacagctactaagtgctgtccactaatatgcactggccccgaaccaagcttcaaccataagaccactggtggtgttatttcaaagtccccaagggaaaccgttgactgtacagacattttcaaagttgtcagtcttactttaattggactgtcttcataattcattgtttctgcttcaacaatgtgcagttcatcctttgcaccagctcctaaactgactgttcctaaagataactggtctcattttcatcattatccaccttaaagtgatcatctttgttggcctttagttcgcaaccaaaaagatagctctggggcctcagggggctcatgtccatgtccatcgaatcttccttgggatggtggcacacccttaggtgggagagaaggtggatggagataaatgactactgctccagagaacagccatgcaggatggaatcacaccagggatttttttcctgatttctatggtgaataatattctgctaatcttatgtttttataagttctacaaaggccctactctacaacccatttggtttcagttgacagcaggtgaacttgcacagctcagcccatggctagctgaatctcataaggtacagtccctgggtcttctatgatggagcacaccaaaaatttcaatccccaacatgcattgttaccaggactcctcctatctcagactctgcctgcagtgttctgtgggagcagtgtgttgcaagaggaaagcaccttcaccagcatctttcttcccctccgtcctgttctggtgttttctagaaattggaatggcatgtgaaatggtaatcactagtgcctggctctcatgctcactgaccacgcttctcccattgataagtctcctagactagaatacaagatgatatttttaaaatgtctttaatgatacattttatttctttaaaatatatttgttgagcacttcctttatgtagggtcctgttgtaggcaataaaaatagagcagtgagcaagaaaggcatggccctgccctcagggagcttccatcctgggtttggttgaggatgaataggaaacaactgacaacataatgaatgactgtaggtacagttgtgattaggggttcagagaaaacatccagaccaaggagcagtggtgttggtggtggttcccgcatagctttccctgaataattggtgttcgagttgagctctaaaagatcagaatgaataaacaagaagagaaggagagttaggatgtttcaggcatagatcatataccaagagcctgaggcaggaggacatggtgggtttgagggcattgtagaaagtcgatgtgtctggagcttggaggggagaaacaagaagaggtaaagtcgtgttcattgttgcaaccccagtgcttgggtggagtagggggctctataaatgtttgtgtctgatgagtggaagatggtagttgtagctaatctgtaaggaagttcctgatggtgggtgttgggctgccctcagctctttcttgtccttacatttctaccagtaattagagtgacaatgcagaagccatgcccagtcggccaggagatgaggacatgggtcagagtcagagaagggctaaaaggacaagcagcatgtggctgaggccaaaagggaaaggaaaccacatggatttgaagcagcttggaaaggtttgagatgggatagctttggaggcaggtcttgaggagtggaggaggaggaatcttaacaagtagcagcgaaagaggcaaggagtaggagaatagaacaaggtgaacaaaagccccaagaagagacactgcgggtgtggtggtccctctgggctgcaggaccagatgtgtgcattgtggggaggctggatgctgagatagacgaggcagcatctcagctgcactcggtcaggaagaatgtgtccccagaatagatgtgcccccttcttagagcccatcaggataaagcctgggtcagccttactctgtgcacctgcttttcacattcaagcactgagtgaaaagtacctgcatatgtctttgggtggtgaagaaaaatggccaaaactgggaagccccaaatcttcaaatgcagactttgcctcccactgcttctcagtgaacttgagaatttgccccatctcatcactcagatctcatcagctctgagacctagtaaaaactctcctccccaagtcctagagaaccagaacaaaggaaaagaggacagactccagccctgactgcaaaccattagttttgataaacatctgtgttggtggcgccagggctattcattcaaccaacatttcctgtgtgccttctccatgccatgcacacaggctggcatcaggcggtgcagctatctcttttgcactgagaactgtcataaacaacaccatttaggacaagagacatccaagggagcagtctctgaggaagtggcttggcttctctgagcaccctgaagtcttgggcattcattcactcttagagggagagaatggctgggaactggggaagtgaggcttcctcagagactaagcagccacgaggctgcagctcccctggaacaggcagacttgcacaaactccagtgaattagaagtgtaaattgaggagttcgacttggcttgcacagtacaataaagatctgcaaacactcagctccgtattgaacctgaggcagggtgattaattcattattcgcttcccagcttggaagcaaaagcttgtatacccaggggccagcatggatcagcagagtcataaatcacgccacttacaagtctagcaatgagaaaatccactggctggaggggggatgctcttcaggcagcaacagcggccagaggaccggccagtcaaggcgggccagtctgctctctggagacagaccgattggccaggcatttcgccttccagccaagacggccagcctctcggccacccggcttggcgtttcctggccagaccacaaggaaataaactccactccacccaagaggaatgctcctgtgacctgaaatggcctctctcaaatgtagacaaagtactaggaatagcatcagtatctctccaaaaggctgctattgtccaattgggataaaccactctccaccccgctccttgggctgttctgggttccaagtccttctgccccagccagagggccagcctggtgtctgctcagcatcctccaatccaggtccctggatatcatcggctgccaaccctgagccagggcctttgccctccaatctctgctagcttcaggacaggacgctttggggatccgaatttcattgagagttgaaaggtaacagccagcaaagggctctttagcccctattcgaatacaaggtagctctttaaatatttgataattctttctcttccaagtaaaacaccctaggtttcctcaattattcctcatatttcaagatttctaaagccccttcaatggccaggaagtccttccattttgatattgactatttcccactttacatttcctcttaattctccaaaatctcggaaagggacccagcacttcctgtgtgttcttgttcttgtcatgagagaacaataacattaagacttattatgtgccaggcactttatacttatcatctcatttaaactttcatgatgagctggtgaagtaatttttaactccagtttacagaggaggaaactgaggcttaaagaggtaaaacggcttgccaggattgaatctttggtcagcctgacgccagagattgtgcttctaaagaaccttatgatatgctgtctcctttacccacagcctgacaccctgacatctgattcagggcctgccacacctggtaaccactttccctggagccaggctgagctttgagagactggccaaagctcttttctttctttttaaaaaaatttttatttggccgagtgcagtggctcacgactgtaatcccagcactttgggaggccaatgcaggaggatcacctgaggtcagaagttcgagaccagcctggccaacatggtgaaactccatctctactaaaatacaaaaattagccaggtgtggtagtgtgtgcctgtagtcccagctacttgggaggcagaggcaggagaattgcttgagcccgggaggtggaggttgcagtgagctgagattgcatcactgcactccagcctgggtgacagagtaagtctctgtctccccccaccaaaaaaaaattattttgaaacagggactcgctgtgtcacccaggctggagtgcagtggcgtgatctcggctcactgctcactgaagcctcaacctgctgaactcaggtgatcctcccatctcagtctcccaagaagctgggaccacaggcacatgccactatgtctggctaatttattgttatattttgtagagatggggtctccctctgttgtctaggctaagccatgtaattgctatccaattcagcatcaaaaaaaataataaactaaggtaaaaaatcaataacagcattgttcatactgttttccacccactacctgatctgagcatcccttcaaataaagacagaagtccttatttctctcattcttcttgccagaacagtcatatggcccatgatgcagtctctttacaacttctttttgccttatttgatacacagaggagcagcgttctccctaatctatttatggagcaaaagaacaagaaaagaggattctggccgggcatggtggctcacacctgtaatcccagcatttgggaggctgaggcaggcagatcacttgaggtcaggagttcgagaccagcctggccaacatggtgaaaccccgtctctactaaaaatacaaaattagctgggtgtggtggcgtgcacctgtagtcccagctactcgggaggctgaggcaggagaatcacttgaactgggaggcagaggttgcaatgagccgagatcatgccattttgctccagcctgggcaaaaagagtgaaactgtctcagaaaaaaaaaaaaaaaaaaaaaaagaaagaaagaaagaaagaaaagaggattccttaataagagggtctctaaccaagggattactgaattatgctcattctgctcagtgtcaccagacagattccttacaaaaaagagcactatgactcagcctaccttgctcaagaacaataattgtatctattaacaccttcccatcttccaagaaggaagaaaatattacatggctagaactgtgggaccaggttcctgttggagattttaccaggcccacaacaacactatgcatgtattaataaaacctcaagtgaatattcacagagaaatattcggattttacttacatgtgcgttgcatctggcatgctggttaaggcaggaggacttaggggaatgggctgttccttatacaatgttccatcgtcctggaagaaggtgggtaatctgaatggacagccaggtgagccctgtagagcctgcttcctggccacaccaagccaacctgagagatgatgcaaaagtttcaacctctacaatactctggcaacctcagggaatttatggttattcaaagcatgcccagtaggttaggattgatccaaatgaatgagactatggaagcaggatgctagctggtgcctgccaaccatccatcaggatcaacactggctgtggcgggggctgagagcccatggaggccatggagactgaggaaagtctagaaaaatttacatgtggctgaagcccagctgcaaatatccacaattacctgaactcaggacgctgtgttctgaagttttgtgtgttttagtttcattgcccagcataaatttacctattagatgttatgaaacttaaactgtaatggagctgaatgtgctctgagagatttatctcacttctgctgttcaaatgacatctgctcactaaataagtctcgacctgaacatgtggctaattttctctaaaaatctgcattttccaaaaaagtttttaaaaactgaattaaatagcaaactagaggtaaaaatactaaagcttcgtgtgttttttaatgaaaacatatgaaatataaaaatttaaaaacagtaatttagtgttaatttacatatagtaaaatgcacaaatcttaagagtagagctccgtgactttttgtgttatgtatgactttttgcatagtggccacttcccagatgaacagatagaatatttccatattccagaaaactccttcatactctttcccagtgcctctccaccaccaggtaagaactgtaccgattctttcaccacacttcaatttgtgcctgtccttgaacttcatataaatggaattgtacttatcaatttcctggcagcttttgctcaatgtaatgttttggagattaatccatgttgctgaagatatcagtagttaatttctttctattgctgagtagcaatccattgtatgaatatagctgaatttgtttatccatttacctgttgatggacatttgttttctttccagtgtttgattattaagaataaaactgaggctgggcacagtggctcatgcctgtaatcccaatactttgggaggcagaggcaagaggatcactggaggccaggagtttgacacaagcctgggcaacatagcaagacttcgtctctacaaaatattttaaaaatcagccaggtgcactgatgtgcacctatagtcctgcttacctgggaggctgaggcaggaggatcacatgagcccaggagttcaaggttacagtaaaccatggtcatatcactgcactccagcctggctgacagagcaagaccctgtctctaaaaaaaaattttttaggccaggcgcagtggctcacgcctgtaatcccagcactttgggaggccaagacaggtggatcacgaggtcaggagtttgagaccaggttggctgccacagcgaaaccctgtctctactaaaaatacaaaaaattagctgggcatggtggcgggcacctgtaatcccagctactcaggaggctgaggcaggagaatcacttgaacctggaaggctgaggttgcagtgagctgagattgcaccactgcactccagcctgtgcgacagagcaagactccatttcaaaaacaaaacaaaacaaagaccagcttggccaatatggcaaaaccctgcctctaccaaaaatacaaaaaattagctgggcgtggtggtgtgtacctgtagtctcagctactcaggaggctgaggtgggaggatggcctgaacctgggaggtggaggttgcagtgagccaagatcctgccactgcactccagcctgcatgatagagccagactttgtctcaaaaaacacttaaaaaaaaaaacaaacaaactggatatgagtttttttgttcatacttgttacagaagtctttttgttttaaaatacactggtatatacctaggagtagaactttattagaaactgccaagcggcatacagtaagtttagaaataactatagacatgtgaaataaaagaacttttaaaaattttgcttaattattgataaaatattttttaaaaattggtaaaataggaagaatcatctaacattcaaaatgctttataaagtaattttatcctatataaaatgctacaaatgttctctgatgatatacattttcaatggttgggactttaagcaagttgactttaggcaaataggtcttaggcaaattggcccaaaagctcaatatagattcttgtcaagacaggtctcccccattctgtactggtgtaattgaatttttaaacaatgcagacttgacattcatccctgtaggtttcataccagtaggaagtacatgtatatttatgcacagggatatatgggattaggatgctggaacaagtagacacttggtggaaggagggaaaggaattcctggccctgctcacagagctctggggagactgataatgggccatgagttggcaggatgcccagggagttaaaaccttgctgagccagggcaggggcctaagcaggggaaggtcctgaaggggctcatttggctcagtggggcctgcctggcaatgttgggaccagtttgtggggaggagctgggggtgtcattacaattaatgaggagagtaaggcagaggttgtctctggggatagtggcatagagaactacgtaactgagagggtccacagtgtcagtgggctgtgcaagttagcatttgtctgagaggaaagaaaactgttctggaatcaaccctaaacagtttttgtcctggttgcagatgtttcaaactttcattttaaaaatatgtcagcacatgtgattgcaaattttattattattattattaagatggagtcttgctctgttgcccaggctggagtgcagtggtgcaatctgggctcactacaacctccacctcctgggttcaagcgaattctcctgtctcagcctcccgagtagctgggattacaggcatgcaccaccatgctcgaccaatttttatatttttagtagagacgaggtttcaccatgttggccaggctggtctcgaactcctaacttctcaggtgatccacccaactcggcctcccaaagtgctgggattacaggcatgagccgctgcgcccagctgagattgcaaattttaaaaaatttatagtcatccaaatgtgttcactatcttttcttcatgtcttccacacttttgataaaattggcttctatgtcatctcctgagttattaataaaaaatattaaactgggcaaagccagaataaagcccactggaatgccaccagagactcccctccagggtgccggcaattcattaatcaacactctctacgaatgactattcagccaactataaattcacctcatagtccccattgacgtgtttccacctttgcacaagagactcatgagagatttaggagaagccatcacagaaatcaaggcacagagtctatgaaataccccaatccactaatttaatcacttacaaagaaagaaagaaaaagaaatgaggttaggcttgttcttagtgagtccacgctagtttctggcaaacattactttctttttcaagtactcagaaaccatctgtttaataatcccttctagatttttgttggcactgggggtgctcatcaatcaaattgtaaatttcatttatcaccccatttaaaaatcaggacactattttccattttcactgttttggctactctctctgattttccaggttctatcaaagatgttacaggtaacccttgccatcatctgggaggtcatctgtctgcaccagctggcttaaactcactgaagcaagctagctagtgtcatgggataaatgtgatcctcagatataagcagaaagcaactttattttgtctcccattgtcccttaaaatttattcagtaaggtatatcctttccctgtctatggatgaaaatttatcagtcctgtgacttatctgatcatatcactcatgataaataaaagtactataatcaccttaagtcactaaatatagtcttaatttagatattagaaatctacttttatataacaagcaaaactatacagtttgtttaaagtgaaatcttcctcttcagtttgagtctgcctcaggcaggaagcttacagctggtaacggtgtgcatttggtttcttctttttttttaacctctcctacatcagcttataaacctggaattctgactcctctagggtggggcggtactaagaggctgaggagtaggaaagctcttctttggtacttttgtaaaatggctcttcactctctgagcctagtaagtgtttcaagcattcttaatcttttgattttttcaggcaagaatcagacgccaatttactgcatcctgccctctccccattccccatacctgcaatcctttgaaacctctctccctcttaacttgagatgaaggggaaataccccacaccacgcaaactattctctccaaataactcttcctctcaaatcctatcccttctgcaccccctgacccttaaaccccttgtggttttaaggggttcacgagaaattcaacccattcaaagacacttaatgaaatatttgaacagtggcctcttcatattttctcttcatattacagccaaaagggagacagtcctatttgtatatttggttaaagtatttttccactatctgctctcttatcttggccttccttttccttcattcttatttgatggcatttcttcttgatagggagacagatgaaaatagttcagaatgtttatattctctctaaaacctcctttcattacataccatcttcctcaagtgcaggggttttcctcatttttgaaacatgcttttaaaaaccacaactgtcaggccattttattaatttataatgaataatatgaaggtcataaacatatattcatgtattatttcctaatggtaaacttaaaataggagtgggcaaaggaaatgcagtacccgatacagagactattactcaacctttagaaaaagaaaattctataatatgtgacaatgtggtaaaatggcaaatatattcaattatctttataaaaaccagaatggacaactttacaccaaacaaacaagtaagtctcctctctgatgggaaatacaaagaagaaaataaaaattatcagccataaacacctaaattattaataaatttctttttaatattttacttaggattctccatgtaataattttaccaaattgaaatactatttacccaattctgaatcctaattcttaaacttgctatactgtgaatatttcctattaccagtaaaattcttggaaacccatttttaatggcttcaaactaggccaatgtatggggacaccatgatttattaacctctttcccttgttactgaacattaaatttgtttccatttttttttaccattttgaataacaccacaacataaactattgtgcatatatgtgtgcttgaatttctgacaattattagaaggggagttactggatcaaaggtatggactttttttttaattttatttttattttttatttattattattatactttaagttttagggtacatgttcacaatgtgcaggttagttacatatgtatacatgtgccatgctggtgcactgcacccactaactcgtcatttagcattaggtatatctcccaatgctatccctcccccctccccccaacccacaacagtccccagagtgtgatgttccccttcctgtgtccacgtgttctcattgttcaattcccacctgtgagtgagaatatgcggtgtttggttttttgttcttgcaatagtttactgagaatgatgatttccaatttcatccatgtccctacaaaggacatgaactcatcattttttatggctgcatagtattccatggcgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaaaggtatggactttttaaagctcttaatacaagctgtcactttgctttctagaaagaattgtaacagattggcttatcttaacggacattgtcgtcaaactcaatcagtccaaggctccatctccacaccagagccagccaagagaaccagaacaatgtcagagacacaggacaaaagtggtttttggctatagtaaccatattctccaatctgggcatctgtttcaagggagtgaaaggagaaagtccatttgtctatttgcacatgtgtagtcagggttctcctggaaggtggtagcctcctccgatccagcctgtatctggttcattgccctataacacagccctatgttaatcataaagccaaagggcagggcagctttgttttctctcagccacaccccagtcaccttcctgcacttaaatctagggggctcctccaagaatctgtagccacaagttgataaacacattttcagatgggtttgttttgcatctattacaggttgaagtgtcctagttttgctctcaagtgatgacattcatccagagcatgttccaaatctgcccatttcccaccccatctgggttctgccttaccatatttttaagacagaaacacaacgtacagcaatactaagccatattctaatgacaatagttagataactttttttctgatttcaaaagtggtacatgtttaaagtggaaaatgtagacaacttaggaaaccaggaaaggaaggctgcagagtgaccagcacttatggcagcctgcctggcagatggagagtgcacgtctcggtggacatctgtgtggggtcagcagggatcatgttcagctcagcagatgtcaggagacatacagcaaagtctgagggctggtaagaactctcccgcttgacactacataagccctgagaacttggttccaactccagggaaaagggtggggggaacccataaaactgaaataaaaatcataacacagtagaatgacacttgatatagaaatcaatttcattggtaggaagacaaagaacagtggagtctagtttgtattctctttccagctcctttggcctctgattcccaacctctggtgcaccccaccaccagccttttccagtggctcagtttggttcagtcgtggtacctggtttgagggatggactacattctttaggcaccccgtgggagctagccctacaaatcaccatggaaactgaagatagagtgattgtccatgctggtcttagaggcaggtggttcccaggtgaaggctgggaaaagtcactcctacaatgatgtaataactctaccaatggccctcggtttctgaagatttgcttcccttaattctcctcactggaattgggggattagatctctgaaagcagagatgatataaaaacatatataacatatataaaaacaaacaagcaaacaaatagcccaatagggccatgagtcttggtagggatgtaccagtaagaaagagttctggtttccctaagccatggtgccagtcctggctctttgtttcaaaaggatcttcagagccacctggcacagagggctttctcttggagtcgttccttttgcacctctgcatccttggcaacatttcaggggagctcccgggtagggcaacatcttaactgtcaagacagtgcagcatcagagagtcacagaggcaggctctggaatccctagagaccaaggccaagaccaagaacaggacatatgtaccaggattggcattgcagtgatggctatagtcacaaacaatttgaaacatccaagctgttgagccataggggaccacttaaacagatgctggtatattcataccaaggaacactatgcactcattagaaaaaaaatagatttctgtaaataaaagggaatatgaatatgttcataatatattttaagtaaaaaaggcttaaaatagcatgtagcacatgatcttattttaaataaatatatatttatttttacgtattatatataggaaatctctagtgggataacagcaatcttcatttttttgtatttctctacatgtttcaaatgattttgacatgtttctctacatatgtttctctacatcatatttcaaatgatctttgacacaatgacttattgctttgtgtattagggttctctagagggacagaactaatagaagatataaatatatatatataaatgtatatataaataaatatatatatgtaaagggagtttattaagtattaacttacaaaattacaaggtcccacaataggccgtctgcaagctgaggaacaaggagagccagtccgagtcccaaaactgaagaacttagaatccgatgttcgaggacaggaagcatccagcacaggagaaagatgtaggctgggagactaggccagtctctctttttcacgtttttctgcctgctttatattcactggcagctgattagatggtgcccaccagactaagggtggatctgctttccccagcccacagactcaaatgttaatctcttttggcaacaccctcacagatacacccgggatgaatactttttatccttcaatctaatcaagttgacactcagtattaaccatcacactttgatttttaaaaagtataatctttgttggccaggtgcggtggctcatgcctgtaattccagcactttcggaggccgaggcaagtggatcacctgaggtcaggagttcgagaccagcctggccaacatggtgaaaccccctctctactaacaatacaaaaaattagtcaggcctggtggtgcgtgcctgtaatcccagctactagggaggctgaagcaggagaatcgcttgaacccaggaggcagaggctgcagtgagtcgagatcaggccactgtactccagcttgggcaacagagcaagactccgtctcaaaaaaaaaattataatctttgtcaatggaaatgtggctaaaacctgttgtggcagtcatggaggcatgccacttggatctccccttcaagaaggaacttgacatcagctatgggagttgggttagctgacagcctctagctgcagtgccttggggacccactgtaagctcaggcttttcctggacagcccccagccaatagctgagcatggagaggcactacttcccaccttctgccccacttggaggtcttcttgggcactctttgtcctggagctccccactggactgccagagactttctcaaagctgccctgtggtctgaagctcttcccatccaacgcttccttctgccttctccttccacagaggtcagacctgcatggcaatctgaggtctttcctgcctgttactgttccctctcaccctttattctttataggtaacactccgttaaatcttttgtacagccatgtgccacataacgatgtttcagtcaaggatcgaccatgtttccgacatggtcccataagattacaatgaagctgaaaaactcctatcacctagtgacatcatagccgtggtaacattgtatgcaactacttaatgtttaaataaatttaatgtagcctaagagtagtttttagagagtctatagtagtgtacagtaatgccctaggccttaacattcactcatcactcactcactgactcacccagagcaacttctagtcctgcgagctgcattcattataagtaccctagacaggtgtgccatatatatacacatacacatatatatatacacacatatatacaaaaattagctgggcatggtggtgcatgcctgtagtcccacctacttgggagactgaggcaggagaatcacttgaacccgggaggcagagttgcagtgagctgagattgcgccactgcactccagcctgggtgacagagcaagactctgcctcaaaaatatatatatatatatatatttgtatatatgtattatatatatatacacacacacacatacacacatatataaacacacacatatatacacatatatatatacacatacatatatatacacacatacatatgtcacccacgctggagtgcagtggcgcaatctcagctcactgcaactctgcctcccaggttcaagcgattctcctgcctcagtctcctgagtaggtgggactacaggcatgcaccaccatgccaggctaatttttgtatttttggtagggacggggtttctccatattggcgaggctggtctcaaactcctgacctcaagtgatccaccccgctcggcctcccaaagtgctgggattacaggcatgagccaccgtgcccagcctcatttttatattttatactatatttttactgtaccttttctatgtttagacacacaaatgcttaacattgtgttacggttgcctatcacattcagtacagtaacatgctgcacaggttcgtagcctgggagcaattggctgtacgtacagcctaggtgtgtagtaggttagaccatcattcatgtaagtgcactctatggcgggtccgaaaagaagtggagcctagagaagcatttctcaaaacatatctcttttgttaagtggcagcacaggatggcactactaactctatcttgatgtttgccttctggaggacctaacgagattcctctgtgttcctgaacatactgtgagaagcctggacttactcgttacacattctttccatagaaatacccctctccaggaattattattccagatgacccccaagtggtctaacaaacaaaatgaaatgtcttctcctgccaagattttcctcttctaattgtggctgcctgaaatttccttcattaagtctgcctgtcaacacctcccaatcccttctcatctctgccctgctacccacactcctgcgcaggttcagaaaaggccatcagtggccttcttggctacttctctaacccatacagagaatttgtgaattactcagtatttttaaggcactgcttttctgtttaaaccagccagagttggtttctgctgcttcctaagaaggctggctgatatgtatatctaatgcatagtatttttgcatatgatacattggcatggagaaaatcatatcatattcaaattcagtttaacaactaggttgttaacacaggttgcctgggagggtggtgaggtgaagatggggaggagaggaagagaaaggaggcgagcaaaaatagaaaagggaggaaaataagactgtattaaggagaaggcagcatgcattatgatatgatctcatgtttgcattcacatagtcagtatattcatataccagccatacctcagagccactgaaaaataaatttcccagggtcacacccagtcctgagtatttttcagagcttctcaggagacactgaggagaaaacagggttgacatttaccgaagtgatcctggaccatctgcatcagtattggctggacctctgtttaaaaattcatgttcctggacgccactgcagacctcctgagttaagaatctggagtaggatattctctgccctgggagagggagctcaatgccctgtggccacaggaccaaattcctggggcctagagcaaccacagaactctttggcagtaggccagttctggtgcagtgggcctcaccttttcaaagatctgcttttaaaattgttaatgactgttttacccagcagttccacttcttggaacacatcctaaggaaataaccacatgatgtgaaaagatgtatgaggaagaatgctcatcacaacccttgtttatattaatgaacgtttggaagcaacccaaatagcaatcaatagtggagtcgttcaaataattatgacacatccacacaatggaagggtatatagccattatgattatgaggtagagctctatgtacacaaataaaaatacattcacagtatattaagtggggaatgagcagggatctcgaatgcaacagatggcattcagatgcatggcatggctacgtcacgcaccatcttggggtcactttcttttttatacaagaaaacagacctgaaggctattatggagaactttgaatccactctattttattttatatatatatataaaataaatatatatacacacatatataaatatatatatatacatatacacacacatacatatttatcttttactatggaaaatttcaaacataaacaaaagtagagtgaatagtgtaaggatcccagtgtgtgacttcaacagttttcaatagaaggccaatcggtaccccaagtactattctttacccgaattgtttgcaagctgatattttcctaaatatttttttagtttatttgaatctggattcaaataagattcatacaaaatgatgaattgatatgtctcctaagtttctttaatctgcatgttctcactacatatttttgtttttcttttatagttttttggttgaagaaagcaagcttatcctgtaacggcacactatccaatacaatagccactaaccacatttgactagtgagcatttgaaaagtggctagtgtgactgaaggactacattttaaattgtatttaattttaattaatatacatttaaatttaaaagtgataacttgatccagttattggaaaactgaagtttgaaacaacttgggtatgtgaatctgctttctcaaccataaattttatgaaatctaaatacagtttaagtatttctgatgaaaatttagtgttcaaactgagatgtgctttaagtgtgaaatacacactgattttgaggatttagtatggaaaaagaatgtaaaatatctcattaataatttttatattgattacatgttgaagggagaatattttggatgtgatgggtcaaataaaagttattattaaaaacaattttgtctgtttctttttatttttttaaaggcgattaccagaaaattacaaattggttacatacaaaatcaagaagggctggagagttaacacttacccccgataggcctcaataagcacctgtcaagagtcagtgtgtaactaccccacttcctcacctcttgagtgggataactctgaagaatgtaccttacactatttcccagaattcccccacaggattaagctccaggcaccactgtggtacctagcttgataatacaccttttataggctgccttcccttctctctctcttccctgttcccctaccagtggttcttgcatttcccagataaactctttacattcaaatacttgtcttggggtcagtttctggaggaacacaatgctaaaatggtcccatattggccagtgtgagccttcaagccagctcaggagtctttttgatatgatcgtaatagtctgtgattgcttccttgcttctggtagtttgaaaagatatttcaggctcactctgtacatatctgttccagacttggagccttaaagaaaccctgactctttttaatgggaaatggtatttagagacacaatttgggactagaagtggttatttctatggggtttatcattgtttcaaggtgttttacgttgacagaatatatataaaatacgttatgaatttatgatggtaattccaattcaaagtcaaaactatagctttcttacttaactccaacaaaatgttacatctgtatctcttttgatcttgttgaaaatctcagttctcattgatactgacttaactacccatttgacttatcccttaatacacaagccacagtctgtgtttgacagaatgaaaacatcactactaaccacaatatcattactagaaacaggttaggtatttttttctattctttttgtccttaggatatatcccattaaggatgtgtaaggatacatagattgctgtattagaatgtcagttactggtttttaaagtcacttggaaaaattcgtttctgtcaggttagccacaaactggatatgctgtgagagttccttgtttcatttagttttcagttttagtaacagcattaacccaattaatttgttttataattatataaattatttattggttccaaagtataatctataaaacaagatatatttcaagaagtctagctcttgtcctgttttctctgccctattccttttcttctcccataagaattctaaagatttttaaatcattctattgtttttaatacatataaatgcatatgcatataatatatacaaatatatttaatatatatgtagctctcttttcttagataaatggtagaatattttacatctttttagctgtattttcttttctcagtaaacacaatattctcaagatcactaaacaatggtatgtggagaaatttctcattccttgtttctttttcaattacatggaacctcattgtatgattgtatcatagtgtattcaactagtcccttattggtgaacttttggattgtttctggtcttttactattacaaatagtgctataattaatagcattgtgcttgcatcttttcatatttctgccagtgtatctttaagatttattcctacaagtttaatttctgggtcaaagggtaactacatatgtaatttggttagacattaccaaattccctttcatagtggttataaaaatttgcattcctaccagcgatgaatgagaacatgtttttccacatacttatctgtgatggttaattttacgtgtcaatttgactgggtcataggaatgcccagatatttgcttaaacttttttctgggtatgtctttgagggtgtttctggatgagattaacatttgagagcactgaatcctaaccactagaccacgagggagacgagggagagattaatatttgagtcagtagtttgagtaaagaattcactgaagtaattgcgttcactgaaggcctgaatagaacaaaaaggctcaataagataattctctccctctgcctttcttcaagatgggatattggtcttctcctgccttcagtctcagactcaaactcaggctggaccttataccactgatttttcagattctcaggcccttggacttggactagaagtataccattggctctcctgggtctccagcttgccccctgcagatcttgggggacttttagcctccatgatcatgtaaaccaattccttataaatctattttctctttctctatatatatgttcaattggttctgtttctctggagtaccctgacaaaatccaacatgaatttttgccaatcccatgtgtgaaatgttatctcagagtgttttaatttgcatttctcttatgagagaggttgaacatcttttcatatggttaagagccatttgcatttatttttctgatggattgtccttatctctagcctatttttctacaagttttttcttttgtctatttttagaaattctttacatatttgtaatgttaaataaaagatgcacatttttttctggttgtctttttactttgcttgtggcactctttttggtcataaaaaatttgatgtaataaaatttatctttttccttatgatttctagattttgaatcataattaggacatattttccaactattgagctataaagactaatttgtattagttcatttaaaaatatttaaatctctgacccatttggaaaatatcctggtgtatgatataacaaatgaaactaatgttatcttttcatgtagctatctagatatcccaatgtaaattagaaatgccatctttttgccactaatttgagatgctgcctttttcatactctaaatttccatttgcaattgaaccaacttctgtatttctattctgttccattgtttattttattatacatgtgtgtagaaaaacacaaactcaaagtgctttttcttgtctctcactcaacaacaatcaacacagagaccgctataaccagctgtgtgtagggtatttccttgctggccaagcaagcaatcgattctgcagcaaatatcagctggatgtcctctaattcagttcaattttgacattatgtacctggagatagtatcagatcccacaggttgagggttcagtctccaaaattggcccccaccttcagatgccaaaaacaacaagatccatgttgtttttacctgtgcttcttattgactggctacaaatttggtcccataccacaactccctccttgagttcaattaatgtgctagagcagctcacagaactcagggaaaaacttaatatctaccagtgtattataaaggataccagtgtcatgaaggatacagatgaagagatgcatagggcaaggcatgtgagaaggggcgcggagcttccatgctctccctgggtgcaccaccctccaggaacctccacgtgttcacctatggaagctctctaaaaccatccttttcagtttttatggaggcttcattacagaggcatgattgattaaaccattggccattggtgatcaacttaaccttcagcccctctcccctcccaggaggtcgtggggtggggcagcaagtcccaactctctaatcgtgccttggtctttctggtcatcaccccttgttctgaagcaacttaggggctgccagccaccagtcaatcattattagcatacaaaaagacatcacttgggagatttcaaggattttaggagttgtgtgcctggaaacgggtcaaaaaccaaatacatatctcacattatcacatatgttaacatcatgctgttttaattaaatatattttaacatttgctagggccaataaccctcattgtgtcttctgtttaagtgttttcttagctcaagaagcttttcttcttcacaatgaaacttactatcaatttatgtagctccagaagaaagcctgctggtattttaggagtattacattaaatttataaattaccttgggaaaaattgccatctttattatattcttcttacccaaggacatgatctgttttacctttcttttttttttaaggtccacttggagtctttcaggaatattgtttttctcatgtagattttggatatttattaagtttatgcctaggtattttattttctttgtggtatcatagatggaatagtctctccattaactttttaaactggtttggtttgtgtatatgaatgctatagatttttatatgttgattttataatttgctgttttacaaaattttcttctcatctgtagcaccttttccatttgggttttggaaatctgtgatattgtctgcaaatagaaataatttatagtttttgcagtgaaatccataaatgacattagtatatggttttttggtttaatctcagtgaggttttgagattaatgttatacctggttcacaaattgaagttggaatttgtcattttatattatattggattgcctaactttaaacaatggattatctaatttaaaaatatttgatagaattcccaagtgaaatcatttggacctgatggtttttatggtgtttttatgtaatctttttactttaaattttccaaacactggtttattagaattgtctgtatagggatcaatcctgataactttttctagaaatatgtcatttcatctaggttttcaaagttattttcatagaattagggcaaagtaacttctcatgatttttaaattttccttttgtaactgagtaccctatttttaaagttttttttgtgtgtgttcactttatcactaggcaccccctcacattgctagtgcatctaattctatgtttttttacgcaaaagtgctttttcttgtctctcactcaacatctcacttttacacaaaagttccagagactaaatcttgaaacaattcaggcacctgtggaaatctccctgaccaggagattgcttcaaggatacagttaatttacaacccaaccaagcctgagataatgccaccccattcaccagaggggtcaataactcaagacgagtcatcggaacaagtcacgtagacctgcactgcgtcgccccctgtgtgtcctccatgccaaggcttccccttctttagcccttgcattttgcttggaaatttgaaatggttccattaaggcaagagcctggactgttttccccactgctagctttggtttataataaagtcactctccttctaccatatctcaatcttgctaattggttttgcaaccggctgaacctgcattcggtaacacactgttttatatttatttttgtacatttgtgctttctttttttacttaattaagttagcaaattgctatatgttgttgatttttttaagaagttgacttggattaaaaaacttatttgtactgcctttctgttttctaactcattaacatttaaaaatgtttattaatttatctcttaaatttcttccctgtgttttctttttattattttttatctttttgagttaggtatttttatttttttaaattataatttttattgcaattctcttcttctagctattttatttaatgctatacattttctaccaataactgcattagctatatctcataaattctgatatgttttcaccataatagttattaagacattttgaaatttcattttatacttcctctttgaatgaagagttcttttataaaatataaaaatttccagaaagaagggcttttttgcttttcctagtattactttctagttttattgcattatggataaagaatttgctttatatttgctatgtcctttgaaatgtactggtcaatgttcatgaatgctctatgttggcatttaaaaaggtgtaggctggatgtgagatggctcatgcctatagtgtcagcactttgggaggctaaggcaggagggttacttgaggcctggagttgagaccagcataggcaacatagtgagactgtgtctgaaaaaaaataaaaaattagccaggtgtctttgtatgcatttatagtcccagatacttgggaggctgaggtgggaggatcacctgagcacagaaggttgaggctgtagtaacccatgatggcaccattgcactccagcctgggtgacagagtgaaacactgttcttaaaaaataaataaataaaaagaaaaagaaggtgtattctctagcgtcagggtcgagttggatgtatatctaagttttgctgcttaatcttggattgagcgaaatgtgttaagttcttctgttcttagtacacatatgtctagttcttcttgcatgtcctctaaattttacataagttgatgctgtgtcttgggtgcataaatattaataactaatatttcttcattgcaaattgtattctttagcacttgtgtccttctttgtctcttctaatgattttggtctgaattttatcttgtcctttatttagattctgacctctttttttaaaaaatttgcatttgctggatatatatttgtctaaatggttattttaacatttataaatctgttattccttctgtacgatatggtaatgaattttgcttggctagctgaaaatcattttgttttaagttaagaccatttgagtacactgacattattgataggttgacctcaaaaattttgtcatcttgttttatattggaagtatatcttatagaaataatatttgcctttatggcttattttatttcatcctttttttttttatcagggagggtatatcttttgaatgtaggcaaatttatattttggttctgattgttacctttataccaattctaaaacttttactcctaatctcctgtttttcatgctcttgtctactgatccccctttccccatgagtgatattgaagtttacctagtaacttcttctttctccatgtcttctccaaatctaatttgcaataatatccttatactccccgttaaaacctacaaggaagattttcttttttaaaattgatatatgtaattatatatattttggggatatatgtgatactttgatacatgtatgcaatgtgtaatgatcaaatcaggacaattagggtattcatcacctcaaacatttgtcttttctttttgtgttgaggacattgcaattcttttcttctggctattttcaaatatatgataaattgttattaactataatttctctgctgtactctccaaggcagttttcaagcttattgaacttcttatgtactttctccattcttatcccatttttgataattgtgctctatttatattgtcaggacataaagccgttcgtactattctttcttgctaagaaccatcatttagtcttaattctacaggaaaccatgtctttcatgcttatcagcagtctttgtgctgatacttctccagtcattttggtcttttgaagtacattctctagtggattcctcaggaaggattcataagaacaacattgcctgagttttttgcattttcataatagtgtgtctgcctttatatttgaagatcagtttgtttgctataaaatccttgcttcatagtttatttccttgagtattttaaagatgttgcttcatggtcctctagcaaaaagggttgtgtccaaaatctaatggcaatctaattttctttctcttataaatgacttggtctttttgccaatgtcttttaagatttttttttcttttactttgaagtcagtagtttcactagaatattggctgttttaggttgattttcccagatataaaatatacctttcactataaagtttcaagtctgttttatttcaggaaagttttcttactttaaatatgtttgtatttgttttattctattggtttgattttcatcttcaggatttttattccacacatattgggtcttcttcatttgtctttgattttaacacttttcttcttacaggtggtgttcattcatatttgggttctatggtcgtctgaaatatggctagaaagaggcatgaggaaacattttaaggtgacaaaattgttctataccttggctgctagtagctacaaacttgtatataactaccaaaagtgatcaaactacacaattataatggatttgttttattgtatgcaaattatactttaataaaactgagaaaaatagacaaaaattctttgacactcctccaccaagaagtggagtctatgtttcctccctttaaatctggatgggtctgtgactgcttcgactaatagactacagtgcaaatgatgctatgagacttccaaggctaggtcatgagggactaaattggtctgccttggtatttggaacacttactcttagaaacttgggtcaccatgtataaagcccaactacctcaagaacatcatgctggaggggtcacctgtcggcactccaatggccagtcctagctgaacctctgctccagccatcctagcccaagtgccagataggtaattaaagaagccatcttggaagtagatctaaatctaatcccagctgtcttagcccctggccattcaagttgtcccaattaagcctagaatccatgagcatgatacaattgttgttggtccattccactaaattctgtggtaataaattatgtagcagtagaaaattagaacatgtcccttccattttagtcttcatttgtgaaactgttttttatttctttttctttcctgagttgtcatttctcttttcaaatcttccttttctcaaattacttcctttctaaatttttctaatctgattacactattatttcatacacttatcatttttctttattttagttcatttaatatattaggttacaagttttacctgttttataagcacgtctttctaacatgacttcattatctgtcatgacattctatcccttattttcctttctcttatagtgactttatatggaacttgctcacgatcattttctgttgctcatctctttcatttttaggtattttgtttctgtttcatttttaaaatttgtatatgtttagggtatacaagtgcagatttcttacctgcatcttttgtacagtggtgaagtctgggcttttagtgtgcccatcacccaaatagtgaacactgtatccaataggtaacttttcaacactcacacccctcccaccctcccaccttttgtagtctccagtgtctgttactttactctgtatgcccatgtgtatccattgtttagctttcactttataagtgagaacatgtggtatttgactttctgtttctgagttatttctttaattaattcacttatttattttaagttccagggtacatgtgcaggatgtgcaggtttgttacataggtaaccgtatgccatggcgatttgctgcacctgtcaacccatcacctagatattaagccctgcatctgagttatttcacttaggataatggcctccagttccactcatgttgctacaaaagacataattttattcttttttatggctgagtagtatgccatggaatgaatacacacatacacacacacacacagacacacacacacacaaaccacattttctttatccagtcttctgttgattgacacttaggttgattatctttgctattgtgaatagtgctgcaataaacatgagtgcaggtatcttttttcatataatgatttattttcctttgagtagatacccagtagtgggattgccagagcaaatggtagatttattttagttctttcagaaatctgcatagttttccattaaggtttttactaatttacattcccaccaacagtgtataagtgttccctttctctgcatcctcaccaacatctgttgtattttaactttttaataatagccattctgactggtataagatggtatctcattgcggttttgatttttacctctatgatgattagtgatgttcagcattttttcatatgtttcctggctgcttggatgtcttcttttgaaaaatgttcctgccctttgcccactttttaatggggttgttttttcttgttgaattgtttgagtttgttgtagattctggattagccctttgctgcatgcatagtttgcaaatattttttcccattctgtaggttgtcttgtttactgtattgattgtttcttttgcagtgcaaaagctttttagtttgattaagtcccatttgtctatttctgttattgttgcatttgcttttgagggcttggtcctaaattctttgcctagcccaatgtccacaagggttttttctgggttttcttctaggattcctatagtttctggtcttacatttaggcctttagtacatcttgagctaattattgtatatggtgagaggtatgggtctagtgtcattcttctgcatatgggatatctacttttcccagcaccatttcttgaacagggtgtcatttccccagtatacattgacttgttgaggatcagttggttgtaggtatgtggctttatttctaggttatattctgttccattgatccatgtctctatttttataccagtaccatgctgttttagtcacaacagacttgtagtaaaacttgaagtgaggtaatgtgatacttccagctttgttcttttttcttaaaactgcttcagccattcaggctcctttttggttccatgtgaattcgaggactatcttttctaattccgtaaaaattgacattggtaatttgatagggattatgttgaatctgtagattgctttaagtagtatgattattttaacaatatcgattcttctaattcactaccgtgggatgtatttccacttgtttatatcatctctgatttctttcgtaagtgtttaatagttctctttatagagatctttcactttttttgttaaatatgttcctaggtacttactttatttgtagttattgtaaatgggattgccttcttttttcagtcatcagctagatagttattggtgtatacaaatgctattgatttccatatgttaattttgcattcttaaactcctgaattaattaatcaaatgtaagaatttttggtggcgtctttagggtgttccagatataagatcatatcataagcaaataggaataattttacttcctgttttcaaatttggataccttttatttctcttgcttgattgctctggtgaggacttctagtattatgttgaataagagcagtgaaagtgggcatccttgtctatttccaggtgttagaaggaatgcttttaacttttccctgttaagtatgatattagctgtgggtttgtcatgtatggccttatgtttaagcatacttattcctaagcatattattccttctaaggaatagaacatattccttctatgcctagtttgttgaggacttttagcatgatgggatgctgaagtttatcaaagacttttctgtgtctattgagatgatcacatggttttgtccttaattctgtttatgtgaggtatcacatttattgatttgcatatgttgaaacatccttgcatccctgggatgaatctcacctgatcatggtgtattatctttttgatgtgctattggattcaatttgctagtattttgttgaggatttttgtgtctatgttcatcagggatatcagtctgtaattttcttttttcgttgtgtccttttctgattttggtatcagggtgatattggccttgtagaatgaattagggagaattccctcctcctcgattttatggaatagtttcagaaggatttgtattagttcttctttgtatgtttggtaggaatcagctgtgaatccatctaattatgggcttttttgggagggggagttttttttttttattactaatccaatctcaccactcattattggtctgttaagttctatttcttcctggttcaatctcaggaggttatatgtttccaggaatttatccatatcctccagattttcttctttgtgagtgtatagttgtttataacagtctcagatgattttttttttaattctgtggtatcagttgtaatgtctcctttttcatttctgtagtgtttacttggatcttctttgttcttggttagtctagctagtggtttatcaattttgttcatcttttcaaagaaccaatttttaattttgtttatcctccgtattttgctattttatttagttctgctctaatctttgttgtttcatttcttctgctacctttctttgttcttctttttctagttccttaagatataatattaggttattaatttgtgaccttttagttcttcgatgtaggcatttaatgctgtaaacctccctcctggcactgcttttgctgtatcccataggttttggtatgctgtgttttcactttcatttgtttctagatttttaaaaaaatttgtctcaattttctcatttttaatgagagaattttttggtactttcaggagaaaaaggtaggctggtataaccttcgtagatttactatcctggatgttcactttcacaaagtaattttcttttttttttttctttttttttgagatggagtctcactctgtcacccaggctggagtgcagtggtgccatctcaggtcactgcaacattcgcctcccaggttcaagcaattttcctgtctcagcctcctgagtagctgggactacaggagcacaccaccacgcttggctaatttttgtatttttaatggagacggggtttcactatattggtcaggctggcctcgaactcctgacctcaggtgatccacctgcctcggcctcccaaagtgctgggattacaggtgtgagccactgcacctggcccacaaagtgatttttttaaaaaatatggccaaatattttctaagctgagtccccattgctcttgtctctcacttttatctctctcctatttctcctcccccaaccccgtgatgcttcatttaaattctgttcccagtgagtacgtttcagtgcagtttatcctggaacaaaatttgatgcgttagtttaaaaaactcagagagcccagagtgttccaacactttccaccttccagagatcccttggcgctcacatgcaaattggatcctatgaaacttcctccaacttttggttgatgttctcagattgagccaccgagatttccaaggcaatttgtgggttggctttcaggaatactagagtccttttctcccccttctctcccaaacaatttccaaaatcacatggttcttgcagttgtcagtagcttatacccatctactaatattttggagttgttaccacaccttgtcacctacttatgttgtagatcagtggttctcagactttataatcagcatcacaagaattgcccacatgaaagcttgcacacaaatgtttagagaggcattattcataattgcaaaaagtggcaacaacccaaatgtccaagaatggatgaacggataaacaaaatgtagcatatacatacaatgggatattatgcagccttaaaaaggaatgaaattctgacccatgctataatatggatgaaccttgaaaacattatgctaagtgtaatgagctaaacacaaaagaacgactattatatgacccatttatatgaaaagtccagaatagacaaatctatagagatagaaagtagattagtgattacctagggctgcgggtgtggttgtggggggtagaatggggagtcattgctgttgggcatggggtttctttataggggtgatgaaaatgacctaaattgattgtggtgatggttgcacaactctgtggatatactaaataccattccattgtatagtatgtgaattacacacttcaatagagctgattttttaaaagcagctatattgtcacaactgccatcttcccagaatctccttattctaaaaaatattaattattcacaaatgttggtacttccattcattgtaacaagtcttgtataaaatgccttgcaaacaatcacacatggcagtctatcaagggcaccgtgattgaaagctggtggctaagtgcaccctgaggaaggctttgtggctcccgactgttgctcccagtacatgctgtggtgacatagagtaagatttgccatgataaagccatgctcttggcctcaggacaaagcctctcagccctgggaatctcggcccctccctggccctcagtgcagcccacacccagttgcctctgccatgaaaggaagcggacaccttcctccctggctattcttttcccactggcagactccctcccagccctggttccaagggctgtcagggtcaccctccctctcctcaaatcccccaccccctgccccatcaggactcattctgctttccatcttttcagacaataaagacactagaggaatttatttatacctccagccagctaataagacaattcaatgaaaagcagcccctgcttgctggagcatcctcgggcctttgattgcctcttctgtgtcccaattcccagcatttattctacatataaattttccacggtgaatagacaccattcttctcggaataccatttgttcccttggttattttatttccatctcgttttgctttttattattactgttaaactgtaattaattcttctcctatcagcttctctttagtgaactaagcctaatgcagcatgaagtgtcttcactcacccccaactatacacctattcttgaaaataacgaagcctctgacatttcaaaggcccacaagctgctaaatctttccttctatggaatgggagtggggagggatggagggagggagggaggaaagtctgggcaggcaaagtgatttcataaccaggtgactgtgggtttcaatttagctgagatagttctgatttcatttagcagacagacacttgaaaggttaagaaagtcatgaaggaagtgtgggagaaaagctcaaatgcactttaaaatgtggcccctgtcctgctgctcaaatttggaaccactgtctttcttcccatctaaaaggatatttgctgcattacattccctctaagttttcacagcatcccctcaaggtcagcctctttgaaaggtataccagcaccatggacaattctgtgatggcatctgtagtgggttgaatgggggtccctagatatgtccacatcctgatccctggaacctgcgaacgttaccctctttagaaaaagggtctttgcagatatgattaagtttagcatcttgagatgagaaggttctgcattacccaggtgagaactaagtccaatgacaagtatccttataacagacatagaagagagtgacagaagagtagcaggtgatgagaagacagagattggagtgatggggctacaagccaaggaacaccaaagattgctcagaaaccaccagaagctacaagaggccaggaatggactctctcctggagcctccagagggagcgtggccctgacgacaccttgatttcagatttcaggcctccagaactatgagagagtacatttttttaagccaccaagtttgtgatcgtttgttataagcagccacaggaagctaatactgcatccttagtttgccagctcatcatgagcagaaaacacaaaagagaaaagactggataataccaagtcacaaaactttaacatgccaagctgttgccttcagatggtagaagtctgggttgtcagatcagatgaggctgcccacataactcaagccgaaagcacgcattggatgcaggaaatgaattcctacaacccagaccttgccagaactggctggccacagctttgctttctgaaatatggcttttcttaaagaggatgtggcatacagttggctcagctgtgacttttattttacatttacaattcctttatccaaaagatttctaagctcaggtatctatatttcttttttcctcccaaattttctctatttctttttcttttaatagctagaagaacacgtttatgagtagttatagaaatgtcccagagtcatgggtctgcatgggatctgagacatcatgtgatttgtctcagaaagtggcatgccccagcaggccaagtcactagaggggttttccattcaaatgtttttaatattttactcctttgataattgataattcctttgataattgataattgatagttgataattccttattggctcccatttttctttctccatttgtcccagaaacttatgctcattctccctgtaaatgtgtccttatttcctttttcttctattgccaacctctgatataatatacaatatagttccttgtcatgtccctaggatttcacatgggctagtatggacccaagcttttcacctctcagtagaaataatgcctaatagtgcacacagtggagcctcataaacaatgtgttgtctaaaaggctgagtttccagatgtcctagccgtatagagtaccactctgttatactttgattttatcctgtgggaaaatatttgaaaacttacacttaaattgattctatctctattatttttaaataacattctcttgtagcttacagggtacatttctatcctaaatgacatgtttctgtttaacttgcgtgctatagttctgtgtgtgtttacatctgtttgtgcgagcatgcgcaagttcatgtgtgtttgcacgcaaaatccctctggtaacagaaagtttattttccctcttcccataactgaaagtccactgaatgaatttaacttaaattacctctcttggcctaaataaataaatacaatatcagcaagataaattatgacctaaaatgttatttcttatttttaaaaagtgaaaaggtgagggtaattgagtttgctgttcgaatcacagctctgactcttggcaacaccctaaaatatcatgttccacctcagttctgtaacccaaacacagcagcagtgaggccctgcttctgcactgatgaaaggttttcatttctggcagggcataccgtaaactgaggcccacagccacgaaacaagaggtggtgtggaatttacaaagctctgaggggcaatctccatccatttgtggtgattaatatctccttccttggcttgaatgccaaccttcaattagaaacggaaacagaaccttcccttttatagagcagacccccaagacagcccctggaaggggatttcccctggaaaggaaggcccggtaaaatccaaggagaagagctgaaattcccctccattagcagagggtgtctgcattcctggggtacttcctgcatcttccaggctgccctgctgggcaccttataccatggcagggagtgatgtcaaaaaggttatgttctcatgggaacttgaggaaggaaaaaggcttagtggatttctttagttattttggtgactgtttctatttttcaagaatgtctaagaatctaagggaaaatctcaaggttccccttcacccccagtctcttccttccattgaatttgggaactcacctattagggccaaccccatttggggttcttctgcttccagtcagggctgagactgatatcaccaatgccactgccagtcaggtggagaatgggattattgtgaatagcagatttcaaaatttgataaaatgtttatggttatgtgaagaataatgcaaattctgactcatcataatggcctatccttctcttcccagctctttcctccctttggttgtgtgtactgggagctctggcggatgagattgctctttaaaaagacccttgtgggtgggcctggtcaggatactcccagaactctctggtgaaggttgatttccacattcaggtatggagtgggcattaactgcttgcccctctactccacattcattccccaccaccttctcacccacagagtacacatcaggcactggggttgcaagagtgagtaagacaaccctccgccctcatggggattgtctcccggttaggaagacacactgaccacatcaatcaatcactttagatggttctaagtaacatgaaaaaaaaagttaatgtaatataggatagatagaagatgggtaactattttttagggtgattaggaaaggtctgagaaagtgatatttgggctgggatctccacgatgacacatatataacctcacggtaatgtacagccagtcttgagaggtcatcagtcaggcataaagcaagggagtggtcaggagtctgggtctgctgcctggaagccaaggagaagaggaagaccaagcagcatggttttcacccttcatccctcatacccccagacccctcagctgtcgtctgatgccactgacacgttgcaggttacccaacaccatgctctagaatgaggtctgagctgggcatcagggccctcaaccctgacatccagggggttccatcagctgtgtatgcttctctgggccccatcccctgcaaccctcacagaaagagccgcactgctgaccgtgcagggccgtggctctaagccacgcttccctaccctcttattacagtccagcaaggaaggaaggcaagacctggccaaatgacagtcataatgcagtgtgatgagctcggggacagatgaaataagggcccagcagaaacccaagcccagaagggaggggtggcaaggctgtgcaggaggctgccaggggagctggctcagtcttgctcgctgccagcctacctcagacttgaccctttgtagcactttacagcaatcatcttggctctacttgacaattactgtggttcagcaataggttaggccaccgtgtgtgagtacacctgcaaatttggcctgttctgggtgcctccaccctcctggagctgcactctctgcagtaatcttgctgggtgtttcctaagcacaatggagacagctgggtaggcctccctgtgtctagaacaaacccaggcctctcagccaagtccagtcaccccctgggctcctgttcctcttccctacccactgtcctgccagctttcacaccagcagtaaacctagcccacagcattggagctcagcggaccctgagaaaacattcccaaagtagccattccatggctaggctgaaggacctgggatggcttagtcctgtaggctacaggaacacaaattgtccacttgaatatttgtgctgaccacggggcctgatcacaaagataaacttcatggccagggtggacagacccctctcaagagcagccatctcaggaagtttgaagctgcagacagggactgttagcatttgtccatactgggaaccaaggtctccagagcaagcaacaatgaaatccctaaatccaaagggctcatgggcttgttttaaggatcagtgaagaaggacgaagcaaagcattctgtacttcactccagagctaggccagagtgggtggtgggaggagtggaggaggcaaggcagaagtcctggaacctgtggaagaggaaggatgctggggccaagcatagaaagccagggtaggggaagtgggtcctgacacctgctcttacttgcctcactttagtcctagccactgactaagtggtgacatctatctgcacaatggttcaaggcattttttttttttgagacggagtctcgctctgttgcccaggctggagtgcagtggcgtaatctcagctcactgcaagctccgcctcctgggttcacgccattctccttcctcagcctcccaagtagctgggactacaggcgcccgccaccgcgcccggctagtttttgcatttttagtagagacggggtttcaccttgttagccaggatggtctcggtctcctgacctcgtgatccgcccacctcagcctcccaaagtgctgggattacaggcgtgagccaccgcgcccggcggttcaaggcatttaaggagcaccatttaaccattgcctatcagtgggcatgtcagtggcaccctaactgagtgttgctgtttccaaacaatgtggcatgaatgcatctaaagggcaggttatcaatggaaaagcagaccaccacctgggattcactggtataaaataaatgtctcatgcaaatcaaaatgatatgcatttccaaacgtatgtaaatgcataaaaaaggtcttgaaaggccacagcatggactgatgacaggggtcctctcttggggaggactagggttgtaataagtatggagaagcattggaggaaagtgtggtttgtctgtgtggtttcaattttttttttcagcaagtatgttttcaggtacgtcttaggtacattttaaaaacttccatacatctccctgttcttcatgttgctggaggtgcagcccaggatggctgagtggggtggatggctctgttggttaggacatttcataacaggctctttggttatgagatagtctaaatgaaagaggcttgaaaccaaagagggctagcttactctgaaaaggacaccagttttgtgctggcaaccaggcagagagagtctccaagaccctggaatggggaaagagtctagacaagagggagaacacgcccaaagaatggcagacgctggggccccaagggaaacgacggccactgagactttcctatgttgtgtggctcaagcctataatatccaggatggcagaaattctacagtgggttgtttcctgctcagaattgccctatagtccccttagtaatccctaaactcttagaaaaagtctgctgcatggaaaaccttatttgagtggagctttaggaaacaaaggagaatgtgaaatgattaagggcaggtgacaaaactcaaagggagcagaaattcgaggtgatgtaaccaaggcattgtgaaacccctgggggtccctcggaaatcctgggatgggcagtagcttttccgtggtacatgggatggaggcttcagcatgtataatcggccagttgaagagagggactccaaaagactgaagatcctgaggctatgtgagttaatgtaagtaaaaacatgccaattgatttaaaaaaaatcagaaacctataaagaagtaaaaagtgctagcatagcgtttccatccatttggtgtaatacattcactcattaaatactaaactcacgcactgccccctccaactttcccctctgcaattgcatcttatggtctagcttttaaagtaatgcagtacatggagtcagaagcccggagatccataaaccatccagacatctaatagtgctttaaaagaggccctgcacactggagggtaagtggccagtaatggctgagctgggtacagacagggtggggagagggcttggggcttaagggaaaagtgaagtagtgagcataaggagaatttttacagtggctataaaaagaagtcccatgctcgcacatttagattctgagttggccaaataaacccaggcctcttgcagttcacactgtcagccttggcactggttctggtggctactgtcttagagacccagtaaaaatgctttgagagagagaaagacatcaccatctcattgaggagccagtgcaaggatagctcccagaagggcctccctgttaccaggagttacaggcagcaggcagtcctcctgtcaataggctcctggcaggtgatgattactattctgcaccagcctctggttccttggaacataacaatgatgtaggcttctgagcgagggccatgctttgcagtcttggaagggaatgtctgtgtttgcaaaatgctatgacttagggttgctaaccctgtagcccattcccataggaactccagatggaaatgctcacccatcagcactccctaaactacctgctcccaaccagttgctggtgacaaatggaaatgtcctgccccagcactgctctggagaagtcaagacacacttaccagcttcactgcaactctcagtttagatgcaccagggaaggaaggccactccctggctgataaatgtttcactagctctctagggaataaaagccctggtttgcagcatttcctgattcccaggagtaaatactcccacaggctaccaagccatgtcgctgggcatggagttgggaagtagggttcaccatgcggtaatcaatggaaataacctcaagaacacagctaatagtaaaatgtagtcagagaattaggatgtgatgtatctgtgtatttattacctgtgtcttcaataagattttaagtgtatataatttaatttttaatcattgttctatttaataactggcttccattcctgaaaatttggcaactgacactcatgagctagtacatgagctggctccagcaaccactggctgggccctggggccttcttgctttgggttctggatctaatttctttttgtaaattttcttcgtgcttcttcctctcttctctcttccttctctctgggttttttgccccacctccccactttgcccaatttattgagcacttaagacccatactgagtaccttatgtgtaattggaggggcccttgttggggagacttccagtgcatgcccgtacccagttgtgctcttcttttggcatgaaaaggacaacgcttctttctctgtcttccagcagttaggcagagccatatgaccagctctggtcattgggttgtgaatggaagtagcatgagtccatactagactgaagcatttcattgatagtgtgagacttctcaatgctctcctttcctattgcaacaatttggagaaggccttgtgtatagatggcatgggcaaaagattgaggagctcaagtcactgggttaccacatgtggaggatggttgccttcaagagtcagctggatccgtggtgggttttgcatgagtaagaaataagtatttacatgtcaagccacagaattttgttgttgtttgttaatacagcataatctactctatccgaagtaataacttgccttgccgtgaatggccaaacatatgctgttattatcaggaaattctgtattcctcccgtaagcatcctctcccccatcaaaagctttatttgcctaggaatcaccatgtgctacaagtctttttggttagttttgcttagggagttggacattccagtcagcttgaatactatagtagttaggctatagacaaacaaaccaaaatacatggtgattataaaatgaaaatttcagacacttatttctcttaaacataaaagtttagatgttaacaatagttggcaaggtacatccctccatgtgtggcttccacctctgggtccaaggcgtaggacccatttgttactctttcctaaccagaaacgaaaagaaaaggggctgggaaaagggacccaattctttttagctaagaccccaaagtggaacacatcctacaacttctgctcacatctcgttggacaaaaacatagtcacaagaacatatctacctatgagaaaggctgggagatgtagtctccagctggactaatgtgccctgctaacagctggtggtgcatttctgttacagaaagtaagaaagagggaagggatacagggagaaaagacttggtctctgccatgatctattgtgttgtcctggcatgggaggggctctagctgcctggtgtggagaagctgcccggtgtggagaagctgcctggtgcagaggagctcttcccaagcagagtaactcatcctctctgatttcttccatggaatggctgcctgagtggcaggccctttgaagtcatcttaagccattttgtactgctataacagaatattacaaactgggaaatttataaacaatagaagtttatttgtctcacagttttggaggctggaaaggccaagatcaaggggctgtgtctggtaagggttttcttgctgcatcaccccatggcagaaagttgaaggacaagagagagcatttaagtgagagagcagaagagcaagggatctataataaagggattaaggccacaagttcaaaggcattaacccattaatgaagctggagccctcatgacctaaatactttccattaggccctacctgtcaacactgttgcattggggattaggtttctagcacatacttttgggggacacattcaaactgtaacaggggtgtaggtgatttcacttctctagtattatggctccaacccaaggaccccaaagtcctagtgctgcttgtttctttccccagctttggtttgggtgagaatctgctcccatgaggattcctgccatggaggggcacaggcagggggcaggaagcacttgtcagactgtctgcagggtgatggccaaggagtggtagggtgtgtgagctctggagtcagagtttcttgggcaaggtgcttaatcttttctacctcagctgtagaaaagagtaagcaccttctgttactgatgataataatgataccaagctcataggattgctgagattattaaaggagatattgatgtaaatgtgcttagcatagtgctttaataaccattagctattgctgctactactactactattactgctgctgctactactgcagttatctggttgctactaggggatagagtgaccagttctttcgcatatagttgcttgtgcaaggtggagctcttcactacaaagagtggttatagcaggctccaggatgccttgtgtcctaaacctagaactattctctcccatttctcccttaatactctgtactgagcagcctgctgttctgtttctgctctcaagatacctttgtttcaagattgttcacacccttctctgacactgggctttcacaggtaccagctccaggtctcagagaggagttgggctctcagtccattcttcccaggagggtctctgggtgctttctgcaaattgattttcccactgtctaaagttctggacgcctaagggattatctgtctttgccatattaaataaaagtcctattatacctttcctttttcccagaagtgggtagtctgtcggcctgacaatttatataacaaggatagcatgaggtggtccctgccccaacccagacagagatgccgttgtcagctattctaaaaccaataaaccaaccaacaaaatataacaatgacaagacaaaatttttgtacaaaagcctgttggaccacccattacaagatttatctcatgtgatcctcacagcaaacctctgagattggtatcatagagccaggtctatttaaatataaaatattgccttgctctggtcattaaattgctcacaccaacctatgtagacagaactaacacaagggaaggaagaaaactttacatacctaacagcttatctgtaaggttttgagaaacattcttatcatagataggactcttatagatgcaaaagacaaactcaaaatcaaatggattaaacaaaacctgcaattttttggctcaataacagtgaaatccaggagtacctggtttcatgtatgtcaggacccaggtgctcaggtgatgtcctcattgttctgccttttcttctttctgctctccctacggtggcttcattttcaagctcaccctctctccatggtggtccccgaaactccagtgccacaggctaccagttccaattcagaagaaagagggcttctctttccccatagcttcagagaaaatccaagggttgtgactccaacaaagattctctccttgaacaaactctatgcagactcccctgaactctcttctcaactgagctctgacatttgggcgtccgtgtttacctctgcagtgtccaattttggtaagaatcctgctaggccagttcccctaatctaatcatatctacagaggttcttcatactctaccatcttctcggtgatgtatgatcaccatggttgccttcagcatgaattctgtttggtcagtttagccaggattctctttacctctgatgtttctgctaagtagttttctatccactgatctccaccttgctccttggctatacattcccactcttccttgtattcagagttgagcccaatctctctccattgcaaaatcttattgcagtggtccttacacctatcataatggtcctgactaaagtctgccttaccatctttaacaagtgtcaaaaacaattgcttttcagaactcattggctcattgagccttgctgaatccatatgggccatgtacttaccccagaatctagggggaattgggagagagtgaatagaaatgggaaggatgcccctaataaaaggaaccagaaagtaaatcaaaatcagcagatgaatctggatgcacctatacaaaatgaaatgatgacaggacatattttgattccctgcaatataaaatgaatttatctcagttcctttaattcagggattcttgcttttggctgcatatcggtctttaaaatccggaggcttaggccacatcccagactcaggaaaccagaatctctgggaggagggtctaggcatcaaaattttaaaaaaatgaattttaggtgaggaggagcttcaagttggctgactagaggcacggaacaccccttcttctccacaaagaaccaacaaaataatgactagataataacactttgaacagaacaactgagaactctggaattcagcatcgaagtgacaggaaaaagctgaggtgcctaaggaaaaggaagtgaggcagacggcctggctgggatcagccaggagcctggagaaactctccagtctggaagaagagtacatgagagatctccagtggtccacattcctactgtggactcccgcagtcctagccataggagagtccttctacctgtgggccctgagactggtatagggagctccctggagtccacatgacaacattgctgcagataggaagtacgcactgggtcccacacgcctgtattcgtccgttttcacactactataaaaatactacccgagactgggtaatttataaagaaaagaggtttaattgactcatagttccacatgggtggggaagcctcaggaaacttacagtcatggcggaaggagaagcaggcactttcttcacaaggtggcaggagacagtgtgtgtatgtgagtacaggaaaaactaccatttataaaactatcagatcttataagaattcactatcataagaacagcatgggggtaaccacccccataatccaatcactcctttccttgatacatagggattacaggtctctccctcaacacatggggattacaattcaagttgagctttagatggggacacagagccaaaccatatcacccccctaagactcaagcagctgcagaacggtaccattttgagagctcagcccctaccagactgtatccccttccccagggcccaacagcctctgcctgtccatatccctggagacccactgacatctacctgcatccacccagagggccgcagtggtgtgatgcaggtggacccagtggaacagcagggttcccagcactctagcctactctgtcctgtgtgttggggaaagggcagagcagtgcactgaggaggctgtcccctagacaaaaggaggtgaagtgtgcatgccccagagcttgaaacctgtctgcctggggccaccgtcactgacagcaaccttaccccaccagcagcttaacaacagcacacttccatgtgccctgaggatagcctctctcagccagccaccacaggcagggacctgaacgtacacactccccagagcctgagagccacctgtctggggtagctaccacagacagcaactctgtctcccttccctagcagcaggggccccaaggacttgcatgtgccctgaggacaggctttccctgcccactgctgctgctgccactaccacctgagcacactgcccagggcctggggatcaccctgtcctgcccaccgaagcctttgcccatgtacaccattgaggggacctgggaacaggtctgccctgcctggcactgctctcccagcccctgagcatgctgcctaggagccagagtattgccccaccctgtcagttgttctcagagcacatgcataccaccagtgggcccaacaacaagcccagaaaacctgccaccagcacccaagcatgccatttggtccaccattgctggcatctggacactcctcctgggggccttgaggatgggcccacccagcctgctctaccaccactgctgatacccacccacacatgccacctaggggcctggggactggccctcccagccaccattaacaccagtgaatgacatcttggagcccaaaggctgttgcaccaccactactatcattgcccacaccaagcatgtggcccaggggctcaaggactctcccacctacccagtccaccaccgacactaccagcacccaagcaaacctcctagaggcccaagagtgagcctgcctggacctgctaacaccaatgctcatgtatgccacctggcagcccaaagacagaccttcctaggccactgctgccaccattagagcctgaggactggcccatctggtgttctgtccccagcaaaacttcaccacagccaccactagcagccatagcctaagccactaagaaaatcacagataccactgataatgtttgcaaccaaagacatcatacacagactacactacggcacacaccccgaatcaaagccaaagtgcattactcaactaacactgtaggggaggactttttcctgttaaaaagtcttcccctaagaaaaccaatccaaggctggatgtggtggtttatgcctgtaaaccagcagtttgggaggcggaggtgggtggatcacctgaagtcaggagtttgagaccagtctggccaacatggtgaaatccagtctctactaaaaatacaaaaatcagccagatgcagtggcatgcgcttgtagtcccagctacttgggaggctaaggctggagaattgcttgaacccaggaggcagacattgcagtgagctgagattgtgccactgctctccagcctgggtgacagagtgagactccatctcaaaaaaaagaaaagaaaaaaagaaaagaaaagaaaagaaaaagaaaaaagaaaatcaatccaaaaaattggaagaagtcattgttataccacatagggagatatcaatgaaaggacacaaacaagaaaaagggaatatgacagttccaaaggaggacagtaattctccagcaacaggttccaatgaaaagaaatttatgaaatgcctggaaaataattcaaggtaatgatattaaagaagctcagtgaaatataagaaagcacagatatataatataaaaaataagaaaaacaattcagggtatgaatgagaaatttcactgaaaagaaagatgcaaaaaagaaccaagagaaatcctggaactggaagattcaatgaatgaaataaaaaatacaatcaagaacttcagcaatagactggaatcaagcagaagaaagaatttcataacttgaagacacgtcttttgaaatacctcagccagacaagaaaaaaataaagaataaaaaaaattaagaacacctacgtgacacatgggacatcataaaatgaccaaatattctaattttgggtgttccaaaaggtgaagagaagtttaatagcatagaaaatctatttaacaaaataatagctgaaaacatcccaaatgtagtaagagatttagacatccagacacaagaagctcagctatccccaaatagatataacccaaaaaggtcttccaggcacattatagtctgtcagaagtaaaaggccaggtatagtggctcacgcctgtaattgtagcactttgggaagtcaaggtgggcagattgcttgagcccaggagtttgagaccagcctgggcaacatgacaataccccatctctacaaaatatacgaaaaattaaccaggcatggtggcacatgcctgtagtcccagctacttaggaagctgaggtgggaggatcacttgagcccagggaggtcaaggttgcagtgagtggtgatcatgccattgcactccagcctggatgacagaatgagaccttatcttaaaaaaaaaaaaaaaaaaaaaaggcaaagacaaagagaattctaaaagcagcaagagaaaagcatctagtgacatataagagaatcctcatcaaaccaacagtggatttctcagcagaaaccttacaggccatgagagaatgggatgatatattcaaagtactaaaagaagagaaaaaactatcagccaaaaatactatacccaacagttatccttcataaataaaggagaaattgagacttatccagcaagcaaaaactgaggaaattcatcaccacaacaatcagtcctacaagaaatgcttaagggagtcctacacctgaaagtgaaaccataatatctaccatcataaaatcacacaaaagtataaaactcactagtagagcaaacacaagtgagaaagagaaagaactcaaatgttaccactatagaaaaccaccaaaccaatgataagtaataaaagaagaaaaataaagaaaaggatatataaaacaaggaaacaacataatgacaagaataagccctcacatatcaataataaccttgaatgtaaatggactaattttccacttaagaggtttagactagctgaatggattaaaaaacataatcctactatatcctgcctacaagaaactcactttgcctgtaaagatacatatagactgaaagtaaatggatgggggaaaaaattccatgcaaacagaagccaaaagcaagaaggaatagctatacttatatcagataaaacaggctttaagtcaaaaacagttcttaaaaaaaagacaaagaatgtcattatataatgataaagggatcaattcagccataggatataacaattctaaatgtatatgtgtccagtgcagagcactcagctgtataaaacaaatattattagttctacaggaaaagctagactccaatacaatcatagttggggacgtcaacatcccactcttagcattagatagatcatctagaaagaaaagcaacaaagcaacattggatttaaactgcattttaaacaaaatagacctaacacacctttgcagaacatttcattcaacagctacagaatacacattcttatcagtaccacacggaacattctccaggatagatcatatattaggccacaaaacaagtgccaacacatttttttaaattgaaatcatatcaagtatcctctcagtccatactggaataaaactagaaatcaataacaagaggaacttgggaaactgtacaaataaatagaaattaaacaacatgctcctgaatgaccacagggtcaatgaagaaattaagaaggaaatacaaaaatgtctagaaacaaatgaacattgaaacacaacacaccaaaaccaatgagatacaacaaaagcagtgctataagagaagtttatagcaataaacacgtatatccaaaaaggagaaagatttcacaaaaccaaaagatgcacctcaaggaactagaaaagcaagactaaatcaagcccaaaattagtagaaggaaggaaatgacaaagatcagagcagaactaaagaaacactaaaaaaaatacaaagggtcaaaaaaaaagttgttttttaaaaaagataaaattgataaactgctagctaaactaaccaagaaaaaaatgaagacccaaataaaataaaaaatgaaagaggagacatcacaactacaccacagaaatataaaagatcatcagagactactatgaacaactatatgttaacaaactgaaaaacctggaggaaatggataaattcctggatacatacaatgtaccaagatttaataaggaagaaatagaaaatctgaacagaccaataatgagaaacaacattgaatcagtaataaaaagtctctcaacaaagaaaagcctaggacgtaatggtttcactgccaaattccaccatacccaaagaattaacaccaatctccttgaagtattcccaaaaaatgaggaggaaattctaactcatttattgaggtctgccttaccctgataccagaaccggataatgacacattgaaaaaagaaaactagaggccaatattcctgatgaacatagatgcaaaaattctaaaaaaaaaaaatactggcaaaacaaatcgaacagcacaggaaaaggtaatacaccatgatcaagagggatttatcccagggataaaataatggtccagcatacactaatcaataaatgtgatacatcacattagcagaataaaagacaaaaaccacatggccttctcagtggatgcagaaaaaatatttgatgaaattcaacatctgttcatgataaaaactctcaacaaactaggcatagaaggaacataccttaatacaataaaggtcatatatgacagacccacagctaacattatgctgaatgggaaaaagccgaaagaccttcctctaagaatttggatcctcaatcaaatactatttggccataaaaaagaatgaagccagccgggcatggtggctcacatctgtaatcccagcactttgggaggccgaggtgggtggatcacctgaggtcaggagttcaagaccagcctggccaatgtggtgaaaccccgtctctaccaaaaatacaaaaattagccaggcgtggtggcgggcccctgtaatcctagctactccagaagttgaggtaggagaatcacttgaacccgggaggcagaggttgcagtgagctgagatggtggcattgcactccagcctgggcaacagagtgagactccatctcaaaaaaaaaaaaaaaaaaagaaatgaagccatgtcacttgtggcaacatggatggaactggagatcattatgttaagtgatatttgtcacacagtaagacaaatatcacatataatcactcatatgtgagagctaaaaaaataggttgatcttacggcggtagagagtagaatgacagttactacaggctgggaaggatgtgggtgtgggagatgaagagaggtttgttaatagatacaaatatacagttagatagaaggaataagttcttagactgtgaatttcttaagagaaaaaaagaaggaataagttctaatgtttgatagtagaatagggtgactgtaattaacaacaatgtattacatatttcaaaatagctgaaagcaaagacttgaaatgttcccaacacacagaaatgataaatgtttgaagtgatggatatccttaacaccctgacttgatcattacacattctatgcatgtaacaaaatatcagatgtatcccataaatatgtaaaaatattatgtattaataaaaataaataaaaattttaaaaattttaggtaatttataacgtgcagccagggttgaaagccagtgctccaatttcctggtctttattattaaaacccatggtttatgaatacattacgctaaagtccaacacagcagttctgggtgctgttgtgagccatggtaaacaaggggtgtatctgagccccagctctccagtgatcagcaaggacaggccacctgtgcctccaggggcagcctctgtagagtcacagatcctctcagtgcggagaacctgtcttggttcctcaaggggaaccaagggaagatattccagagggctcataggtcagggacctggtcactatcctttcagcacagctgtagccctctgtgggcccagggaagcctgatgccagctgccccagggtaaagccttggcagatgccaagtgggagaaggaggtggtgttccctcggggagagggggaaatgctacacagagcaacatgggattcatctgcagaagagaggtcaattgcttaccctactggaaccaaaaagtctcttggcaaagggagttctgagctgataaacacaggctcagtcttccagaatccacactgcaggctgagaactggaaagacagtagggagacttattgctttctgggtgttttgcccagaatctcccttctggtaaagcactagggtgggtagtaggactcactctttgatctttggcaagtccctcctactctctgggcctcggtttcccttctatataatgaaggagttgaatcagctcacccttaaggtctcttctggatgctgttgcagggtctacatgattcctgatgaatgatttcccctggagaagctgcacatctgtgctctgccccagtatttgtctggaaggtggaatttcaagctgcctcctggacttgtcctttcctttcagattccaaggccactgccctgtctgatggtcatccagtcctgattcacttccctcatctgagtccctggtgatccatcctccaggaagctcagcctcacctcaggtcctacagaatttaaatggcctcatcactcgcactccagggaggtgtggtgtggaatcttcctcaaggaccctgggttttaagcagcactggtgtcaccctctgttgccagcctaaggctgtccccaaggtccaggatctcagggcagctctgctgatctacagatttctctggacccacaggactgttataagtttgaggatgcagattggggtctgcttgtctcctcccaaaggctgatcctcccaggctcaggcctcctgaatgagcatccctatcagtccttcactgagtttcctacccctttccctacccagaatacttttctcatttggaaccctggacataacacaggcctttcttgtccccctcatatatgattcacttcaacagcctcctaacctgtttccttaaggctctctttcttctaccccctacaccatactacagattcatctccctaaaacagtcctgccttgggttagctggcactttgctcaaaaaccttcaatgggacatgaagacctctgtgctcagttcaaattctctgccaaccatttggggcccagaggcctagagcttcctggtttagggagccccttctgtgcatccaggtgaccccaccccgcggtgtggcagtcttgtctatctgcttcattgtcttaggctgtgtgtgcttccccagcttggaatgtcctccactctctccctccattttaaaaattccatcatccagccaggcacggtggctcacacctgtaatcctagcactttgggaggccgaggcgggaggattacctgaggtcaggagttcgagacaagcctggccaacatggcaaaaccctgtctctactaaaaatacaaaaattagctgggcatggtggcacacacctgtagtcccagctactcaggtggctgaggcaggagaatctcttgaacctaggagatggaggttgcagtgagctgagattgagccattgcactccagcctggggaacaagagcgaaactatctcaaaaaaaaaaaaaaaaaagcaaaacaaaaacaaaaaaaaccccattaaattaaaaataaataaataaataaacaaaaattccatcatccattcaagattcctgctctgtccctacctctgccaaaagtctgttcagactattccagcacatactggtctcttcatccttttgtttcttttctgactccatcagtaccactatttcagttgtacttgaagatactgagctccttgagggtggaaactgtaacttatacttgttttgtgtcccatgatgatgcctagcaccagggctttgtgcacagtggggtgggagacactcatggctgcccacgcaacagcatggctttcttgctgaccaatcagcctctactacaggagggtgttgaggagggaacctgaaagctgcatttgccagcctcccatgtacaaggacagggatgcatgatccactccttgcactggagcctgaagggagttctgacgggaggtgtgggagagattctttcctgtgtgaggcaggaaactcccctacatctcaatccatgcaaatcagtagggaaccaataacagttcctacctcctcccagccttgagctaggaccactgaactacagcatcccccgaggctcattgtaagctggtgagacctcagaaacaagacctagaagctcataaatacacagggcttggttttgtttcatttctgatagttcatcgagtcaatgaccaacaattaatgctttagaagaagataacagtctctgataatggacctacccactcatataattctggaaaatatgccttcctgacccctccaggcaatcagctcataccatgaaatatgaaatccacgcatgcataactgtgaatgttattaacaatcataaaaccatgcaactccttcggaaatccaagccttatttccaatacaaattaccccctgccacagactgggttattcaggatagaaagaagtatttcctttcctttgttaaaatttacgagtcattaattctactgaatgagaggcttctcatattatagacaagttgaagcttttttcctgaggggagagctgcatatggaaagttccctgtttgggtctagagatgtccagcaacagtctttgataacctagaagagttcactgtcggttccattaatacccatctgtaagtacaagttggtaccttggctgagtaggagctgggacctgtatgctcatgggtagcggggtgaggcaacacatcaactcttacccccaacccagtatctacttgcaagcactgatcaaaatgatcgggaaatagtttggtaaactctgggatagcacataggttgcctgaccatactccactgattcccagtgttctgggagctccctctcctttaacccctcatactgccactgtttacatttcaataggagcagacaagttcctgctgtacgactctggtcatcttccccactgttgaatggatcagcacctgatcaaaactgggtcaatcaattaagacatcttcccaaatatttgaaactagaactaaaagagatcagcttctccctgaacttcctggacaagtaaactcaggagtggtccacggccatgttttctgcaaaagaccatatacaaaaacagagaaggaaagagggaaacagatgcaagttggagggaaggggtgctgttggcttcctaccccctattctagtctctattcataatctagatctgaggtctggctgtgtctcttcctttagtttccaggaaacatccctgatcccataacaaatttccttcattaaaaaaaaaaattgacactcactcaagtggatttttgtgattttctaccaaaacactccaaatacacataacattgggcattatataactgttaaaagtttgcatataggcctaggtatggtggctcatgcctatactccagcactttgggaggctgagattaaagaatcacctgagcccaggagttcaaatcagcctaggcaacatagtgagaccatgtctctacaaaaaaatattaaaattagccaagtgtggtggcatatacctgtagtctcagctactcaggaagctgaggtgggaggatcacttgagtcagggaagttgaggctgcagtgagctgtgataccactgcactccagcctgggtgatggaacgagaccctatctaaataaaacaaaaatttgcttataaataatttttagtatcaagggagatggcttctgacatcatgataggtcattaaaaatcaagctataaaattatattaagtgcaatcttaacaatataaaacaacggaggagttaaaaaccatcaaaacattatttgtgattatgtatttcttttttgagacagggtctcgctctttgcccaggctggagtgcagtggtgtgatcccggctgactgacacctccacctcccaggctcaaacaattctccttcctcagcctccagagtagctgggattacaggtgcatgccaccacacctggcttatttttgtatttttagtaaagatggggctttgccatgttggccaggctagtgttgaacacctggcctcaagtgatctgcctgccttgacctcccaaagtgctaagattataggcatgagccaccatgccccgcctatttgtgattctttctaagtagtgggattgcaggtgagttttattttcttcactgggtcttttttctctatgtactttacacattttttataaaaagtatgtattaattttataatcataaaatcagatttgtttaaaagtcaacatatttaagaatctttccctgcttccttctcctttcccaaaaagtctgcagcggaagacccagtttgagtccaagtgtgttcaccaacaaaatgtaaccatgtctagagaacttggagggatctgttggcatgagggggtaggagcctgctagtaaaaaactcactcacacaagagtccagataccaagttggcccactgatggaaccttggttttcaagtgaggtgtaattccatgtatagctgagtgtccatccctcagacctgctccagccagtctcctgtggctgagggcacagcaagagagtgtgaattagaacggaaagtgctctttcactgaaaatttagggacactaaggggtatgcacagctttcacttggggttcttccaatagagcataacatttcaaggagtacagatactgtacctcttgctcattttgctatagaccactataccgccttgacactatggggcctggggtattggcactggtgtggatgatggtgacaacaaggcatggcagaggtggcagcatccaggagtagcagcagtcatgcatgtgagctacagcagatacagtgacagcttctaattaatgcagaggaatggaagagtcccacagatctgcagtgatgtccagcaaaggccaatgttcagtgggaaggcaggttcagtgttagaaggacaggagtagagaaaacagaataggagggaaggaacaaaatgttagtagctgactggatggctgaatggaaagctgcaagctaaagctaccccagaaacccttagtagacggctaatgccttgttaagaattttaccacctggccattcctgctaaagaggttggaaaagcaagtcttcaactttcccttttttttttttttttatacggagtctcgctctgttgcccaggctggagtgcaatggcacggtctctgttcactgcaacctccgcctcccgggttcaaacgattctcctgccccagcctcctgagtagctgggattacaggtgcctgccaccacgcccagttaatttttgtatttttagtagagatggtgtttcaccatattggccaggctggtctcgaactcctgaccttgtgatctgcctgcctcagcctcccaaagtgctgggattacaggcatgagccactgggcccggccaacttttccattcttaatctagaagtaagcaaggaggagggagtattcagactgagtattgacttgataaaggtgattaaaaagtcagtatcagattagggctgggcaccgtggcttatgcctttaatcccagcaatttgggaggccaaggtagaaggatccttgaccccagaagtttaaggctgcagtgagatatgattgcaccacagcatgccaacctaggtgacagagtaaggcctcatctctaaaaaaaatttttttagttaaaaataatcagtatcagattaaatacaggcaggtattatggggaaaatctagaagggttctgcattcagatttggcttatgaaacataaaaagaaaatatcttatccctatatcaaaagatagtgaatggacattcatttatatattttaagttaaaatatttaacacacgcttatgtcattctttataataccccacagtaactggcaatttccaacttgtcaactatagatcctatcacaactggtagactgagcagacttctattacatccttcttattttgaaaatagctttattcttttaaagatttaggcttattataaatattgtgatcatacagaaatgtacaaagaacaaagcaaaattcagctgttagggtgaacatccttccagacatccctccatgtgcacctattaaaatattatacaaatgggatcatgctgttctgttatcccttttttgcactcaattatacatgtcataggcaaattttcatgtcatcaaatctacatcatcatttatatattgtctatatggaagtgccttaatttctttatattttttaaaccaatgatttaaccttattgataaccatccacttttcactgttataaacaaggctgagatggaaagacttgtctttagatctccatttgttttggcaatgattgtccgggggtaaattacaagaagtgagatcactgggtcaaaggtacactcatttgaaatgttcattcctgccagcccagtggactgcagaaaggctgggccaatttatgtcaccaccagcagagcataaaagggccgggctccagcccctcaccagtccgagattttgtcattcttctgtttcctagagtaaaacttcagaaggattctcttcatccatcttttgtctactatgttcttttttgtagatgcttttttgcataggtttcatgctgagtttttttctgcctatctttaatggagagcagttctctcagggtttaccatctgcttgaaaatggtatgcatgaaatctccttgactccttttcctgttggtttggttactatccgaatcttcacttagcatttaagttggaaggctagaatctaatcatgattttcccctgtttatttgccagaaagacttggtgaaggcatagaaccttgatttatctcctaaattgttgccatttctgctacctggacaacttggtcaagttggagaagtctgggttttgccttgtctcccctcttctgggtaggctaatgagaggtgcgtgagcaatgccaggtggttcgtaaagtgaatctgcttctcttttaaaaagagagtgagccaattgagacaaacacaggcaaaaacccagctgcagcaacatcctcctggctaattggatcctacctgggaagggccatcttctagatagcttgttcccaagcagtgttcccagctggcccctcaggaagtattaggcctgtccttggctaatcccacagtttagcgttgacataattctatctgacccagtctccagaaagactcaaagacttctcagctaatagctctgtcctaacatctagaaccacaccctcaaagatgagatggtacccctgatttccacaatcctctcctttgggacacagagcataccatccctgactgcaccagacatagttattctctgcccatgggctactctttcttctcaggaggcctcagggcaactgtggggtctcctgagaaagccatctgtaggtaatgggaccaggactatcagaggatatcatctatgaccacagtaggtgggcaagaagcagagttagttccctgttcagaatcagagccccaagagactggcaggacattcctgtgagaatcacagtttgttttaggaatctcaccagccacttaagaaaatacagatggccaagagcaccccaggaccaaggtcattgactgattcagtaatacctcttggccttccacctctgtatgaatttgttattgctgccaggacaaattaccacaaatgtgagagcttaaaaaaaacacccatttattatttcacagtttgcaggtctggagtttgacatgggtctcactaggctacaaggtgtcagcgggctgttttccttactggaggagggtcacttacaggttcatgaaggttgctggcagtgtccagttgtatgtggttgtagcactggggtccttatttccttggtggctattggccctgggtcattctcagcttttagaagccatccacattccttcacgttctccttatctttgaagccagcaatagagagtcaagtccttcttgtgccttacctttcctgtcttctcttctgctgtatctcttcaactaggaaagattcttctccttttttttttttttgagacagagtctcgctctgtcgctcaggctggagtacagtggcgcgatctcaatcttggctcactgcaaccttcacctcccaggttcaagcaattctccttgcctccacctcccaagtagctgggattacaagtgcccacaaccaccgcccccaactaatttttgtatttttagtagagatggggtttcaccatattggccaggctgttcttgaactcccggcctcaagtaatctgcctgagttgacctcccaaagtgctgggattacaggtgtgagccaccgtgcctggccaattcttccacttttaagggttcatgtgattacacagagcctacctggctaatccaggataatcttcccatcttttttttttttttcttttttttgagacagagtctctctctgtcacccaggcgggagtgcaatggcaggatctcagctcactgcaacctccacctcccggcttcaagcaattctcatgcctcagcctcccgagtacctgggattacaggcacccacaaccacgccccactgatttttgtaatttcagtagaagtggggtttcgtcatattggccaggctggtcttgaactcctggcctcaggtaatccaccagccttggcatcccaaagtgctgtgattataggcgtgaaccaccacacctggcccatcttaagatctataaccttaattgtatctgtaaagtctccttgccatgcaaatttaatatattcacaggttccagggatgaggcaaggacatctttggggccattattcagcttaccatggcccttttggccaagagtcatccaggagtaagagcccggcagagataattccaaggaagacccacatgatttcctctcctccatccccctcccacaacacacccatccctgggaaccagttggccagatcttccagctgaatacttcaccagactcatgccacaatgcatcactatcaaggcgaggctgagcacctggcacagccaactccctctggagagctggggcaaggctggtactttcaacccaagccctgagtggcctgtctgctcactgctgtttcctgaagctcagccaatatgcctaggaggatcccaaggattttgggcttcagtccaatatgcctataagcagaaggctctgctttccctttgcaggagacggttagaggcttgggttagggtctcggtggaattataaatagtataatggcattactgctagggacccaggaaggctaaaatattgtcctgccaatcattcagcaccccttggcatctcatataaggaggaataaaaggatgtaaattaaaaatgtctttttttttttttttgctagccttattggtagctgaaatgtcaatgcaaaagctggagaaagaacgactgtatcaggtggctggttccccactctccctcctcttgaagctaaatctggtggcagcacacacaagtatacatgctaaggagagagcagggcccaactgaacttacttattgactacatatccaggaacagagaggcatggccaggccctcactgagatggcaacacaacctgggtctgctcaccacatacaggaaggaagcaaaagcacaggaagccccaaagaccgagaccttcctaggaccaaagcgggatagaggagaaaaggtgttgcctttaatgtacagtgacctggtggtttaccagtaaaatgtggcccagtgaatattctggactctgacctgtcagattagcacctgttcttcctttgggcagggaggggagctaggaaggcgttagaaagaggctgtgctggtgtgtgcagagtagacagtggggggtttcactagtgcctgcctttgtctgcttctggtctcaacccagtggctgcccctaggtttctggggatggatgatgagagtactgttgacccatgcgcttgtgagccaggcaccttggtaatcagatgcccagcggctgtgagttgtagctgaccacgcccaccagaggaagaatatatcacccagggaaggccatttaaccagagacatgcaatggtgtagccactctgagaccttctgatctacaatgctggggtgagctgctccccgaaatgcccagatatcctaaactcctgagattcaaaagaccatgcagactcttttgcaccatatttctgtgcggagatctttctggcttggatttggggaattcagacagtttcccatgttcaaagaattatcaagattctctccaggaagatttcactgatgcccaggtcagagtttgatgtcctacctggtgctttcctgcctgccccatactgcactgaaatcaccttctgttggtctgtcttgccgagaccagctcagttgtggagaccctaacccagcagtgctagaggaattaaagacacacacacacagaaatacagaggtgtggagtgggaaatcagggttctcacagccttcagagctgagagccttgaacagagatttacccacatatttattgagagcaagccagtgataagcattgtttctatagattatagattagctaaaagtattccttacaggaaataaagggatgggctgaaataaagggatgggtttggctagttatctgcagcaggagcatgtccttaaggcacagatcgctcatgctattgtttgtggtttaagaacgcctttaagcggttttctgccctgggtgggccaggtgttccttgccctcattctggtaaacccacaaccttcagcgtgggcatcatggccatcacgaacatgtcacagtgctgcagagattttgtttatggccagttttgggggcagtttgtggccagattcgggggcctgttcccaacactgtctcctctaataaactgtgaattccttgaagccagggactgcttttttctccattttcttccctggcctagtgtaggatgtcacacagtaggggcttagctagtggctgatggtggacgctaaatgattgaaatagctatcctaccccaaccagtcccaggctgggttcctggcacaggctggcatttgtacatgaacaccatggctgcttgttccactgtggcctcagctcccacagcaagtttctcctacagctgaacctggctggaaatgcaggcataagagcccccggagggagccagtagtcatcacagccaaaggtctttgggaagccttcattaccatctgggtatgccttgccaatctcgagctccccaggcttggcactttttaggacagcctttgtcatggtctgacagacatgacagctctccctgtctcacactatctgatccagtcatattgagctttcatattggaactctctaggacctactcaacctaggcaggcagatctcttttatttcatcacattgttgaagatgccagaactttgggactaatgattgatcttagaggttggaatgcacagccagcctgccagtcagatctcctcctggtactttgctgcccttcctcttgtctcgacctctgtctgctccactgatgcccatcacttggtcctttcatccgagaaagaataagaatggaatcaggtgctttgtagagtccactttataaaagaatgggaagagcttttaaaaattccctaccaagcttgacccactaggcaataactcttactcaatctcattgcttcatgaaatttcattgactccctgcaccctccatctccctgctccaccctaggctacttccttggcactgatcttattccaaggactgggccaggcccatgggtacacatagctaaccattccccagtccctggctttcagccaccatccaaggctggttccctgctctccccagcacttctccagttctactctgatttgggccatatagatggaaaagggatcagctgggtgactaggcaggtaatgaatcccaggactgtaggacacttattgacacaacactggggtagtggagactcacagaaaatacagaaagccttctactttttcatctaccttccctgttctccaactgagtataatttcatcatctgctcagattggaagtcatatggcctccttgtttgtttttctcatcttactttacccatagttttggtaagaaattggtgaggagggttggctcttggaggtttttgagctaaagatgacatgatcagagttgctctgtggtaaaactatgtgaggatggaggaagctgaagaccagtttgaggttactcatgtaggtcaagtgagggatctaaacttgaatagaagtagggtatgacaacatggggacgttgatggtacaacaggtgcaaaatattgtggaacaagaactgctagaggtaagagggattggatgtgaaatttgtggagggaagaatctgtgaaaacactaagattaacagcttggataattaggactgtggtggtgacattaacaaaacactgaacacaagtaatatatgtttctagggtttctttctttctttctttctttctttttttttgagatggagtttcactcttgttgcccagactggagggcaatggcacaaccttggctcactgcaaactccgcctcccaggttcaagctattctcctgcctcagcctcccaagtagctgggattatgggcacctgccaccatgcctggctaattttttgtacttttagtagagactgggtttcaccatgttggccaggctggtctcaaactcctgacctcaggtgatccatccacctaggcctcctaaaatgctgagattacaggtgtgagccaccatgcccggcctaggggatcattttgagctcattttgtgatctactgagtttgagtaggatctccagacatagcattctaggaagcaaagaggaatactgggcatcaatttgagagagaggaagatcacagttatagctacagacatcatctacatagagagaacacttaaacataaaacagaatgaaagctgcaaaggaaaaattatcaggctgtcccctctgcctggaatgccctttcttctcatacctgctgctgcaggtatgcattgttggatgacaaccctaaaacttagtggctttaaacaacaattattttatagtaaactttcatggttttgagggttgactggccttagtagggtgcttcttgctcagaatgtctcaagtaactatcaccagtcaagttcttacggctgaaataatctcgatctctcttcctctcttctgtttctccagcatggtggctcaggaagtcagggtagccagacttctcacatggaggctccaaacacatgtcacaagtgagctaccgcaaggaggaagctgtatctccttttatgacctagcctcagaagtcaggcagcattacttctgccacattctactcttcagagaggcagtcataaaagctcactcagggtcaaggggtggggatataggctctacctttagatgggtaagtggaaagtttctataaggtcatgtgggactggaaattttttttattcattctgggaaaatctgtcttctcttccaaaactcaatacaagaaaccatcccaaatcctcatgcttggtataactgccactcttcagtagccttccagcattttacatcctatgacaatgtttagcactacaggcatcgtcatctggttatacatgtagccatctgactcaattgtaagcttctataagtcaagacccgggtctcgctctgttttggtggagtgcaaagtagcaggtagatctagattgttgatttaaatttaattccaaaaataggagaagactgtatgtggaaggttagtgaaagctgtatttgagacacaggaaacgaaataggccatggagacttcgaggggagttttttcaaaaccaaaccataatagtcttggcaaaaatattgtggacattttccttacctatgaaaactgtcgctgaataaaattaaccatatctatgataattagcaacaacaaaaacccctccacaattaatgctttgtaagcaatagctactgaacaagtttcttattttcataacagggaacttctgaatagtcaaaccttagaagaaatcctaaccataaaacagaaccaaatttgcaaggattgttttcccatccaaaacttatggtataataaggcataccataatcaaatttatcaatgattaaataatcttaaaataagactaagataccattttttgcctatcaaattgggagagcttttaaaaatattcgtaaaatggcccaatgccaccaaatgaacgttcagacatttctgacagacgggagacttggccaagccttctggaagataaagagctgttaagagttcgctccctttcattcaggaattccagcactagaaatttattctaagaaaataatcctgggtagggcaaaaattcatatcgaggatgctcaacaaagtatatgttatgatagcaaaatgctggaaacaactaaatattcaaatagagcttggttaaatagattatgattaattcacttgctgaaacattatgcagctatttaaaaaataacatttttgaaaactcttttctagtacaagagcatgcttacaaattgatgttctctgtaaataaaacagaatacaaactgcacaaattataggaagtagtatgatcccaattttgtttaaaaattatatatgtatcgagaaaagactaaaagcacattccacaaaatgttaacagtagttatgtcagagtgatagaattataggacgtttaaatttttttccctatgcttttctgacttttttttttttaacaataaacatgtaatacttttgtaaccaaggagaaaaatgtattttttgaaaaaaccccaggaattgcttctgtgactagctaggtaattaacaaaatggagggaatgttttcctggaaaaaaaattaagtaatttatgatgaagttcttggtatagaataactcacactttcaaaaaaacctaacatgcaagaaagcagcctggacacagacagaagcgctatctgtgaggcgtgaaatttcacacatgccaaagcctgcacaggtcccacagtgtatttcctttaatgacacatgggaacttgtaagttctctggctgcaactaagacagattctaatgggcggcaggagtgctaagctgtgcctttctggttctaccccacacttctctaccccacaacaaggaacaagttgattaacctctttgagctcctcaagtccctctctgatatggaaatccactaacatcaatagggcgcctaagggcaaaagtggaagaaaataaacactacaaataagatggctttagatagaagcccaggccagtgcaacagggacattacacagctgtctccaactgaactgccaacacccttggctgagagtctgcccagggtctcgtttcatactcctctcattgtaacactgctgtaggtacccagggaacagctgagctttctgcaggcaaacagagctgcctggggcccaccactgctcctctgataagacaggcctctattgtaggaactaattaccacaatgccataaagctatctgccctgggccgtgcatcagaagtggtgacaggctcataaaacctgacttccctgtggataccaaatgccagccctaagggaatatatggtcagtattcaggcctttccgagtttgcaaataagccagatcctaaaatcttgtttgtaaagcatcatgaggaacctgaagtaccagagaaaccatgttctaaatgtagaacagacatggcacatagtagatgctcaataaatatttgatgaccagtgatggccaagtggaggccaaggtccagttctagcccttagaagcatttgaacaaaatgtagctgcaagctgcatatttttcaatataggaaacaattttgtttaataccagcagctaaaagacgactatccacaggattaaataattgaataattagtcttaactatatttatctaaatctgtttatggagaagaaagcagatttaactagaggaagataagaatgtagactgtaggaaagactaaggcagaatctaggcagtttcaaggagtttaaagatgagtgacactacgttattattttacttttcatgtcctttatataaacagcacttccttttggctggcagccaagttgggcgtcattttacaatgattacaagggaaaagaggagaaatgataacgaagccgtgttaatccatgctgaaacagtatggagtcacacggtccccctgtcaacacacccagggaagagcccagccaggaccaccacacaaatctaagatttaagacctggttgggccactcaccagctctgtgacttgggaccagaaacattctccctggagctttaatcaccgaagcataagagtactcattccatgaagccattgggagggttaaataagatcatgcatttaagcactcttacactggcgcataatacatgctagttatggttattattagaaatgtgttctaaccttttcctctaagtttcaggagggtgggacccacgtgttcatctcatttactactgtatacccaacagtagtaaacctggcatgtggcagggatttaacaaatatttgtaggggacaatctgcttgttctcatttttttcctctggtcagtgacaaagtgtttttctgcatctatctctgtcattttttggtcaagtggtttataattatagacatcatgacccttcatccttaaatatttcactgtgtctctaaaaaataaggacattttctttataatgatatcatatccaaaattaataatttgtaaatatataacacctacacggtactcaaagttcttcaataattccccaaaatatcctattacagctcatttccttatgccagctttattccttgactgaataaaggatcaaaactacattcggtgattaggtcttttaagtctcttttgatctaaaaatagcacctccactcctttttgctttctatgacattgacttattgaagatacagctgtccctcagtatccatgggtgatcagttccaggatgcctgaggataccaaaatctgaggatgctcaagtcccttatatcaaatagtgtagtatttgcatgtaccctacacatatcctcccatatatgtacttcaaatcatttccaggttacttatagtacttaatacaatgtaaatgctgtataaatagttattgtattgctttttaatttgcattattgtttttatttttagtatttctgatgcagagttggtggaatccacagatacagaaaactgaccgtactgtagaatgtcccacttttttgatttgcctgattgatttaccactgaggtgatgcctaacaaattcctgtctcccctgtatttcccatgagatggaaattaattctacagtcttgatgtgattcaggtaaaaccttgttatccagaaaacctcatagatgatgctatgtactttagcactgtatcacacaaggagggatgtcatgtcaagttggcctattatcagtgacactgggcttgatcactggattaaaatggtgatggcttgcctgatccctttattgcaaagttaagggttttctcctcttggaactagcagataaactggggcggtagttgatgccctgtaaatatgtagctcaccattaacctctcaccagctgatcttacaaccactgatggtctttgcctgaatcaatcatcccataggggttgcagaatggtgattttccaatcccatcattccttcttcacttattagcgtgcactcttctgtaaaagagctttccttcatcaactgggctatttagttaccctgaaatatatagctcctagggaaaagacaggttatgtactcgtaactctttcccctgcataacccatttttaaaataagttattggtaaatagcatattttaaatcctggggtaaaaaggtttttctctctcctctggctccaataattgttttagcatgagcctgggaaagggtttggggccagaagtgtgagattacttcccattctgcttagtgggaagaaatcacacctcccattttaccccctctatgactcagattccttctcaagttagctgatcctaagtcctaagattaaaagttacggtttctcagcagatcctggttatatgatttataaatttggtgctaatctttcctctgtcattggaggtatctcataacatgatttttccaatgcttccctaggaagagtatttattccacaaactgatggaattcagtggcatgtatttctctctttgactgcaaattttattttaagcgttccagtgagaactcttaattctgaaacctcaaatcagagtaaataactcccctccttctcactgactacaccatttacacgtggctgggcccactgctagcataaaacctcaactctctgcccagccgagcagcatacactgctctgagctctttaatatgtcctcataaatccagctcctctcactgccctcggattccctgtacctctacatttcctccccaataactgagctcagcacggctgcaatgtggtgctcccttcctgaaatcagatgcagagtattctaccctctctttgacccctttgcctccatgctgcaacataagctcccatctaattgctgctctgcctctctcagcagaacctgacctctttctgggtccctctcttaaagcaactgtctgtgtttttcattatgtttgccaagacatattatcttgaacttttcccagatgaagctcgtttttttactttttcttcagacccctgaggtggcaggttcaagaatgcagtcttcagagggaagcttttggtctaggaggcttcagccaggacagttcagttaatcatactctccctccgggtactgcccctttaagaagtggacagactctggttccaactccaaacctcagttagaagttcaagccacaagacgaacacacatgtcctgcccagaaagctgcccagccttgctgttgactttctcctgacagcttgtcatccacatacccatcccacgcaaacgcaaacatatccttttaaacatcgaagtctcaaagcctcccccatgaaaaggaagttgaaagtcaagttccgggcaccctcggcttctgtagtttgaccagtaacctggtaagaaggggcacctcctttgacaacccgagtgtgcccaacaatgccaatgagaattctttaatgatcactcggaagatgtcatctctgtgtctcagcgaatccttctcttaaaaagaaaagcactcatgagactggaagaagagggggaaaactcagagtgataagaatgctaatcagaacgaagggaattttccagcttttagctttcctagcaaaaaaaaaaaaaaaggcatctataaaaaagtgttggaaggcttttcttgcagcctggggcctttgccagggaacagatttctctccctcaactcagtttcttccagacctttttcctgtgcattcttttttctttcttcttctttctcttctctcttagcggagcctcctccggctgagaagtaatctgtggggagcccgaggggtctgtactgttcaggccctggaaagagatgaaggtaactgcctgctgataggggcactgcaccatttgggattgcagtagggagaccccactcctcaactggagggattcatagaggtcacacccagggcttccttgctgctttttctgtcacctcccatgctgttttcttcccttcggtgtaagccagccctctctttttgtggtaagatgactatgggagtcccaggctggaggctgactctttgcacccacttcccacacttgtttctgacaagtctgatctgtgtagctcagcacatccaaggacagccttccccttggcttcgttgtccagatgcatgaccccaatggctttgtaaatgaaatggtataatctcaagaggctagcctgctgtagagagaggaataaataaatcaatatgtaaataaatccacaagagcagaggggatgtaccgggactttgcaaaactatgatgaagcattttagaagatggatattgctgtatttctggtgagctctgattgaaaggctatgattccagccatgggctgtaggagagggaaagtgagctgtgacggaaattccctcatggattgatttgacttaaatatattccaggagctgatctaattgctggttcagtcttaggctttgattttccttctcacaattccctgcatttcaaatagtttttattaaggggcctgagctgccctcagtcctactgagaatctttctggatatatgactaattttttttatttatttattttattttttatttttttgagacagaggctcgctctgtcacccaggctggagtgtagtggtgtgatctcagctcactgcaacccccatctcctgggttcaagtgattctcctgcctcagcctcccaagtagttgggattacaagcacacaccaccacacctggctaacttttgtatttttagtagagacggggttttgccacgttggccaggctggtctcgaactcccgacctcaggtgatccacctgcctcagcctcccaaagtgctgggattacaggcgtgagacaccatgcttggcctgtgactgattcttctgagaacacagtactagaaatactgcccttggtcaaaggaagaaccagacattccccacctgagaaggagaagcatgctggtaatttccagggggacaggtagttagttattcttattttgaatcagaagtgctggtggcagcctcttactgttcagactctgagacatattggtttgggggtacagtccaggaaaaggtgggaggagaacttccaatcaggtgagtcttatgcatggaaggccccagacactgacccctggagtctgaccccttgatcttctcatcagttcacagccctctactccacccctgctgccagtctcctctgcctgaccgcctgccttacaatccgatttatattctctttctctctctctctctccacacacttcctcctcctcttcttctggaaaatttcaagcatatacaaaagtagagagaataatatgatgccccctttacccatcacccaactccaacaatggtcaactcacagccacactttttttgagatgaagtctcgctctgtcacacaggctggagtgcaatggtgtgatctcagctcactgcaacctccacctcccaggttcaaatgattctcctgcctcagcctcctgagtagctgggattacaggcacacaccaccacgcctggctaatttttgtattttagtagagatggggtttcaccacgttggccaggctggtctcgaactccggacctcaggtgatccgccctcctcggcctcccaaatagacttatttcaattacatgcccagctgcttttaccttcactccttacctcttgctctacctggacgatcttgaagcaaatttcagatatcatgtaatctgtaattagtttagcatatagctccaaaagataaggactcttttggatataacaattccattattatacctaacaataagaataattcctaatgtctccaaatatctggccagtgttaaaatgtcctcagtgtctccatttatttttacattagttcaagtcaggatccaaataatgtccatacattataatcagtttatgtggctttaagtcttttcttcatataggttttcttttgctttcaaaatttattaaataaactaagttattgaactatagtttcccatagcctaaattttgcggatcaccagtccctgtggtatttttttaacacattcctctgtccctgttttttaattggtaattagatgacgagatttgttgaattcaggtttgattttttttttttttttacaataatgctttataggtagtggtgtgttctttcatcagagagcatataatgtcaattttgtgtgtgtgatattaccagcctttgagtgccattgtctaaatctatttcatgtatatcattaagtgttataaaatagtgacattctatcattctcttcatttattagctagactgcttctataaagagaaatttcctccattgatcaattggtcacctttatatcacttatccctgggaaatcttaggccacacagccagaatatgaaagtgctttgtggccagtgtccctcagacctcaaggtagattctacaggaggaaacggagttacccctcaaccttccctgggccctctgtgttcacttcttcaaagatattttaaaatccatttgccagccaagatattggccctgcttcaatgcaatataggttttgcatttaccaatgggaaaatctagataaatttgagtaactcagaaaacatttccattcagttgttttagaagccacccatgcagagtccagagctgcacctcacaccggtgtagtgtggcctatctacatgatgcttaagccatgtaggtaggaacccacacttccagggctgtcctactggttgcatgataaagaagatctatcctccgttttgaaggtactcagtcttgatcctgaggaggaagaaagcagagaatcctccatgcagagaggtcttcaccagctaaggacagcagtgaggccagagcccagctgctcaccttgtgccaccatccttgcccactgaccatgatggctctagttgcagcaccactactgctcacacctgccctggaacaacagtcctgctacccaggattccttgcaactgtagagaattgtaggctgcagctgggtgatttcacaacttgcttgcccacgcctgatgggggacacagaggtgagtcttctcacacaagctgtcagtagtctactcaagagttgtcaggaatgagggagacccactcaagcagataatatcaagcagcgagggctctgggacagggacagaccagccacttgcatctgacgagtgagccacagtaaactgaccagtactgcagccacacactcaaaagcatcactggctattggctgcatctgctatccagcccaagctgggactagggttgcctcactaggtgtatgaggagaagcagtggcaggagtatagtagcttctttatttttccacccaagcaggcaactgcagagagaatgcaaggaggggtatagagatgggcacaacccccctttgaatgccatcatgaaacatggcgcttggggacccagtcaggtgggccttgtgtccacctataagaaacatagggaaaggaattaaccagctgtactagagccttttacctaccacctaaatttcctctctgagccagagagtgtttctggcttctcaccaaaatgcaaggagattttggttaaaatccatcccattccaaatttgtgagacagactctggttccataggcccaatacaccacctgcttcaaatggtcgtagtccaggtggttgtatctgccaagcacccacaacagcagcagggtaatggggagtgctggtggaacctttcacctataggatgcttggagtcttacctgtggagtttaaggcgggtggcaagggttggaggggaggcatacatgagagcttggtattgttgctcaccttatgttcatgtttttatttcctgctgataattagatgtagctggcatgagtcccatagctctgccagcttcacttcagtgtcttggtatcaatgggccatgcaaataccctcatagcccacctggataggaaccacgcaaatttgcaacctttgagccatattggaacagaacttgtcaagtataaggctgatttccagaggctcatacccaggtttgcaggagttcaaaggcatatcaattccttgccatttcccggggactttctttacagtgagcagctcaggatgaaccaggcctgtcaggagccaacatggtgatgatgcagggctgccatttgcttctacctgacactagcatttggatcagctcagatcattcctaggacatacaaaagtggccctggtgggcacacagcctccattcatatcaggaattagtagaagacagtaagtgcagtgattattagtgctattcactaaatattctcggttctccaggctcatggtaaaattgcctttcctgatcccattgggtttgggtggagccatctgctagctttgccaacgaattgtgagtagaagtgacagaagttatttctatgcccaagtatttaattgctgggcaagacactcctctgctgaccatgatctctctctgtccctttgacatgacaactggtaatgtttgaaatggctgctactctgtcaacctgggtctcagagtaaggagcacagaggtgagcccttctgacccccactggatgagtagcattaccaaataaacctagtttgctataagcggccaagatttgaggatcatttttatcacaatataagctagcctatactgactggttcaactgatcagacatgcttgggacaaagcagctgtttaggatgaccttgaaactatacagccttcttgaagttccagggtctgatgtaagctcctgtatgatctcttggatctggagcaattatccactttaatgacacatccatcgactccctggcctggcttcctccagatatttctgaggcctcgcacccctcatgatgcccttcatactcttagagcatgagccaaggtcaatgataggtctaggaagcccaaggtatggtagacaaaataatgtcctacttcccaccaaagatgtccatgtcctaatccccaggatctgtgaatgtgttaccatatgtggcaaaaggtctttacagatgtgattaagactcttaagatggggcgattatcctggatttgggtgaaagagggaagcaggcatgccagagtcagagaaaagagttgaaaaatgctatgctgctggctttgaagatggagaaaaggtactatgtgccaaggaatgcaggtggcttctagaaactggaaaagccaaggaaacagattctcccttagggccctcaaaaggaatgcagccctgccaacgccttggttttagcccagtgagacccatttcagacgtctcacctccagaattgtaagataatagatctgtgtttttttaagccattaaatttgtcataaattgttacagcagcaataggaaactgatacacaagagaaaaccttctcctgttactgaatactttcaggagaccgttgtgaccatcaaccaaactttccagagcacaacatgcacttattggagccccctgaaaccctcaacaactgcaccctgacaatgtggcctattaatagaccccaattcctgcagtgagtatgatagagattcttctttatccaccatgtttgaaccttctgtccattgctcatcactctcaaatcattggagttcttgaaccaatgtactgtgtgtcttccttattgactattcgatttcaaccatgtagtagacaccagtaaatattaggtaaatatgaatgagtgaataaatgccatgaggaattatctgataacgtatgtagctctggatgatctgttgaaaatctccagcaagaaacacaccaatctgagttatacacagcaaaaaattaaaacaaaatagcaagcggatacaaaaaaaggatttagtgctttgcccactcgcagtttcgtcaggtgcaaacacaatctgtatgattctccttagttggctgattcttttgattccttctgccgtgcctgttgtctttgtgtgtgtgcttgcagaggggggtttctgacagtgcaacagatctgtcctcccctgggcacctgcttcctccagcttattcaaatttcactcatttgttagaaaagtagcatgattttgtaagcaaggatgttcagtgggacgagaatgaagcatacaaactcatatctttgtgactcaaatatagtttgattcattcatatttattccaactctgccactgaataataattatgaaaagagttacagtttgtgctgccgttaaacagtattttggggccaggcatgttggcttacacttgcagacccagcactttgggaggtcgaggcgggcagatcatttcagttcaggagttcgagaccagcctgggcaacatggcaaaaccccatctctataaaaaatacaaaaattagccaggcatggtggaacatgcttgtagtcccagctacctgggaggctaaggtaggaggatcacccgagcatgggaggtcaaggatgcagtgagctaagatcgtgccactgcactccagcctgggtgacagagtgagaccctgtctggaaaaaaaaaaaaaaaattgatgaggtaaaatcccattttaacaaaaataagcatatctcacttaacgtcaataatctgttcctgaaaaacagaagttctactcttaaacactgatcattattttaagggggaataatgcatttcgtgatgacccaaaactctaagataatttcccaaaacataattgaaacatggcaaaacgcctatatacgtaacaactatcagcttcgtatgtgaaatgcttaaagcactctctaatcaaagttttaataaaaatggatctcacatgtaaatgaaaaacttaaacttataaaagttctggaagaaaacacagaaaaaaatatttgtgactttggcttaaggaacaagttcttagcaatgatacccaaaatattcaacctataaaagaaaaaaattgctaaattggatttcatcgaaatttgaaacctcaactctttcaaagataatgttaagagaatgaaaaatgataaactgggagaaaatatttgcaaattacatatctgataaaggacatgaatcagcaatatacagagaactttcaaaattcgatattagaaaataatccaatgaaaataggcaaaagggataaaaagacttgatcaaagaatacatatgcataacaaataagcacataaaaagacagtcatcacatcgttagtcactggggagatgctctttacctgtattagaataactaacttttttttttaagtttcgctcttgtcaccccggctggagtacagtggtgcgatcccagctcactgcaacctccgcctcccaggttcgagcgattttcctgcctcagcctcccgagtagctgggattccaggcgcccgctaacattttttttttaaagctgagaataccaagtactgatggggatagggagcaacaggaattcttgttcattgcctgtgggaatgtaaaatggcacagccactttggaaggcagtttggcagtctcataaacagacaataatcacgtgatccagcaattctctcctagttatccaaaagaagtgaaaatttatgttcacacaaaaacctgtatataaatatttatagtgactttattcataagaatcaaagtctggaataaactcaaatgttcttcagctggggaatggataaacggactgtggcctatctgtacattagaatgttattggcaataaaaagggacaaactatggcagacaaataaacatgaacgattctcaaatgtgttgtgctaagtgaaagatcccaggtccaaaaggcttcctactatctgattccatgggtgtatcatcctgaaaaagtaaaactatgggaacagaaaacagatcaaaacacagaacagaaaactgccagggggtgagggtacggggaggagatgactacagagggacacgggaatttttggagtgacagaaatagtctacatcttgaccatggtggcgattacatggctgtcaaaacttgcagaactttgtacttttttaaaaggcagattttactgaatgtaaattacatattaataagcaactgccacaaaaccaacaaaacccagttgctttggtgtcgtagcatgtgcagctccatgacccttgaggaggctcagcacgcttttcaaaacatccacgtgtgattccgacattctagcatttgtatttagaaaggaagtgaagacttttctgcatgttgttttgttaaaatgttgaactgaggtttgagtatgtaaatattattttttcctgtgtaaacacatcagccaaaaatatattgacaaatacatatgttcaataaagctcggttattaaaatccagagggattctactgggaaaaaacaaaccaaagagacattcagcagggtatgccagtatcatgatactgctgaactctttttatatcctggctgacagcctataccatcactgttaaactgatatgtatacaacaagtcctattgaataaaaattcatctgtatttagcatatcttttttcagtcaccatcagttaaataagcaaaaatagagaaatccaaaggagctaaatagtttaaaaaataaagatgatttattaatattaatatattgatttctatatccagtacctagagagtgtattcttttcatgtccatggactatttacaaaaatgatattttagtctatgagatattctaaaatgtacaaatagaataaactacattctctgattataattcagtgctactataaatacataatgagaggataaccaaaaacttttaaccacttggaattaaaaactgcaattacagaatgttcagtgaattttaatattgtgaatactacatgttgagaattataagatgtagccaaagctgtacttggaaggaagtgtatagacttaaacgcctcaattattaaataagaaaagatgaaaataagctatgaattgagtaatcaattgaatatgtctggcatgtattaagcaatcaataaacatttagtgagtaaagcaattagagaaaagcaataaaacaaatttaaggaaaacaagataaagaaaaatattttaaaatgttgctaaatttgaaaacagaaaaattaagacagctgaataggaagcaggggcaataaaatagattatctactaagtagtcaattcaagaagaaagagcataactatataaaatttagaaaagaaaggagatgcagctacacacacaaattttaaagaattacaaattaatactttatattatgctatatacattggataatctaaatgaagtgagggcttttctaagaaaatataaattactaaaagtgtacaaaaagtataaagccaggagacattatttaagcaaagattgtggctcacacctgtaatcccaacattctgggagacccaagcaggagaactacttgagcccaggagtctgagaccagctgagcaacatagtgagacctcatctctacaaataatgaaaaaaaaaaaaaattagccgagcatggtagcacgtgcctgtggtcccagctactcaagaggctgaggtgggaggatcgcttgagcctggtgttcaaggctgcagtgatctgtgatggtgccactgcactccagcctgggcaatagagcgagataccatctaaaaaataaaaaaatttaaagtatggatttttgagccagatactcctcatttagttcaggtatgagctgttcctcttggtaactgtgtaaccttatctaactaattaacttctctcaacctcatttacaggtaagtttccttacctgtaaaatggcacacacacagaaaaaaactacctcataggaatattgtggggatttaaataggttatatgtaaacaacatatctgacgcactagtgtgaatattaaaatctttaaagaccatggaagcaataaggcgtgtgatcaaagcgctatccctcatcagaacatgggaagcaaataattttgctgctttcattgctgtttaagcttctttcgaacctagaaaaagaaaaaaggcatctcatttctttttggaaaactagcacattcctgacagcaaaactccacaaagatagtacaagaaagaaaagtacagactaaccctcttagaaatacagacataaactttccagataaaatattagtactcaaccttattggtatttacataggtatcaaattaatattgctttattatgtttctgattatgtagtgcaattgtttcctatttctgctataacgaactaccacaaacgtggtggcttaaaaacacacaaatttattatctcacaatttgggaggccagaaatctgaaattagttctaccggggaaaaaaaatcaaggtgtcagtagggatgcacttctgaagcctctaggggagagtgcatttccctgccttttccaatttctagaactgcattccttgccttttttagctgctactttccatctgtattccttggctcatggccccttttcttcatcttcaaagccaaaggcatcttcaaataactctctttactgaggtcatcacattgccttttctctctgtgttaaatctcactccctctgcttcccttgcataaggacacatgtgagtgcatttagggtccaagctaaataatctgagataatctacccatctcaagatcattaattcaatcacatttacaaatatgttttgccatgtaaagtaacatgacttattaggatatgaatatcttttgtgtgacatatttttcagcctaccatagtcttccctttaatccccaattattcatgtccatcccacatgaaaaatacattcattccatcccaacatccccaaagtttcaactccttacaacaacaattcaagtccaaaatctcttcaggtcaaaaatccaaagtctcatcctctaaatcagatgtgagtgggactctgggtataacccatactggggtaaaattcctctctatccatgcacttatgaaactggaaaacaggtcatctgtttccaaaatacaatggtgaaacaggcatagtacaatagttatagataatctcattccaaatgggagaaaaatggaaggaataaaggggtcactgattttaagaaattttaaaatctagcagtgcaaattccattagatttcaagcccctttgtggctcaagattctgctctctgagcctacagttctgccttctgcctctacttccacagctctaacctttaggctcaaggctctgccctgagttatctttcctttttcctgaaaggcaacacatgtttgcagctgagttgtcttattagcctcctccctgcctgtagaattttggaagcctgaccgctttcctttattttaccctctctctatccctttcagtacaagttggcagtgtttctgttggactaacatcctcaaaacccttgttgctcttccacatatttcacagggataaaaagccattagacaaaagtcttctccaagatagtcctggacaataccacttggattcctaccttctgttgagatgattgagtgggtccatgagtcataccttgaatctcttcagttctagcaaaaggttgtccaaccacatacttgactctctctccagggcacaatttcctaatagtgaatctcttaatattagtattttttttttgcaatgtgcataactgagtatttcccaaatcaagttctagttcctttttgcttaacagttctttccttaatttgtgtctttcctctaaagttttatataagcagtaaaaaaccaggcagtgccttcaacactttgcttggaaatctcctcagttaactagccaagttcatgcttacgagttctgctttctaccaagtgtagaaataattcagctaggctttctgccacgatgtaacaaggatctcctttcctccaatttccaacaacatgttcctcatttccctctgagcccttgccagtagcacctttaacatatttctaccaatattctatttatgatatgtgtatactacaagatgatgcaggcgtgctctacaccatgcttcttacttcctcttgagccctcactaacagtatttaacatccatatttcaactcacagcctgttcaaggcaatctcagtttttttctatcatgtgcctcaaattctaccagactctaaccattatccaattccaatgccactttcacattttaaaatatttgttacagcagcaccccacctctaggtaccaaattctggatcagtcagggatgcaccagagaaacaaccagtaaaacacatgcacgtgcacacatactcacacacacatttagtgcaaggaagtatcttatgtaattgtgggaactgactaggcgagtctgaaatccatagggcaggccatcaggaggggcagtctggaattcttgggcacaagctgaagctttagtccacaggtagaatttctttttctttagggaaacctcagttttccccttaaggccttttaactgattgaatcaggcccacccagactatcaagtataatctcttttacttaaaaagacaaatgattatagatatcaatcacatatacaaaacaccttcacagcaacacctagattagtggttaattggataactggggactatagcctagccaagttgacagataaaactgaccatcgcacagagcaaatagatggttaaaagtcagacaatccagaaatataaaataatgttataaaaactatcaggagacctaccatccagagatactactgctaacctctgtgaatatccttttggactttattctattcaaatacaaatacacacttgtactagtccattttcatactgctataaagaactgcctgagactgggtaatttataaaggaaagaggtttaattgacccaccgttcagcatggctgagaaggcgtcaggaagcttaccatcagggtggaaggtgaaggggaagcaaggtacctccttaacaaggcagcaggaagaagtgccaagcaagggaggaggagccccttataaaaccatcagatctcgtgagaactcactatcacaagaacagcatggaggaaactgccctccatgattcaattacctccacctagtctctcccttgacacatggggattatggggattacaattaaagatgagatttgaatggtggcacaaagcctaaccatatcattctgcccctggcccctcccaaatctcacgtccctttcacatttcaaaaccaatcatgccatcccaacagtcccctgaagtcttaattcattccagcattaacccaaaagtccaagtccaaagtctcatctgagacaaggcaagtcccttcctcctagtagcctgtaaaatcaaaagcaagttagttacttcctagatacaatgggggtacaggcattgggtaaatacacttgttccaaatgggagaaaccggccaaaacgaaggggctacaggccccatgcaggtccaaaatccagcacagcagtcaaatcttaaagctctgaaatgatctcctttgacttcatgtctcacatccaggtcacattgatgcaacactcactcatgcactaactcctatacacacactctcatacacacacttgaacaaactcacactcacatttaaaaatgatatagtattttgtaaataatctttgtaaaagaaaatatctatacattttttatttaaaaatacatgttcaactttcaaactcattttatgaggccagccagtttcctaataccaaagttagacaaggacaccacaagaaccgaaaattacaggccaatagctctgatgaacatagatgccaaaatcctcaacaaaatactagcaaaccaaattaaacaacacattaggaggatcacacaccatgatcattatccctggatgcaaggatggttcaacatatgcagataaataaatgcattagactacattgacagaatgaaggataaaaatgatatgatcatctcgataaatgcagaaaaagcatttgacaaaattcaacatgctttcatggtaaaaactctcaacaaattaggaataaaaggaatgtagctcaacataataaaggccatatgtggcaagcccacagctgccatcatactcaaggaaaaacagttaaaagcttttcctctaagatcaagaacaaggatgcccactctccccactttattcaatatagtactgaaggtcctaatcagagaaattaggcaagaaaaaaaatacatccaagttgaaaacgaagaagtaaatttgtctgtgtttgcagatgacatgatcttatatacagaaaccctaaagtctctaccaaacaaaatgttagaacaaatgaattcagtaaaactgtaggatacaaaaatcaatatacaaaagtcagtagcatttctacacaccaaccaacaatctgaaaaagaaatctagaaaagaatcccatttactatagtgtttaaaaaatacttaggaataaatttaaccaaagaagtgaaagacgtgcacactggaaacaaactgaggaaaaattgaagacaattcaaataaatagaaagatatctcatttcatggattggatgaattaatattgttaaaaatgtttataccacccaaagtgagctatagattaatgtaatttctagcaaaattcccatatcatttttcatagaaatagagaaatatcctaaaattcatataaaaccacaagagacctgaacagctaaagcatatatgagcaaaaacaaagctagaggcattacaccacctgatttcaagatacgctacaaagctgttgtaatcaaagagcatggtataggcataaaaaagacatgtagagcaatggaatggaatagacagccccaaaatccacacatttgcaaaggtgccaagaatacacaatagagaaaggatagtttatttaacatgtggtgttgggtaaactagatggccacctgcagaataaaattggaccctgatctcacaccatatacaaaaatcaactcaaaatggattaaagacttaagcataagaactaaaactgtaaaactactagaagaatacatagcggaaaagcttcttgataatggtctaagcaataatcttttggatatgactctaacagcacaggcaacaaaagcaaaaatagacaaatggaattgcaacaaactgaaaagcttctgcacagcaaaaaggaaacaataaagtgaacagacaaccaatggaatgggggaaatattggcaagccctacatctgataaggggttgatatccaaaatatataaggaactcagataactcaataacaataaaacgaataatctgattaaatgagcaaaggacctgaatagacattcacaaaagaagatggcaatggccaataggtaggtggaaaaatgctcaatatcactaaccatcagggaaatataaatataagccacaatgagatatctcacacctgttaggatgactgttatcaaaaagagaaaggataataagcattggtgaggatgtggagaaaagggaatgttgtatactgatgatgggaggtaaattgagatagccattatggaaaacagtatgaaggtgcctcaaaaaattaaaaacagaactactaattcaacaatccctcttctggatatatatccaaaggaaataaaatcattgtgttgaagatatatttgcattcccatgttcatcgcagcattattcacaatagccaagatgtggaatacacctaattgtccattgacagatgaatggataaagaagatgtggtatatatacacacagagtagaatacaacttagcctttaaaaaggaggatatcctgtcatttgggacaagctggatagatctggagaatattataagtgaaataagccagacacaaaaagacaagccttgcatgatctgacttatatatggaatctaaagaagttgaactcatagaagcagagtgaagaataatggttgccaggggatggggtgaggggtggcagagaaataaggagatattggtgaaaggtacaaagtttcagtcagacaggatgagttctgatatatattgtacagcatgatggctgtagttaatagaatgtattttatacttgaatattgctaagagagtagctcttaagtgttctcaccacaaaatatgtgaggtaatgaacatgttaattagcttgatttaatcactccacaatgtacacatatatcaaaacatcacattgtataccttaaatatactccatatttatttgtcaattatacctcaaaaactacggggaaggagggaggctgcggagaagaaacaaccctgccaacatcttgacctctgacttctagcctctagcttccagaattgtgagacaataaatttctgttgtttaagccacccagcctgtggtctttcattatggcagccctggcaagtgaatgcaggcaggtgcaatcctaaatcatttctttttttttttttttttttttttttggagacagagtcacaggagtctcactctgttgccccaggctggagtgcagtggcacaatctcggctcactgcaacctccatgccccaggttcaagtgattctcctgcctcagcctcccaagtagctgggattacaggcacttgccaccatgtccgggtgatttttgtatttttagtagagacggggtttcaccatgttggccaggctggtctcgaactcctgacctcaggtgatctgcccgcctcagcctcccaaagtactgggattacaggcatgagccaccacgcccagcccagcatcatttcttcaacatttttttcattctcttattttgcggagaaatatataagatttggttttttaatttaaacacatcaaaaccatgattgcggatgcatgtcttctctagtatgctgcagtagcatggggtggggggaggggaatttaatgctctgtctaaagatacagctcaccattatttacttctgaaaaaatgaagttgaatctaatcctgtcaacaatcaaccttacacaacccatgcactcagttggatcagacatcttctggggtttgtgttttgcaactatgctatcttgatgagccccagcaacagagtttttaacattattagatccaggacagcggcctttatggaaggagcagtcagccagcagcagctccctaacaatcccacaagctgagattctctctatccaggcagcgtggtagagaattctggtgggcccaaacgtttgctaataagagagcttggacagacttaaagttcttttagataaaaaatataaaataagacaaaaagaaacaaagaatacatgttcactatgcagcactcagagaggcagaagaaagtaaatgttattggaggccccaccactcagagagaaatcaccattaacattttggtgtatcttggaagtttgagatatatagataggaataaatataactgcagtagtaccccttcatctgcgctttcactttccacaatttcagttgcccgtgatcccagtctgaaaataggtaaatacaatgcaatatttttagagagaccacattcactttttgagagagaccacatgtaactttcattacagtataattgttctattattagtctcttactgtagctaatttataaattaaactttctcataggtatgtatgtacaagaataagcatagtatatatatatatgtatatatacacacacacacacacacacacatacatacatatggtttggtacaatccatggtttcgggtattcactgggggtcttggaatgtatcccttgaggataatggggactactgtacacaaatatatacatttagttgtaatactgtataaattttattataagggtgtaccttggatttatttatttagatgtaccataatttaaccaatctttttctgatgatccttgcattagtcagaactctttcttttgcaaatgacaaaaactcaccttaaaaccaacttaaaagaaacaaagaaatatattggctttaataactgggaggctcaggcacagctgaaacagggaatcaaaggatgtcagacttctgtctctccagcccatggtaggctctccccatatgctctgtgaaatggctaccagctgctctagactcattttctgtaggtttaataatctgtggcagagattgctattagcctacccagtatcctactggaaccccatttttatttaggaaatcagtgtgcccaggtaaaaactacatttctgagactcccttgcaggtaggatatccacatacaagacaataaagttctacctcacaccagatacacaaacattaagtctaagtgaaaaataggcctaaatgaaagagctaaaactatacaactctttgaagaaaacataaatctttgtgaccatgggttagacaaagccttcttagttatgatactaaaagcacaaatgacaaaaggaaaactagataaattggacttccaggttaaaactttgatgctccaaatgacattatgaagaaggtttaaagacaactacagaatgggagaaaatatttgcaaatcatatatctgagaagggcctagtattcagaatacatacacaaggaacttttacaagttaaaaagacaacccaattaaaaaatgggcagaggacttaaacatttctccacagaagatatgcatggccaataagcacatggaaagacgccgaacgtaattagtcatcaaggaaatacaaatcaaaacatgagctatcacttcaaacccactaagatggttaaaataaaaagacagtcaataggttgtgttggtgaggatgtggagaaattgaaacactcatagattgttgttgggattgtaaaatgatgcagctactttgaaaaacagttttgcagtttctcaaaatactagacatagagttaccatatgacccagcaattccacaactaggtatatgcccaagagaaatgaaaacatataaaagaaaaatttttaaagaactaaaaaaaatgaaaacatatgcccacgcacaaacttgtatccaaatgtttctagcagtgttattcataacagacaaaaaagtgaaaacaactgaaatgtccatcaaataatgaacagataaacaaaatgtggtataactgtaaaatggaatgaatgttattcagccataaacagaaacaaagcactgatacatggtacagcatggatgaactttgaaaacattacactaaatgaaagccagtcacaaaagaccaatatggtatggttctatttatattaaaggtccagaacaggcaaatatagagagatagaaagattagtggttgtctagggcagggggtggaatgggagatggagaataggaaatgacttctaatgagtcatggggatcaggcgcagtggctcatacctgtaatcccagcactctgggaggccgaggcagcgggcggtggggggaaatcatttgaggtcaggaattcaagaccagcctggccaagatggcgaaaccccctctctactaaaaatacaaaaattagccaggcgtggtggcgggcgcctataatcccagctacttgggaggctgaggcaggagaaccacttgaacccgggaggtggagcttgcagtgagccaagatcttgccactgcactccagcctcggtgacagagcgagactccatctcaaagaaaaaaaaaaaaaaagaaaaagaaaaagaaaagaagagtaatagggtttctttttggaatgatgaaagtgttctataattagatctcaggaagagttgtgcaactctgaatatactaaatttgtacaatgttaagtgtgtgaattacatgatgagttatatcttaacaaagctgctcaaaaaataaacctagcctcttattttatttaccttttgatctgaagacaatcttctattatttgataacttcatctgtacctgctcatgtatctacctctagaacttctgttgcatatggtaaatatatttccaagacctctcctccattcaaggccaacctggaagtcaccattcacatgtggtaaaaggtgttccagcaacccacccccgaccccactcctggccccagtggagttttgcaatcaccatggctctttctgagcccttcattgtttgccgtttctcacaatttctgtgtctctttcttaggggcttgggagaatcccttaggcctgtcttctaattgagtggttccaaaatctgagtaacccatcaaaatacttccaggcatttgttaacgctgtgggtccttagccaccacctgaggattccgattctacaagccacgggtagggcccagagactctttttaatacagtgctctggatgattggtgactttaattcagctagtttggcatttggaaacagcttttataactcactaattcctcgttctgtgatatccaccctgctatttcctgctctcttgagaattttatttcaacagtgtgtttcatctctaagaactctacgttgttctcagactgctctttttcataacagttttttttctgctttatcactgcaatgtcctctcaaatctcactgagaatactaatcagaggattttttaaaagttttttttgtctgtattattttcggtgtgtgctcggattactcacattctgagacttttcttccttggcctgtgctgtcagcgtggcagagcctccgtacacagggaggccacttggcaggatgaagactagcgctaaagtgaagctatcgcctcagcatggctggaaatttccatcaacaggcacccaacaagtacttatccgacatctcctaaggtagcggttttctaccttggctgtgtattaaaattatctgggaagctcttaaaacttccaaaacctgggcaaagcaacgaaaccaggtctcaggcatcagtacctgccaaaagcttcccaggtgatttcaatgtgtattcaaggtggcaaaccgctaatctaaatcaaccgttttcagaagttcatgtgatgtgaatcagttggggatcttagtaaaaagtagatcctgattcataacatgtgacatggagcttgagagtctgcatctctaacaagcttccacgtgatgccaatgctgccgccctcggttctgttctttgaatattaagggtctataacagtgggtctcaaagtgtgttgtctggaccagcagcagcaatgtcacgtgggtgcttgttagaaattcagttctccggactgatcccagaccttctgaatcagaaactcagggagtggggcccagcatctgtgttttaacttcccagtgatgtgaacgcttgctcaagtttgtagagcatacttctctaagcatgagcctctgagcccctgagccccttcaacaaaagccatgtggctttatagtgtgcacatttacggaccccttcctaggccaccccatcagactctcagaaggtgaagcggcagattgtgcatgtttaacaagtttcccaggtgacgctgatggatagcctaacatttaagaacggctgtctctggcagctcggccctgtgaggcctctgagaatgtttcagtgtcccaacattgaagcggttttggttatttggatgccccaggctatttctacccggttaattacctgtgtagaagcttaacacgattaattcaggtggataccatcttggatgtcccatagaaccctataattatgtgtgaaatacacatttaatttaagcacaaggggaaagattaccccgatgactctgaggccgtagggtatgcagagcagatgctgagcagagcttggagctgtttcctcatagacctatgccatagccatctgaggccagtagaatgttcaagatttgggctttcctgatccccaagttagtcttgatagtatctactgaagcgttaatgccactagtttacctaaactcagaaaaaaatatagttgactatttaggttaataaccagcagagataaaagtgtaattatttgggtaatttgaccacaaaatgtgcaaataaaatataatttttccccaaaatatgtgtttaaggtctgagttgtcaaaatctcattggtctcttcctttgacttgtgcagaaactgggtctgtaagtgtttgtttttgcagagaatacattttaatgtgctatgctatgacatattaaacgaatggagagactttggttcagaaattctttttttcctctgtactagccaagcatttcaaatgatttggctttggcttcagtgttcctttggagagctgatttttttgttgtttttttgttttgaggggtgggggttagcctcagccattaccaaatgaaaaaaatcaactccaaagtgcaaaaggaacagccaaaggaactccagaactgcccaccccacccctgggcagaaaaagtaaaatcacaacacaaaacagcgcaacaggccgttccctaacgaactgaaaacagttctttggggagtgtttcctgcccagggcctgctttccctgctggtttctgggctgccgctggaaaggggccaggcttcggcacctccttgcctttgattgctgtttatcccctgaaacatgattaggtataattacgtataatctctcccttgtttacccttctccaccgaagcttgaacgtggttcagttgtgtctttctctttgctgtgcctgagcacagcaaagaaacatttcccgtattttcaactttattatttttttaagaaatagaggcattaggtatccatttgtcccttcattctcccaagcctgacattctggcaatttctgaattgtttcatccaacaacgacagttgagtgccaagcatggtgctaagtgccttggaggagttagaagtgaaacctaaatagacccttctcccaaggatttcccatagtaagtgtctctttacatgggaaaagagtgtaattggaacataatgggaagaaataaagctactcatcttttcttcaccaacaacataccaattgtcaatattttctctcttgtagttatttgctagtttaattcttgaccctgaattaatcgttgatagctgagtttattagaggcaggggtccacgagtatcctatttggtttcttccactataggccatctctactgctctgttttcaagaaagttgagtattctacatgcaaagaagatccctaaaccagaattggcacatgaatacacgtatgcaatgatatgaatcgtgcacgtaggctctgggcacagtcgcacaagatcccatgctcagaaggaccctgtgcttggtttaatgtcctcctgtcaccaccttgacattcttaatacttttgaacaagggattctgcattttcattttgtactgggccccacaagttatgtagcgttttctgcatgtaccccagaacctattttttctgtggcattctcatccaactttgagcataaacgaatggaagttcatccagaatctgatggcatagagtgagaggggaaagagcagagtctgtgtgtgtgttcatgtgctgatgacttttgtggcactcctccagcctatgtttagatttctttaacatgcctattaatcttgtcaagtttcagcccagctcttctgaaatagaactgacccccaaaatctcctggcaatgggctgttcaggcctgtcccctttctcagagtatcctgctcactgaggggactgctaaaggaatatctgtctcccttagagggaaactgctacttcccagggattgagtttagaagacagaccaagagtgtgcagaagagtgaaaaatgacttcccccacacccttctaggttccttggctgggctatgatttaaattgacgtaagacagattaacaggaggagagccgcatttaattgtgtacacatgggagtcccacaaaatatgagactcaaagaagggtgagatgactgaagcctgtatagcagcctgagctacagaagggaataggggcttggggcttctgggggtggtggcgacacaagttatgggagggtgagagaggaattatacagtgaataaatgttgtcttgttaggcagataaaaagtctctcccttattaaaaagttgtctgggctgggcatggtggctcacgcctgtaatcccagcagtttggaaggccaaggtgggtggatcacttgaggccaggagtttgagagcagcctggccaacatggtgaaaccccatctctactaaaaatacaaaacttagttgggcatggtggtgcacacctgtaatcctagctactggggaggctgaggcacgataatcgcttgaacccaggaggcggaggttgcagtgagccgagattatgccactgcactccagcctgggcaaacagagtgagactgtctcaaacaaaacaaaacaaacaaacaaaccaacaaacaaaaaagttgtctggagcagttctcaggagaagagatgattgtctgtcttggcgtggtgtccagtctcctctcctgtgattggagttaatcttcccatgttgataagattcccagagagcagattcatgataattgagttttttttttggagtatccgtctttaggcagataaggggtctcagggaaaacctctgcctgcattcgctgttccccaagtgctctctgttcaaagtaatcagcacagcaaagtggcatattttggggtagcatttctggaactccttccttcaagtgtaactaacacttccagggggaatgtttgataagccatgtcccaagggaggggagatggaacctgtttgccaaaacaacagggaattacataaggggaagccagtgttcactctctaaaaccttaatttttagattctggaaggagagaggggaaggttacttcctgagctgtgaagaggttcagacccttctctaaaaagggttctgggagagaaagaggctcccaggcctgtctacacagcccagtggtgatgaagaaaaatgtattttcctttgacacacccctttgagtggtcttataaggtttgctttgtatttggtgaggcaaatattggcaaagaagttgatttggtttttgttttgtttttaagatgaaaagcaaaatcttaaaaaccagagctttaaaaagcctggaagaaaatatgccaaaatattataacacttgattttggatggtagacggatgagtggggtttttccctcttctttttacttcaggcttttcaaaaattttacagtcatatcttatcatttttataatataaaatgtaagtttatctaacatttaaaattaaaggtttagaattttaaaataaagatatgagcatgtatttaaacatgcttgggtcacctacctcagctgagagctttctcctgtcagtttctaacactaaaccttaatgaagaaggtaggaaatcagttgacttacacttctcactttgacatttttaaatcttaggggatatttgtatgcaaacaggaatgcgagctatggttggcagaatttatttctacctgcggaacattcccacctgaatctccagtattcctctgcaattttcagagcagagagaatcaaagccattaaaaagctgactgtgacatcaggctgaagagaggcacagatgtcctccccagaaacactacttgctcttacccaggcaacagaggcttgaggactaaccttgtaaattacctggcatgtgtaagtaacaatgtttgcaagaaagtctttcaacctttttttttttccccaagacagtactggtggctctttcaagttccaattataaatttccaaatcccagacacttgggtgccaggctgaaacagggactgctcgtgctaagacttgtagtaaattgcaacagtgtgggaagtgggcggtttgtttcccagagttcaagcagggactgtaactgccagtgccatctctttgagatgcttcgtgcccggggctcctagctcttccaggttgggaaatagctctcatacccggaagaggctggccagaggagtgaccagcaggagacagaactcaggcctgagggctctaggttcaccaatataaaagtaactgcttaatgtggcttccagctatgagaagaatataaatgaacaccgcgttcttccaaaggcctctaatctgagacacccagggatgatacatatgtatgtgttaaatttatctacaaagagtcaggacttgtggatgtccctttacggcttacaagccgaaatgtgtgcagcaatggaagttaacttcacagatattgtcttgtttcagacaaaaggtcactgggctgtcactgagagactcggtgaggaaaaaaagatggtgcaaaacgcctcaggatggcagcatcttgacttgggtaaacaccagtgtaccgcgtgtcttctgcatgcctatacacgtatgtctatacctcagtcagatgaagagcaccacaaaactggtatttaagtgattaagtgtatttgaaattttattgattctagaagaggcagcatatgaaaagagactgggcaagcagaaaggagtctgtaggctgcaaatgagagaaggatgtactgtctctgtgggtgactgggaagtgctgggcgtggagagaaatatttgaattagccaccacccaaatacgataagccagatgaaatacggctgctggctcgcctgaatgtggcaattccaaaggtgtggaggcaaatctcactgtacaaactgccccctcacaggttggcagcaagacccataattcagaaaaaaggagatgacgtcagaaagaccctcgcctccaaaatacagcctctcaggtcagagggaaggcacaaccttcttcctaacacatcagagggtttcctgaagcagtcagcgagagacacgtcggcactcgggaaaatgcagatgcctggacttctaatacctgggattccaggcaggaaaggacagcttggattttgatatagacggtaccacttgaactgggaatgaaccggtcctagagcaggtttcttaggagaaaaggctctaaaaacaaacaaaaaccctgagagaagatggtcatcctttcaagaggcatctacaagagttgtaacactaactagatgtgaggcctgggcaagggcacagagagatcatgactagcaggaaaaatgcaagataatgtgggacacaggaagctctggaggtccaagagcagttccgggaatgcttcaagtcttctcctgttggtggaagctggggctggggacaccaggagaacaaagagctatttggaaaagggtgacgacttctagaagcacctgttgctaaatctgaacttggaagttacagtacagaaagcacggactgtgacatcagagagatctgacttcattgcttcctaccttcccatgcttggcttagttaacccatttgagcctcagtttgtgaataataaaacctacttcacagggctattgggaggatttaacaacaaaatactgacaaatgggcactcaaaacatgttagctcctttctccttcattttattccctatttaacttttgattcatgtcttttactctttttgtccagttacgcttttcttcagtttcaactccctctattgtctttcaaacaatggtggaggctgaaggtatgtttcaaccccccttatccttggccatgcctccaagaactcagagctctgagacctacttcctcctcattgtcagataggttagacatgcagagggctcctaaacaccacagagctgacagtgaagccccatgttggctttgatctgaatctcccttctagaatagtcttgaggacctcatttctcttggggcaggccactcataactttaaattggattattgtcattcttgtgcccaataatgctcaattgtaaggttcttccaaaatctttaagaaatcgtcctgctcagcctccgatgctgacactcttggaccaaatacagctgaacttgttctgatttgcacagccgataactctgggatctgttcactgttttgaagataaaccaaaactaggtcaggctcttatccaaggctaaaatcagcacacgatgttgaggaaagcagtcaacaaacataaagacatttaagttctttgagttacttgtattagataatatgttctcatggttaaaaatattttaaaaatatataaaaagtgatagtgaaagttttctctcccatcccccatccatcttgttctctatttctttcccccaagacacaatccccattttactatttcacatttccctccacttttctttatgcccatgtaaatatatatttttattttctccccttctcacccaaaaggtaacaatccatataccttgttctgcatcttcgctttttctacttggtgatacacctatgtattttaacaaataaaatatacataaaatatatagagagatccttatgtaattttccttgcattttacaaatgcataatattccataatgtgtatttactggttcagtcagatcccaaatgatagacacttgggctgttttcaatctttgccaagataaacaatgcagcaatagcttaacttaggcatctgtcattttgtacctgtgtgggtagatctgtaggatgaattaccagaaataggctattgcggtagaaggtcaatgccttgtattttaatagatattatcaaattgctctccacagagctgcggcattgtggacgtcccccagcatatatgtataggggaaatgcctgttttcctgtagcctcaccaacagagtatgttgtcaaatgtttggatttttgccagtcagatatgtaaaaattgataccttaacatcatttcaaatggcgtcttattacattactcttattatgagttaggatgagatcttttcatatatttaaggatcatttgcattttttctctgaatagcccatgtcctttgccaattttctgttaagtcattggtctttatttgatcaatttttaggcctctttatataaagaaagatgaatcctttttctgatgagttctttttttctgtatttgtcgtttgtcttttgactttttatataaatttatttatcatagtttttatttgtgaacttttggggtttgagtcattagaaaggtttttcctactccaatgctacagcagttgctccattgttatatttgtccatgttttcgtctagcatttgtatgattttatgtttatattaaaacatatacttgatccatatggagtttgttctagtatacagtagtatacagtataaggtagggatccaaatttacctttttccagagggctgtacacttgtccaaatacatttacttataaatccatctttacctgcactgatttaagatataccctttatatgatacatattacactcatgtatttcagtctatttctggattgcctattctgcttcatacaaccctggagctatatcaaagggtgattaagaacataaggcttggaatcaagttacccagattattttattccaggtaatttgactccaaacatgccagcatggtagcatgcacctgcagtgccggctacttaggaggctaaggcaggaccaggctacttgagaccaggagtttgaggctattgtgcattatgatgacacctgtcaataaccactgcactccagcctgggcaacatagtgagacctcatctctaaaataatttttttttgagatggcatctcactctgtcgcccaggctaaagtgtagtggtgacatctcagctcactgcaacctccacctcccgggttcaagtgattctcctgcctcagcctcctgagtagctgggattacaggcatgtgccaccacacctggctaatttttgtattttagtagagatagggtttcaccgtgttggccaggctggtcttgaactcctgacctcaagtgatccccccggccttggcctcccaaagtgctgggattataggtgtgagccaccgcgcccggcctaaaacaaaatttttacaaaatcaaagcatgtgtgacctggaataatttatcagctttttcaacctgtaaaatgggattaaatgtgccttgcgttaagcctggcacagggacacactcaaacaatgtcaacaatgaggatcataatgttggtatgttttccagctgctggagggagtgcctcatccttgtccgtttatgtaggacctctgtaaggatgctgctgtttgtaccacaagtccgctccttgtgttcctgaagtagctgaagcatgactgtaccagcagggttccctaccatatgggagatgcccggtgatctctgcacattccaaacccctgtggaaatggttctgtcctccagtgcctctctgaagacctcaggcccaagtccttgggggaggggctgtggaataagttcccagactgacatcaggctctcccttcataagctctaacaaaagccttcccttctctttcatactaaaccttcatataaatcaactcctcattgtggatctgtccttcagctcatcagacattcctagacaggtttgaatctcatctgagacataggacaggtctctttcaatctctctctctcacacacacacacacacacaccactcttacacacacggataaacacatgcatattatcagagacctgtggatctaagaatgtgaaggaatgagtcctgagggattgaagagagaggccatttgcaattccaaaaagccctgcactctcagaatggaaatgtgagttagaaacccagtgtcactcaatgttcaggctttcaactgtctacccgtgttcaagatctctcattgtgcagaccacaagtaggttttgtggaggacagcaaaagaaagtgataccccagttttggttttttttttttccttttttgagacagagtttcactcttgtcatccaggctggagtgcaatggctcgatcttggctcactgcaacctctaccccccaggttcaagcgattctcctgcctcagcctcccaagtagctgggattacaggcatgtgccaccacactcggataacttttgtatttttagtagagatggagtttcaccatgtcggccaggctggtctcaaactcctaacctcaggtaatccgcctgcctcagactcccaaactgctgggattacaagtgcacaccaccacacctggccacgataccccagtttttacctcaaagggtttgcagtttaacatatgtgcaaaaactacacagacatacatcaagcaaaagagaagttagaccatgatatcctcaacacgttgggccacatttccttcagtaatggccacatgattggaaatccgtatgtgagctgagcacactgcttttcagttgatgataatgataaagtatacactaaacatacaaaaataccaaagtggtttaaagaatccccagttacatcaactttacatatagaagtgcatagttaaggtctcatgtgaatcactgatcaatttggaccaagtcaatgaaaacacagccatttaacagaccgagcatataaaatgcaggtaaacatttacttgtttcttaatccctctggctcatctcatgggctctccacaattttaaccactcagcaacttcaaggacacaacagagtcactgaaaattcagagtcccaataatccacattaagcatttgagggcaggataaaagttaaatgactttcctcttctcaggagtctcttgtggtggtttgttattcaatttgggtggaaatagccaccataacgacagcatctagtactagttaagtccttgctatgggccaaacacggtgccatgtgtttgacttgagtttttatttaataactaacagcagctgtctgaagaaagtactattattttttccattttggaatgaagaaattgaaaccttgataaatttaagtggctttccctaggtctcagagttaccaagtggcagagcttgaactcaggtctgtcaaagtccatactcataacctagagctaatcgcacttggccttcaattacaaggactaattggatcaagcctgggatcaggcctggaggcaccagacacagcagtaacaggggcaggtgattcgatcccactctgttccaattcatgtgggtgagcccattgctgaacagtctctttgcctaaaaatatcaggcagcccacaccctggagccctgcagctgcttatgcaatgccctagaactaggaagtgtttcataaaaccttcataaagactttttgaccaccgtgatgatgatggtagggagaggaaaggagggaaaatgaaagctagaaaggctaagaaagacaaccatagaagtggtgtaaaccagtcgtggacccacgatgtctggtcccctaactgaggtgccctgccaagttccagggtccctcttagagaggctcatccaggtcagcttggcaaaccacctttacctgtctcttacctcacggacccttcctggaacaaatgtgagttccgaggagcagctaagggtggctaagtcactgtcatagttgttcaatccattcaacaaacatctatttattgcctaccatatgctaggcactgttttagaatgtgagaataaagcaacaagcaaatcccaggtggaactcaagaaaattacactctacgagggaaggaggagcttcagggatttcagacaagcagtgataaagagtaatatagtaggtcagatggagataagggctatgtggaaaaatacagcaggttaaggggatggggagggagcaggaaaggagaatcagagaactgctgttttaatgaaggtgaccagggaaggtcttccttgaggaagtacctcctgtgcagaaacctgaaggaagtgagggagtgagccatgcttctttctgggcaagaatgttcccgccagtgggaacagctagggcagaggcccaaaggcaagggcatgcctaacttctttcctgagcagcgtggggatcagtgtgtctggaataaagtgagatggggaaagtggaggagataaagtgagtgaagtgagggaaggccagattatagagagccttgtgggccacaggaaggacttggcttctgttctgagtaaatggaaggctattgaaggactttgagcagaggagtggtacaatctgaagagatcaccctggctgttctagggaggccaggagagaccagttgtaaaggtattgcaataatccagatgaaagatgatggcgacattgcccagggtgggagctggagaggtgagacaaagtgatcagatttgggctgtgttttgaaggtagagctttcagaatttgatgaaggaatgggcttaatgtgtgaaagaatgcaaagagtcaaaaaatactccaaggtttttggcttgaacaatcagaaaaaaatggaattgccatttactgagattgggggagactccctgaggaacagatttggggacaaactaggaactgggttttgaaaatctaaggttgagatgcttattaggtatccaatgaagatgttcagtaggtagcttagcattcagtggagaagtctgggtcttgtgagaggcacccgtatcttctatccctggtttaggcaagaggtgttgagagtccgagctagggcaaatatgagatacattgcgatggtaaaataaaaagaatcagaagagctggatgagaaagaaaagggtgtttgggatgagcggaacatctttagtgtgcagaaattctatcgtaatgcgtactgcgaaagcgttatttccaggggctttgattgtatgtcgtgaatgtatcaggctatgctgacgcaaagaagagagttgcattcaatagcaaaaatgcaaatcaacaaaccagcaactcattttgaaattaattggcatgaaaatgcaatgtgaaaaaaattttaaattatttttatgtctttttcagtctagtaattgattctcttattgagtgttttatgttaagtgctttatgacatggagttttaaggatattgcataaaaataaaatggactatactaggcctcatacacataatccaaaccaactccatgtctcattgctttaaattaacttcagctattacaaattttttttctgtcttttgcagctctccattgattttttctttcatctcctctcagtgacctttattacagtctttcctgatgctagtccctcctactccatttcatcttttaaatttctccctgatgagataccttatcttgctggtcctatttcagatggagactgaattgtatagattccccagagagcctgcatcgaaccaaggaagtgactgatatttctacaataatatatctgagtttgtaaaaatgttcttccatcctattactgaaaattgctattaattaacttagcaaataattatttggcacattctttttcctaggcaccaccctaggccctggacatacaagtgtctgtccacaaggtcaatgtcacactttttatgctattggcatttgtaatgaaataaaaaaaattattcataccccaactcagatgtgtaaagataatgcaccttctttaggttgtccacaacagacacccccctgccccccacctaaaaagatgccagaaaataactcctaaattttagtctagtcttaaaacctggtgtggtgcaaccattaaacactctccttaagaaaatgctcaatccctttaggtaaaaatgcttgcctctctgatatcctctgcaagatggtggctaggtgtgtgaggacggggtgtggctcagtgaccttggctggaggaaagaaggcgttgtctgtgctcctatgtggctctctgagtcctcggtggcctatgtggcaatggcgtcttttgtgtgactcatctccatttgctctgtgagcctcctctgccattgtctgtggtctggtctctcagcctgatgaagccacagtggtgcccctcaactcctgtgggcatcacagacccctctgagctctgcctgtcttccattcactgcctggaccagtctaactctttgcccctcaccatcacaggcccattacatgcccatcagctctcaactcagctgcttcctaaacacccacccactcaggggcatgtggggtcttctgggccctacccatgccacatcaataccaacagctactcaggagaaccaattctagttctcctttggcaaatcgtgctgccccaccaagctactctgatgtggccccacaggcgagggcagcacagcctttgagatgagctccttccagagtcccagatgtgaagcaaacatccgcctcacgctagtattccccataacctgtctaacattcctccctacccctgagctgaggcctcaaggaagagttctgggcacactatcatattctcctgccttcctctctgtattagtcagggttctccagagagacagaactaataggataggtagatagatatggatatatgagacgagatttattagaggacttggcacacacaattatggaggctgagaggtcccacaatatgctgtctgcaagctagagaaccataaggatgtcttagtccaagttggaaggcccaagagccaaagaggccgattgatataactctcaatctgagaccaaaggcctgagagccctgggaggacaggtgcaagtcccagagtccaaagttctaaagaacctgaaattctgatgcccaagggcaggagaagaagggcatcctactccagaattgagagggggtggggaaggaggagaggaggagaaggggagagggtgaggggtacggtggatgaaataggggagagagaactattcgcccttcttctgccttttgttctatctgggcccccagcagattgattagtgcctgcccacattgagggtggatgctccccactcagtccaccaacttgcactccaatttccttcagcaacaccttcacagacctgacacccagaaataatgcttcagcagccattgaggcatctctccatccagtcaagtcggcacataaaattaattatcgtactctcccttctttttactaatagtcgcctagtccagaagatgaagtgtttcttttgcatccctttccttctgcccaggatttactgtaagtaacctgggctggaagaggtgggtgttgagctgttcccttcctctgtccacttcctccctccttgtttactcagcctcatggctaagcctgaacagcacatgtggagggccagagaaggacagagagggttaacaataaattaacctcagttgagaggtattttgaaaatactgttatacgttgaaggagaactattttttttttttttagctatcaaaagatagggaaaaataaaaaaacctcagctctcaaattctggagcaaagagtaagccttttgaggagataccttgtgattctgatgactccgtgatacacgtttctactgcagtatggtctgactggatgtaaaagtagcacagagatttgaatattataatatttcagttataaatcccatacacgaagaggaaactggaagagaaatcttagaaggaacattaggggtcctctaattatttgttccctccaaataggaaccctgatttgtatctctgtatccctctgacttcctacataagctaagtactatactaaggaaataaaacgactcagcaggcatcctctcatagctgaacaacctccgttgtgagaaaatctctccttacattgagtcaaatcctctccctcccgcttccagatgttgtttctggtcctgccccctggagctatagaagcaaactgtaacttctttctccaatttaatatcttacaatattctgcctcttcctcaatctcttcttctccaattcatggtgtatgtgtgtttctttctttttaatttctgccacctggatactccttcccaggaacattccattctctcttgtagtgcttctcttaaaatgaggtgcctgtgggtgtggtagcttgagcctgtagccccagctactccggagggtaagccgagagggatgggggaggctgcagtgagctgtgattgtgccactatactctagccagggcgacagagcaagaccctgtctgaaaaagaaaaataaaagaggtgtctggatatgagcaccatgccccagctgtggtcccctagcactgagtctagcaggatctggatcacagacttcttatgccggagtctattaacagagattaataaatgtttgctccacactctattcccaagaccgcgtggttctctgaaacttccagcttgagcctttagctacacctgccaagaaaatattggatatggatgctgtcatgcaatccacttcctttctccctacatatccctgcctcagctgatggaactcagacgccggacttgcccaggctcgtacggttagtagaggcagagttataaaaacaagtgctaaaataacaaagcatagagctactgcactccatagtaaagaaacaatagttcaaaaagaaaaaaagcccaggaaaaaaacaagattttgtttagtccttttgttttctctttgttgtctcaatatcttacccgatcccccaaccccaccccagcttttaaacatccttcacatgtgtaggcactattcaagagtcctttaaaaagtagttaccaatgttctactagaagaagcatacaatcacaatactatactttctcaaaatgagacaccattatggttagcatgaatcattttgaaatggatggatttgttccctcccccaactggtaaactattaggttactcacccttcgtatgcacatctgtaaatacttaattcaactctaatgaaatattaacctatgactattgcattaatacatgtataataggaagtatcttagattactactttgcctcaagtaaagtgaatgcaaaaatggtgatataatattcccccaagaactgcaaattttgcatttcctgacatggggtaggttttaagttacatcatatactttgaaaaaaatatagagatatggcttctgggttagcatggcagcagaaggctgttcttgatacagttcctcctgccttcccattaaaatgccatgaggatagaccaaaatacaaaactgatgacagcactggaaactataaataagacagtgctgtcggcctgcagtggggcagaccaagaagaaggaagaggaagcatgctgtttaatttgcctcctgcatgctctaccttttgaaggagaacctggcagatggccctagagaaggaaggcattacttagattcttccttcggcatctatacataattcaggtgcggacccgacactctagaaaaacaaatggcaatttcctaactgtgcaggagtcatgttctgcatgggctgggctcagccctctatcactgcatcagcatcgcgtcacacttatctggagattgttaactcccagcatgccatggaacaggaagcagcaggaaagagaagcccccgcatcctgcataaggagtcccctctcccttgagagcagggtggaaagaagtgtgctggaggtgtgtggccttcacgtcagacactgtttaaaggaaactgcccgctgcatctgattttcttggttagaaaatgtacaggctggaatgggttgcaggttgagtggaatgcatttctggggcttgcagagatacaacaaatgtctgcgaggggctcctttatcagccccatctttgggagttgaaagggccaagaaaatgccacataccttgtctgttggcaaaccctgagtctggatctatttacttcattcatagatgactaaacatgttttaaaagtgaggtttatgaaaggtttatgttcttgccattaataaacagtggatcacctgaggtcaggagctcgagaccagcctggccaacatggtgaaaatccgtctctactaaaaatacaaaaattagccggtcgtggtggcaggcgcctataatcccagctactcaggaggctgaggcagggagaattacttgaacccgggaggtggaggttgcagtgagccgagatcgtgccactgtaccccagcctgggcaacagagtgagactccatctcaaaaagaagagaaacaaagtttaaggataattttctaagcctaaagacactagtagagtaactgaaaatagaatttctgaattccaaattactgcagaaaattcaagcaaataaaacattattttaacacagcacagaatatagagtgaaatatagaaaacaagggaaacagacaatacaaaaagaagaaaacataaaatgagtcaataaagacaacctctttcataaaagacataaataattttttttttttgaggcgtagtcactctgtcacccaagctggagtgcaatggcgtgatctcggctcactgcagcttctgcctccggggttcaagtgattctcctgccttagcctccagggtagctgggattacaggcgtgcaccaccacacccggctgatttttgtatttttagtagagatggattttgtatttttagtagagatagatgttggccaggctggtcttgaactcctgccctcaagtggtccacccacctcggcctcccaaaaagctgggattacaggcgtgagccaccgtgcctggctgacaaataaacttatacacttaatttctgtggagaaaacaaaaaatttacttaggatgtgtgagaaaacacttgcctaattgggaaccatactgtcttggtgatgagagaaactttttattattatttatttatttggagatggagtcttgctaagagatattaaaacattttataaagctatagaaattaaaacagaggccagacatggtggctcatgcctgtaatcccagcacttcgagaggccgaggcagaaatcacttgagctcagaagttcaaaaccagcctgggcaacatggcaaaactccgtctctacaaaaaatacaaacattacctgggtgtggtgggtaaacagcattgtactggcataacgaaagacacatcagtggaatagaattcaaattaatggacatcagatgatagtcaataaatgatgttgagaaaacttgctggctccctctccccttccctccctccctcacctcccttctcctctcctctccgagacagagtctccctctgttgcccaggctggagtgcagtgcagtggcactgcaagctctgcctcccaggttcaagtgattctcctgcctcagcctccagagagctgggattacaggtgcccgccatcatgcctggcttgatggcgattttcacgggaaaaaaaggctagacccatattgtacttgtcggtgttaaattcctgagagattacaaattaagaatgcaaaaacttgaagaaaagatgaggaagttctttttgaagcttgccaccaaagacaaaaaccataaataaaagactgctagggtagattactaaaattaaaaatttttgaaaagggaaagcactccataatcaaaattaaaaggcaaatatgtgtttacaacacatatgacaaggaactaatatccttaatatataaagagttctacgaattgataaggaaagattagcacccaaatatgaatattggcaaaggacattaacagacaattcccaagagaatataaatgaccaatagttatacaaaaatatgtttagccttactagtattcagatatacaaaatgaataatcaggctgggcaccgtggctcatgcctgtaatcccagtactttggtaggtggaggcgcaaggatcacttcaggccaggagtacaagaccagcctgggcaacatagcaagacctggtttctacaaaaataaactctcaaagctgagacaggaggatcttttgagtccaggagtttgaggttacagtgagctatgatcacgccactgaacttcaagagtgggagacagagcaagaccctgtctctaaaaaagtaaaaataaaaaataaatcaaaaaaatcaaataaccagtggagagtatttattatgttggcaaagcctagaaagccttctcagtggtgtcaaagatgagtggaaatcaaatgtagctatctgctggacaaggcaccacgccacctctagcactagacagctcttccgacactaatgttcctggaagctgaatgctctttcaactgaaggagcttataggcaaggaaaaagcaggaaggtcacaggagtagctgcaatgtagccccattattgttgaagggcagatttcacgggagtcattaaatgagcaagctggaaaaataagaggctgtggttggatagcaggatgttgaaattagtagcatggacaatggcatcttttctgaaaaacaacaggttccgagttgaaagggtgggagaagatggctggggtggtttgcgaggcaaggcctttgacaacgaggaagtcagcgaccaagagtctgagatttttggatggctgttaaggtggactgtgaagtcccccaggatgatagcatgcattggatagtgatggaggctgtgagtcaggtgcaaatgtcaccagtgaatgcaaggaagatactaggagggctgtaaaggggagcatcgaggtgaggagagagtgatggagcttaaaaaggggctttttttttttttttttgagatggagtctctctctgtcgcccaggctgaagtgcagtggcgtgatctcggctcaccgtaagctctgcctcccgggttcacgccattctcctgcctcaacctcccgagtagctgggactacaggtgcctgccaccacgcctggctaattttttttgtatttttagtagagacggggtttcgctgtgttagccaggatggtctcgatctcctgaccttgtgatctgcccgcctcggcctcccaaagtgctgggattacaggcgtgagccaccacgcccagccaaaaaggggctttttattttcacaacagagtaaggagataatggtctagaagtggtattttggagcaaggaggacaagatgccaatttctgagcctgaaatccatgaagcatacaaaaatgagcagcctctgttaagggggtcagcagaggaagtgatgtccttggtaccagttaagactgacgataggggaagtgttccatgaaaatgtggaagatagagaggtatttagtaattatggaatgagaactctgaagtaaaagagaagagggttgagaggaagaggagaaaagtacagttcaagtaagagagaggatgtactgagctgtacagtgatgaaggtcaggcagatatccaaggaaggaatcacaaggcatcttaccccaagaccaaagatttcgtcagtggagatggtgagtgagggtgcagtgtggagtctatcacctgggtttatctcccatctcaacgcaccatggactcagctttggagaggaatgggtataaacaatgaaagaggagtgtcacagtgtgatgagtatactttgctttacaagtagcagcactccaaattaaattagcttgagcaaacttgactcatttctacaaaccataggcagggcagggtaaactgggcctgaaatcaggtctgtacttctctctgcaagctggcttccttgtctcaaaccagttctagaaatttagtacccagcaactcccaagtttacatctactagatttaccactctagagattagagctccttgagttcaaacattccagggaagagccctgactggctcagtttaagtcaattacccatttctagccagtaaggaagactaaaacatggcaacagtgtaagctgcaaagatagttattccccccactttgcaatagaacaaggggactctattttttgaaatggagtctcgctcttgttgcccaggctggagtgcagtggcacaatcttggctcactgcaacctctgtctcccaggttcaagggattctcctgcctcaacctcctgagtagctgggattacaggtatgtaccaccacgcctggcttgttttgtatttttactagagacggggtttcaccatgttggtcaggctggctagtctcgaactcctgatcttgggtgatccacccgccttggcctcccaaagtactgggattacaggcatgagccaccacacctggcctgaacagggagactcttgtgcaccagcagcagctgccagaggaggcagtagcagcgtctaactaagctgcagtgccttgtggacatgagtcctccctatggaaggagatctgacaaagggaaagaaaaaatatcctcatacagtggacctaacttactcagaatgcatgagacacactctgggtgatcccagaaatgctcgctaattggaggggaactttgcagttgggtgctgtgattgcagtcgggggaaactagtgaaatccaaggtcccatcatcaaagtgacctcctatataattacaagctggaatgacattagggaacctaggctacagagaaagaaatgaattaacaagggaatggctaacatgcttcttacaatgaaaaagccaatgtgaaggtaaataaggaatactttcgctttcacaaaacactcacttggcctttcttaaacaatgtttttcagatccaggccttacctttcatagatctaaaggagtgcctgaaagctgccaatttatttaagagaaaggcctaccagagatatgagctgtgcattctgaatccttcaaaagattgtccttttacctaaataagaaacacctctcatatttcactgaatctaaaactctatcacttgtaagacacatcatgttatattgttaggctataataaaggctgacaattaaactctaatatcatgctgttttatcacttagagtttgtatagttatttaaagaacactttaagattatttagagacagatttttatcatgaattactcttatgtgtacctaaaagaaagaaaatataagcaaaataaattggttgcagtattcttaaacttcatgttcaaatttggctcttctaaattagtttttgaattagcattgttgaaaactgctcctttccctccttacacacacacacacacacacacacacacacacacactaccatctttgaggatgtgacattttttaaaatgagttcttcattaatatctcctggatttttttcccagccactgatcactcttctgcaagttttgttgcacatgtgcaaacagtgacagccccatcatcaactgcaacctagccaacaggtttaagacacatcccgatttcagatgttaaaatgtgaccagaaaaaaagagtgttttagaaccaataagcacagcattcatgagttataacaagaagtgccacgtgaatgccaagggcagaattcctactgacacttaagattcaagacaatgcagtggtaacatcattttagtaggaacagtcttctccaacatactgttgccaagtctgtgacttctttacaggtaggcgttttctgatgagaccaaccctagtggtaatgctgggatggttacctttgaaagaggcttacgtggcttaaatcagaaagacaaatcatgctttacataccttgctattttttgcttaatgatatgttttccagacctttccatgtaagcacttgtaatgaattcattctttgtaatatctacataacatcccattgtatggatgagccatgattaatttactagttcattactgatgaacttttttcatacactttgaacatacactttactggcttccagcctttttgttattgcaaataaggctgtagtgggcatctttgcctctggaaatatgaggaaccattaatagaggttgcctttcaagagtgggcccagaggcttgggataagaagacttccttttcattgtatactctattgactgtattgatttgtgctctatgcctttattattttacagtttggaaaactgatctttttcaaagtgtttcctggtttggttttgtttggttgttgtttttgccttggttttaggatgaatgttaggcttaggcctctttactgacactgctctaagctgcgagcctctggttccttgtttggtttttttgctttgttagactttagcaaaagacaattggcctctacaaacccagtcaagttctctcttcccaccccaagctagaaagaaatacttaagaaaccctctaggccaactttgtccaacccacggcccacaagccacatgcagccctgaacagctttcaatgtggcccaacacaaattcataaactttgttaaaatgttatgagattttcctgtaatttttttttagcatattagctattgttagtgttcgtgtgttttatgtgtggtccagtacaattcttcgtcttccaatgtggcctagggaagccaaaagattggatacccctgctctaggccatctgcattatcaaatgctacattttttctgcatttccagacaggagtaggggtatctctagcctgcaataccctgtaggaattctgcattatgtttcataaaggagtccatatcctctcttcccttttccttttagtcctgaaaactggcattcacatttcacaatgccctgaaagttccctctctatggccttaattcagaagtaatctccagttcttaataaggcctgttgtaatggacatcttgtaattcgatatccttgctaacaatgaagctgtattacacagtggttaaataaattgttcttctgtgggtaagtgtttttaaagcattttttttaataaaaggatctcatcaatttcaaaattccatgattttgaaaagttttatttagattagcattctactctttgattctcttgttgatacccttgtttgacagtacttgactttgtttcatcccaggaatattgaacttccagagtttgtgttgtgatttttaaaaaaattcacatttcataaataaatagggagaagagacaaatcttctcaagtaatatgtgtagatatcttagtctttcacctccagccacccagcatgagctgtagctagtgactcacttccaaaagtaaagtatgaaaagggaaacatggtaactttacagtggagaaatctggcaaacacccccccttaaccaaatgatcaaagctaacatcatcagtggtgccatgtggctgtcagttacccccggatgtgatatcagaagggaacatgacttcaatgtattcttctacccccaaaaaatccctaacccctcccaagagggagggagtgtgttcccagaagaccactgtatctggtcttcctataatgagaaaatacatcagacaaacccaaatggatagacagtctacaaaatacctgaccagtgttcttcaaaaatgttcagggaatgaaagtcagagaaagactcacaaactgcagcagattagaacagacaaaggagacacagcgactaaatgccatgtgggacccaaaattggatcctggagcagaaacaggacattagttgagaaactggtgagatctgaatagcattagtcatgtacccatgttggttttataatttgacaaaggtgccttggtaatgtgagataacacgggacacacactggatgaaggggtatacagaattatctgtaccatcttggcggctcttctgtaaatctaaaaggattccaaaataaaacaagcttatttaaaaaatttacatttgcattttctcttttcaagattgtgaaccaatgaagttaggactttgtttagcctgattttctttatctagagctttacatatgatgaaaaacctgctgtcgctgctgcaaaacagagttctcccttctcccctcagtctgacaaccagaaaacaaaaaggcaagaggccagcaccaacagtcagagcaagagggagggagtgtgttcccagaagaccactgtatctgcgctccctggctactagggtgccaccatagtcacagctgctgtttttgaaggtagtgatgaaaggggtcactccaagacctcaagctgctgccatctctctcaatagcacggactgctggtaactgcaccatgatgagcaagattcataccaatgggctgggggaaatccccaaacgctggtgggacctcgaccccagccagggtccaggctcttcacactgtcatgagaattaatttaaggataagttgcaaaatagtgaaagcacagagatttattgcaaagagaaaagtacatactcaagaaaagggagtgcaggtatactcaagagagagttgagcacaagggggtttgggcctgctacatttatgggtttctttaaacaaggggtggaatattcatgaaaattcctggaaaaaagtggagatttctcagaactgtggtgccacccatttttacaccaaatatgggtgttcttggaactgtcatggtgctggtgggtgtgtgatttgtatgttgataagcatataatgaggtcctaagtgaaacctaggtcaaatccagtgccatgttgtatccagttggtcttagccagcttggtccacaccctgtttttcagggccttaccagctcataccttctgcagttatttcaccagtttccttttgctggtcattccagctgaaattgctgcctggaattttttattctcctgcaactgccctgtcttaagatggcagcaacatcttccacaactgcatttttagatcctgttgtttttagcagaatttcttggaacaatcatacgagttatgtgaataatattaaaatgataaagatgctgtaaaccacggagaatcaataacttctttcaaaggattccaatccacaaggagagagggaaacaaaaagatttttatcactgagccaaattttctgacccacagttcaaagacgtacctccatctccagctaaggcagactgtgcagaatttttgagtcggtggaaagattttgcttctcttccctccatccttcaggaccataatcaaatgttaaagccctaaccctccatgtgactatattaaagatggagactttgcagaggtggtgcagaggtggttcaggttaagccctctctccaccatgtaaagacacagagagaaggcaactgtctacaggccaggaagagaggccgcaccagaaacagacccggctggaccttgatctgggacttttagactccacaactgtgagaaatacatttccattgtttaagccagtctatggtcatttgttatggtgacccaagcagaccaagacagcttttctcccttctgcttttccttttatcacaagaagggaagaatattacaggcaaaattctgaacaaagctgtcatcaacaaagagcctccatcaattttaatcccaaagtggctgctgtgtaagcaacaaggagagtgatagggcaggagagagaaagagatacatcacctttcctaggtgacactcaactccctgtcacaaaggcaaagctcagctggtcagaacttaaaattaccaatgacgatgatgatggaaaaaattggtgtttagagtttctttcccctttttaagacactactaatggaacgacctggagtttcttcttgagtcctttaaatgcatctggaagtgaactcacaaaatttccccatgcttttccccactgtagaggtctctcaaggctcttgttgggaatcgcatgaggtaatggatgcaaaagtgttttgtaaaatacaaagcattccatgcatgccagctattattggaaggaagcagaaggatgaatttaaatcccaagatcccctgaaaaatgtgtgaaaggtgcccccatttggattgtcatctttaccgtacatttacagaccatttagcaatttctccaagtgcttactcccgttccctcggtgacatccttgccctgtgctggggagggcagagaaaggctgactctcccaagcctggcccagtggacagcagcagggcctgcggaggaaggggcttggttgctaggagaccagcaaaagtgggcagccagttcccaagcaggttagaatccggcgaggaaggattttaaaagcctatttccgtctgcttctgctagaattgaaattctcttcagggtccagccaccagtgatacaatctgcttacattactggtattgagaggcccttgaaagggatctatctggccatttcttgtgtctccctcccacagtgcctagaaaaggcaggcacttaaaacaaaatgaaacaaaaaaaaaaaaaaaaaagaggagttgatggagtctgtagcagaagcagagaagtgacagcaagaattaacccaagcacatctgatcatgacccttagacccccaaagaggaaataattgtgctcaatctatgttaaattacagtgcaccttccatagcttctgagtacatcaaggcaggtggctggatagaactgaaagtattttttcaagccctcaagaggtgtgtcaagcgggtcttttcctctggagtttatcttcacagacgcaacctgacatgtgcttctgggctaattggatgaggtcgacactgcatttaagttttccctttgaggattatgaaaatgtgattttcaaataagaattatttgtttggttttgttttcccaaagcatgcagtacacccaagaaatcaaatgctttttcgaaccccctgagccctcagcaagatatactgacacttacaactgcctagaacacagtattgaactcaggaggaatcagctggaaaaacagtggaataataggtgcatttagagtcatttatgggctgaggcttgacagtcttcatgccttgttactgctgcagcattgagagcaaagcggcggtgctgattcatcaggaagaaagaagctcgcaggtcataggaaaataaactatctcggaagaggctccagtgtcctcagcagacatgctttatttggttaaagcataatgtgtaatggcaaaatggaagaacaatttcagtatttacagggaaaccctggcttctagcctgcttttataggcagttggaggtgggggtggggggactccaaggggatgcagtaattggttgagaaaagaacaattcaggaaaatagaggacacacataggctagtgcctgtctcatgaagatgaagatgaaggcagacctgaaaacacagaaaaatgtgtcttgagaaaaactaaaaccccttcattggcaaatggtagggcgtgtgaggaccacaatggtgagctgatgcagggaattgcagcaaggtggggagatgaaagaccatgatcctgtgcatgcaaatgagaaataactgaatgtcacatatgcctctgcatctaattcactgagtgaaatgggcaagctctaaagctgtttccccctaataagtgctttgcacatggtgactattttggtgagtggaacgatcgtgaactttggggtcacacagacctgggtttaaatcctggctctgccagggaccttgggcagtgtcggagaagacatttaattttctgagtctccgttttctcatctgtaacacaaggtggtaatgatgcctgtgatggcttcctccagtgcagaagttctgtgaaacagcccagccccacctgccttcttaccctctgtgttcccactctagattcagatacctgggagtgagggtggtctgagtggggactgtgattgaaggggtagggccccattattcatagcttttcctggaatcacagattgtgaggaagtggcatttctccaaaaggagagatgcctggcagacaaaaacatgatccaaacaaaacagcttgaaaggaatttttgaaccttaaattgaacacgaggcaaaactactgcttcagaagtttgtgataaagtggtggtagctttgcaatttcaaagaagcatcactttgggatttggattaccctggcagtatcgtccgcatctcctaagaggagaaccagggacttgtcatcagatggtttctcatagccagggccacctacatatttaaatatccccactgcccctgggttccaaagggcaaacttaatgccatttgccaggcattggaacccatagggtcaagattccctgaaagaccccttctcctccttcctgtatgaatgaatgtgattctgtaggcctggttcctcacctcaaagattcagctttggaaacagcagataagtaagtaaaagcaggtaccagctctcaacaaatgctgcattcaggcctggttagcaggtggggcctccgctcatttgttttttcattttggataaatttttggggggtcttttcccctttcaaacaacaccaggaccccagcaggagcagttgaggttaggcaggaaggcaccaggggctagggctggggtaagactctcaatgagaaccaaagaaggggcagctccctggctttctgctccctggtggggcggtctgtatgattgctggtcatctgagcaccaggagaggagcagcccaagaggtcccccaggagagaaggcatctgctggcccaggtgcaggttattatggcagcagtccaagtctttctgcctccagcctctcaagctagacataacctggccatctgaccagcagccagaggtgcttctgggaagagtctcatttgttggtccctctcccctttcccagcatggatcttactaacccccaacaggtgaacaggtgccaggcctggaaagggcctagttgaggttgggtggggaagatgcagtcctgctttcacatcccagaggctgagacctgggcaggtggggagaaaaggagcaccagctctgcttccagcaactggcagccacgtggattctctgcttgtactgcaggaatccaggaacacccgccacacctgaagcacccttttaaggaaagtggcccaaaccagttctttcttgcgtcagttgctattgcttatgctatgttttgagcgaaaccaacttggtgccctcaccataactggcttcaccagacatggatgccaagccaaaggcagccacctaggaactggacatgacaactgcatctgagacagtgtagcataaaatctgccccataagggcccttcatatcagaaggtagcaaatccacccattatggagtgaattgtgacccctctgtatttatatgtgaagcctccagtatctcagaatatgactataattggagctggggcctttaaaggggtgattacattaaaaatgaggccattactgggcacgttggctcacgcctgtaatcccagcactttgggaggccgaggtaggcagatcacctgaggtcaggagttcgagaccagcctgaccaatatgatgaaaccccatctctactaaaaatagaaaaattagccaggagtggtggcgggcgcctgtaatcccagctactcaggaggctgagacaggagaatcgctcgaacccaggaggcagaggttgcagtgagccaagattgcaccattgcactccagcccaggcaacaagagtgaaactctgtctcaaaaaaaaaaaaaaaaaaatgaggccattggattggaccctaatccaatctgactagtgtccttataaaagagaacatttggatgcacacaggagacaccaggggtgtgtgcacacataggaaatgctatatgaggaaatgccatgaaagaaggtaagccaaggagggaggcttcagaagaaaccacacctgcagacaccttgatcttggacttcttgcctccagaactgtaagaagataaatttctgttgtttaaaccacctagtctgtggtattttgttatgataaccctagcagactaatatacatccaatttatttctctttttaggggagttaaggacgaggttaggatcactcatagtctccttggaaggactggaatctaggcagagtccaactgaggagataatgtcccatatgaccctgtactcttaactatcctggaaatccatcctcatcccgagagagcctcatcaccttttgctcaaaaccttatggagccaggttaatacacaggaagctcctgaggagcaagaccaagaatgtaggccttgggtgtgcacctgggctgtgctgggtcaggtagaagccaagagaactaaacggttttgtcacccagagtctgggtgacaaaatctcaggccctggtggggaagatgaggcactttaggagacagaaacaagagaaagtaaaagaataaaaacgtgtatttgtgtttatgagaaacatcaaatattaatggggctctaactagacttacagactaggagcaagcaatcatgtcaagtggcagggtccatggagagtggatgccatcctgggggtgggggaggctggggccctggaagtatccctcgggtgtaattcctgtattggtgtgaggtgaatagttcctggtgaggacaaggcttgccccagtgatgttgtagattctaattcttttttttttttttttttttttttttgagaaagggacttgctctgttgcccaggctggagtgcagtggtgcattctgctgactgcaacctctgccccctgggctgaaatgatcctcccacctcagcctccagagtagctaggactacaggcatgcaccaccacgcccggctagtttttgtatttttagtagagacggggttttgccatgttgctcaggctggtcgtgaattcctgggctcaagtgatcctcccatctcagcctcccaaagtgctgagattataggcatgagccactgtgcccaccccagattccaattcttaaagctgaatattacctaatgacttcctttttgttcttcttgataaaagtaaaattagatttctttttccataattggctcgcaaaatgattaagccaggtatttaggcagactgttattccctctttcctgcagttgttgataagcatattttaaaagtgtttgaggaaaatattgatattttgtttctccacaaaggttatgttactgtcactctggatttttctggagagatgggaatccagggaaaggagataaacttgagccaccctttcaaataagtcctggcaactgtgtaaagaagttaaaagtgtggcaggtggtcaggcagggcacagaagaggctccttgtgttctcacgctccaacacgtggtctgcagtattgctttcttctctttgatttgatttgatgtgacttgatttgatggtcttgccttgctcagctgagaagacgccagcatgagaaaggaggggggtgtgggagaggcacactgtcctgaaagcagtgggatccaggggaccggctctattgctcagtggggagtttgtcctttcccttcttgcattgcttgagggcttggccagggctttggggaggagggggacaaagggtaagagtgaagctggtttgcaatgggctgtgagagtcctagctctagtagcagcccagcagaagcatagaaaccttgccaacagccagatttatctatttacttatttattttttgagatggggtctctctctgtcacccaggctggagtgcagtagtgctatcacagctcactgtagcctcaacctccctggctaaaacaatcctcccacctcagcctcccgagtagctggaactacaggtgtgtgccaccacacctagagaatttttgttttttttttgtagagatggggttttgccatgttgcccaggctggtcgcaaactcctgagctcaagcaagcctcttgcctcggcctcgcaaagtactgggatagcaggtgtgagccactgtgcccagcccgctagatttatttttgttctgccctcccagaaaactaggatccttagaactcaccagtggtcctgcagacaagaggtattagtatgggctcagccttgcaccaacggggctggttgggcgagcacctgaacacccactagggcaaggagaggggcagcctgcaacagatagaatagggatgtgacatagggtttcttgacaagctttctaagatcgtatccctagagccttcctcaggaaggaaaacaaatatgatcccacttatttgtgagacttcccaagagattgtcgtgtggtggtaagaaaacaatttcagatatgtaaataggcttcataggggaatagaaattttcaataagagaacattaactctcgattctgattagtttagacatatcctctgcttagagagaaataggtaggttgacaagatgatctcttgagaattttctcagatctgtgatactatattttctctgggctgggtaatattccaattgtactacttgaatttatgataaaggaaatgagtgacaagtatctttttattatgcgttctgcacaaatatgtgtgcatgctgtattataagtctgcttgcctccacatttatttttcactccagtttgacattgtgactatgcattttgaatgacctaaataaagatagttttagaagagttgcctgtatttctgtatagccttggaagaatgacctctttaacaacaccaattccttcagcagtgattcatttgagctcccaatgggctgcaccagttctgtgtgttacaagggtatgtgaaaggctgaatgtagggctgtttaaatcagagtttgttagaggagtgttggggaagctgcagggccaggggagcagtcatcaaaatccggaaggcagccgcagcacgtcacacccgggcaccagaagccagggaactcagagcccatctgcctggatgccaccacagctgctcggtctttcatatgagaaccagattttgcatttgagggaaatggatgaaagcatcttgttcatttgtcttaaacttccaatgagcatataaaacacacaggaaactagcaagaggcaatatgcacagaaactagcaggaggacagcaccacgagaagaagaaacagcgaagcagaaggcctagagtagagaaagggagtgaagagtttgcactacagtgaagttagctaaaaagggtaaggtgtgtacaaatcaaaagagtaaagaaggaaaagaaagttattccagataggatggtgtagtacaaagagcctagagtcgcagtaaaaaggcttggcctcagttcaccaatcactggcagttttatctgggaagcattgctttacctcttctctagttttcagctgtaaaaagaaaaggaaagagaaaagcaaccaaccctgagtgccttccctgtgcacacacattacatatgtaacctctcttaatccttagttcaaccatgcgtgggaagtattattgacccccagtttactgatgagaacttggaggcataaagaaaaaggcaacctacctaaggaagcttaaagagagtaaatggtctgcccaagttcacgtggctggtatattgcaaagtggaagtttgaacccagatcaatctggtctagctcccagtttttcccaccataaaatgtactcgcccctctttatcacagaaacgagagtttaaagggcatagggtatatgaacgaaagcattttgacaattgtgaaaagcaaaatagatgtaaagaattcttattatttaaagtcaaatctctctagacaagcccacgatgagatagtggaaaactgtggttcagagaaatgtgctcacttgccaagtcagtgacactacttcccagatcaccaacagtaataaagtgagttaatgactgaataaagcttttaatggtgggttgggctacatgacctctaaggtcctgccgagtcagtatttctgagaatcaggaattttatcaaagcagtaagaatgtagctctgcgctggatctgacctcagagaaaactgtaatgtcagcaagttgcttcctttttgtctctcatttcatgtctctgttctttcccccactttcaacccccttgccaggcagtcatcactcttgaggctatctttaggttttgtgtgccacagaggtgaggaattcgataaacatatgcagactaagggagaaaaaggctacatttgactattggctgcagccctggaagggtgtgtgatctgggggcttatcattgagcctccctgaatcctggattgctcatctataacatgagaaaacctactcatagagagtgttgtaggaattaatcaatgtaacatgtaaagcgcctaccacacaattcaaactatttcgtgttagtttccttcagtcttccagatgcagtgactgttagcagaatctgatatccctctaagaggtgtctacatatacgaacaatgatacctggagaaggcaattctgtacagagtaataaccagtcctatggtggatttgtttcttgcggtgaggcatctgagtggaagagataaattgaggggaaaggagaggggagttgtatagatgggacttcctgggcttctcccagtttactccctaatctagccattccatagcattgtagttacatgaccaacctaggtacaacaaagtcagaatatttccttacttaacttgatacaatttcaattacttaaaatgactttttcttgtatcagagaagcttaaagaacggttgttgcatgtggacaatcaggtaaacctgacaaagtgccgtatataagaaaataattccagggacccagacggtgtttgtccagaaatgggccatctacagttacaataaaatattgaagagtttaacaaacactgatctgggcggaggaggagtttggagaggatgcctctcagtgcttccttccaaaagggtactggtcagaaagtttacagtctgactgcgaaagcctggatttctttggagtcaagtaatcacttatgtactgtatttacttctaataagctggagctgttaaagaaactgagactttcttttcacagctgtagagtacagggatttttgtctcttttgtttactgcatatttccggtgtctataatagagccaggcaatagacatatgtaaaacaagtgaattgtgaaggtgatacttccaagaagtagctcttcagaaccactctagatacactttagcaggcagttggctaacaaattcttagaaatacagtaaatgtggtatgatatctatttttttttaagcttagggatacttaaatgttactgccaagtattcatatgtgtgacacagagccttctcttacagcctttgccttttgttaataaacaataaataattccttggaagcatttgcccttcatgggtaattggagaaatgtttactttggtgatgggatgagaaagatgtgaccttttaactgttattcaactagtaggtgagggaaaaattataaaccagagaagataatattctggaaagctttcaaaaaataaaagaccaatgcggttcaatgcagtaccaaagttttctcgtttccagctctttttggcaaaaattcttcttagtcaaaaaagaggaaattattaaaagaattcatgaggtattcttagatatcaagtagtgcttttaaagtatattgttaggttgaaaggaataaaaatcataattaaatgtcctttgaaacccatatgtatttttaagaatagatgacaaggctgggcacagtggtgcatgcctgtaatcccagcactttgggaagccgaagtaggaatgttgcttgagcccaggagtttgagaccagcctggccaacgtggcaaaaacccatcgctacaaaaaaatacaaaaattacctggacgtagtggtgggcgcctctagtcccagctactctggaggctgaggtgggaggatcacttgaacctggagactcagcctgcagtgaactgagatcgcggtactgtgttccagccctggtgacaaagtaagaccctgtctcaaaaagaaaaaaaaaaaaagattaggagacaaattccagcaagaccacattttgtattctgttgaaaaacaaaattttgaaaatagttttaaatggttgaatacacagttctgctctctctatatctctccaacttacaaattttatcttggaaatgatagatttacttactgtccatttttgaattaaaaaggaaggaggttcagcattcaacaataataatttaggtaccagacctgcatgggggttggatatataaaacctgatttaaatactttatctgcttattttaaatgtttcatatttatcatttgtgtgtacatgtataatattttagaaatagttattttaccttatggcaactattcaaaaatatgtgcccccttaaaaatttgtttcaagctatacaggaagttaaaagagcagattgtctggctcaataccaggtacctggcacacctattatgacgctataagttcatgttgctctttcccttgaaaccttgagtgtgttttgtgccacctaggtgactgggtgaggtaggagacacccacaaccagttcctaggcaggaccctccccacagctgtggcaaggcaaggcccccaaagtcaaaagagagaagccctggagtagcagcaaacccgacaggcaggtttagagtctgggccctaattctgaaggacagcatcccaaagtcagagctggacccaaatggacaaccatcaaaccagtaagaccgtcagaagcagtaaatgcaacaggggaaaggtggggcccagaccatgaggaattccagagctggcctgtgatgtgcagtcttacaattactgtcagtctctgaggccgctagtggcctgtctctaagagttaaaggtgtcgatgaaggatgaacatatttataaattccttaagtgttatgttaggatctcatttaaggacagcgatttggtgttacctgacccaacactccgagataatggtccaggcaggatggagaagcaggaggatttctccccttaaagaagcagcagtgttggggtccttgtcctagagggatggctgaacctggtggaagaagggcatcccaagcaggctgccagagcaaggaagggccaggtgtaggggcagggtaggttgcaagacaagggagtagcagtctaaataagcaaagtaggaattagcctcagtgaattctggagactaagccagaactggtacagggaggtaaagaagattgtattaacaagattgtctactggggagaatgttagatattgttcaatgtcctttggagtggaggtgagactcgaagaggatggccatagataataacaaagagtctactaatttgccttctaaggagggtgacagattcaatagccaaaaagctggccgggcatggtggctcacgcctgtaatcccagcactttgggaggctgaggtgggcggatcacgaggtcaggaaatcgagaccatcctggctaacacggtgaaaccccgtctctactaaaaatactttttaaaaaaattagccaggtgtggtggtgggcgcctgtagtcccagccactcgggaggctgaagcaggagaatggcgtgaacccgggaggcggagcttgcagtgagcggagatggcgccactgcactccagcctgggcgacagagcgagactccgtcttaaagtactactactactactactactactactactactactactactactactactaaataaccacaaagcttttactgaggggactctagaaatttgggggccaagctggttagagcagtgtggatgaaacatagtggagaactgctaaagagagagacacaatactcatctagatgatgatgtctgagggtgtttccctgtggtatggatgttaactctctcctccattcctcccctctccccaaagaaatcttcagcaaattccatcttaattactgatgcttttgtgccagtggatgaaaaggtgggacataaaaaggtgctgtaggccgggtgcggtggctcacgcctataatcccagcgctttggaaggtcgaggtgggaggatcacttgaggtcaggagtttgagaccagcctgctcgacatggcaaaaccccgtctctactaaaaatacaaaaattaaccaggtgtggtggtgggcacctgtaatcccagctacttggaaggctgaggcatgagaacagcttgaacccaggaggcagaggttgcagtgagccgagatagcaccactgcactccagtctgggcgacagagcaagcctccgtctcaaaaaaaataaaaataaaaaggtgctgtagctgcatgaaggtgttgtgtggtagaaaccgagcacacaccaccttcagctgactgctgacagatcagatagccccctcttagccctgggtgcctccttccctggataagattgaacaaaggtctccacctgcttacctggtagaagttccgcatacttcctagcataaggtggaaggtgaaatcttgtgaccgcttttccagcccatatttcccctagcagtatagatagagagctagctgggtgatcactgggaatttagcaacttttccatgagaatagttaggctcttatcttggttccccaggaacatctttggggtatggagttgggtgtaggtgagctgaatgtagagctaaaaatgtggtgaacctgcctgcacaggggcaactggcttttaaaaaaagagtgtgtgttgggtgacttaagggcccactacagactccttcaattatcagcttgggcaaacagtctaaatacgttgttttgtgctgtaatgagaatatagttccttctggacaaagagaaaaatatggtgatattaacttctagcttgaagtagaataagtgaagctccagtctttattaataagtagatgatccaatgttagtgaagtggcttttatgtgccaataagttgtgtttagcagtcaggaatagaacacatttatcccttcccccacagccttctcctcagtccatgcaaaacaaattggagtgaaacaacaccatctgctcatttcacactcagtgaagaagcacgtcaactccttctcaaggttagaaagtccaaactcaaaaagacactcctctagttatgcagaaaaaaaaaaaaaaaaaagcctcctgaaagcaagaaccccataggcttagaagagtcccatatttcccaaaacatgacattgcaagggctgagttgatgagggctaaaaagctgagggcttccttatgagggtgtcacatggctttgtttcactagctaattgtatttctatgattttgtgcctctgatttagatggaaagaatggcagtagaaaaagactatcaataattaccatagttcttgtatcccggtgttgggaggaaaagaataaagaagaaagagaagtctggctcagtttgagaaggctgttttgttctgataattttcttttgtgtaacaaccacttttcttttggcaatcactttaaaaaatctaaatacttaaattaaactccattattttatccagagatgaggctttgaattagggaggaaactgagccatttgagtgtccctctatttactgtgctcagccaaactctgcattcagaagtaaagataagagaaagttcttactaattcatatgaatgccccagaaattagaggagggcagtcctttggccttgctaacaattcttaatctccacacagttataaccagccacctatttttaaaatgctgttcccaagaagaaccctggtgcgataggtggctggacttgttttagagaccagatatttgcaatacaaagtctgagaagaatcaagtcttgcaccaactatagcatacctcactggtactgataatttatgatattcttggagaaacaggagattaacataaaaggataaattgtggcatgccaagtaccaaacaagtgtgcattatgtaaaatcgtacatctttttattcacaaagctcttgtgccagagttttgagatttggtgaacaagaccacattaacttgaattcatccatccattcaaccatctgtcagtgtgtccatctgcccagcaaacattataccactgcctatggtgccagccctcagagttactgagacaaataaggcatggtccccgtcctggtgggggagtcagacttgcaaatcataatacctcaataagtgaaatcacagaagtatgttcaaggtggacaggtaatcaaaaaggagggagcagttgaaatatgaaagaaagattgcaatttaccaggcatgtgcattctaatcagaaggcacagcttgagcaaagcatggaggcatgacaaagcacagggtatccaaggagctagaagccgtgtgatattgctgcgggggtttgagtggcagtgataagagatgagcccagagaaataggtgcaagctagagaaagtcaaacctcataggccatgtttagacatttctctgtagacaataggcaacactggtgggatttcaggagggcatgtgtttagaataatttctgtgatggcaatgaggaaaactatgatgcatagaggaggaaagtgagaaaagtatagaaaacccaaaggggcaagttgtcactgtgttcaccaggctttttaaagctttgatcctatttcagcctttgtatttccagactgggaaatgccaatgtgagacaacttagtgtttgcaatatcacggatctcatagaaactaatattatttttaatagtatattaggggtcaagcatagtatggagtctgcttgtggccaagaggcctggggactccagctatcccaggccccactcaaccagtgcaaggcttgagggaatcagtagctcagctctacctgtaacccaatggagctgccccttgtgcctcgatgctactcagagtctatctacattggaaacgaatgaagtagtaataaataagctcaaccagggtagatctggaatccaaactccaattacaaggtttttccctcctaatctaaccacgctgcctcttcaagctgtgcttcaggagaattactctcttggggcataggaaaattcatagtttataaaagctaaacaaggaagctggggatattcagagctgacctcctagaagataatcatgttctcttattctatcaaagtcagaagaagaaaaatgaatcgtgtggttcacaggttattttccatgttgattagctccatatcattattcatagttgataaagtatctctgtcatccgatgtatatagacacaggagtttttggataaactatgaaagaaactagtgagtgagtgataaagctagtaacaaaaaagaagagtccagttcttctgagttacagctgactgtactaaccgtggttactttttctttcagagtttttggccaataatgttatttttaatttgctatttggcctatgaataattcatttaaaagaaaatctcaatatcttttgagcttattttagtgtccttattttagggcattgattaaaatatcagtctgtttagcatatcagcatgctgcctgtcagtcttcaggaaaatttcttctctctctgggctgttacacagttctggtggatttgttgtattgtatcacattgcattatgttaaaatatttccttcttgccattaactttacaatctggctgggtgtggtggctcgggcctgtaatcctagcactttgggaggccggggcaggagaatcgcttgagcccaggagcttgagaccaggctgggcaacatggagagacctcatctctacaaaaagtaaaaaattagtggggcatggtagcacgcacctgtagtcctagatacttaagaagctgaggtgggaagatcacttgaccctgggaggtagaggctgcaatgagttgtgattgtgccactgcactccagcctgggcaacagagtgagatcctgtctcaaaacagacaacaaacaaacaaaaaaccctgaaaacatcaagacaaaaagttacaatccacttattaaaagcacattctaattttttccttaatatttgtttcattgtgattaaaatagctaaactgacagttttgaagttatgtcaagttggcagaaacagtaaaagttatttttcctcaacttcatttctgtcttcaaagcaccacatctaggactaagaaagaaatgtgtgctgttggtaacattctacttcttagttgtcctgctgatactgccaacacagtagccaaacaactgtaataatttctggaaggcatctgtgaccttgacacttggcccattatgaacggcaccaaacccctccaaccatttcctataggtctgaaagctgctgtcaggcaataaaagctttcaattgttactgacttgggttagactcatgttctacttataaatttccatttagtgtttctattggtgtttgaatcagggaaaaggtttatttgaaatcttaaaattcattccgtatttctttcaatcaatataaatcaaaagcagtctcagaaaattgtcaataagtctggccaagtcagaagtaaatgtcaagtcttctgaaggttgcattttctcaaggaagcactattcaagcatatttgttagctcaattagtcttgatttagtagctccatcagtgagctaaggcctctggcactagcagagtaatttgatttctaaggtgtcagtaagagactaaaaactatccaaaatggtaaatccatgtcctgaaagcagacgtacagatcttgacattcttggcggcatagcagtcagggaaacgtgatgatctttgacactgtcttcatctgggatcagtgcccctcaatgtcacatgcctgggaactctgattttgaccatcagttcccggagagtgctgggaggtgacaggatggatgttccttttggaatgtcagttccctgaagtgatccttttacttctttcactgtctttagtggcaaaatgtacacgctgacagccctgaagacagcactgcagggcatgttttagaaaaggagaatgttattgtcaaagcctatcaatctggtctcttttccccctcacttcatccagaggccacaaaactaactttctgctgctcagacacgtactttgagaaagtgtagtcacattgtaactggggctacttaggacctcaatccagttggggaagggtggcttgcatcatctaggtgaggggtgaagagaacgggaccaagataacctaaaccactgtattatatccttccctctcttaactccctgctgaactgatctgaccagtgtaacatacaaattaattatttatcacctccaggaattagaaagcaatctgcctggcattcccgtctcaagggtaaatctaagctggttacaaaaaaggggagggttcattggaccaagactgaggagtttcacaaaattgaaagtgtagttgaatgtactataggtgcagagatccagctggccgtcaggaacaccagaaactgggatgttaatgacattcaaatgttgtctcattcatcacggctaagattctgtatgtcagcttcattatcttttgttggacactcgttttctccacatgttgaaaaacatggcctcagacatttcctgggttttaaattttagaccttaaactactggtctcactctctcagtacttcaagtgaaagtattatgggtttgatttaggtcgttacccataaatgaaccagtcaactacagacagtggatcagggtagtgtgattagccaagcttgggtcagatgtctgcaccaagctcaattaactgtggccaagagatgaaggtcgtactgtaataatgtggtagctctagtggcaaccacgtggttggaggaggaatgaatgacaggcacaccctcaggtgtccattatacatagctaaaacaaaaagcaaaacaattcttaaataacagaaaagcaaagatatatttaggcacaaataaacataaagtcaaatccaaagccaaagccatttattaaagagagtaattttattttgataagtatatttcaaaataaaaagatgttaataagttctacaaaatcaagtaacatattatcaaaaacacagtaaaacctatgagcgatataagaggaaatgaattgtgtatctataaaaccaaagagattccattaaaaagctatttgaattgataaaaaccaagttcaataaaatggtgggatgagataaatacacaaaaatcaatagttagcctgtataacagcaataatgtattaaaaatgtggtgaaaaggaaatcctattcctaatagcatcgaaaatataataatggtagggagtagactggaatgaatatttgattgaattagtataaaatttattcagaagaataaaacataaagaataacacaggctgggcttggtggctcacacctgtaatcccagcattttgggaggccaaggcaagtggattgctggaggccaggagttcaagactagcctggccaacatggagaaaccccgtctatactaaaattacaaaaattagacagatgtggtggtgcatgcctgtaattccagctacttgggaggctgaggcacaagaatcactttaacccaggaggcggaggttgcagtgagccaagatcacaccactgaagtctggcctgggtgacagagtgagacgctgtctctcaaaaataataataataacatacatgcacacacacggacatatatgttaaaggcaagaataatgaagggtagttagccttgccagatattagaattaaagcagtatagtattgatgcaaaaataaacaaataaatgaacaaaataaataatcttgaaattgatcgtgatatacttcaaatatgaatatgtgataaaagactgcataaaccaaagaatgagaaactattattcagcacagagtattgggacaaccagtggttatgtaaaaagagagtggcacattactaaagttaagaatcaaccaggaatctggtcaagttatttgtggcaaatatgataaaaattcatttttgactcattaaaagctcattcaaatcaataagaaattccagtaagcggtgtttataaaaccgtataaagactcaacaatcttacctcaaaggtggtaatacaattggtacaacactttggaatttaataagcaatacatttcaagaacataaaaaatattcacattccaaattagccgggcatggtggcgggtgcctctagtcccagctactcaggaggctgaggcagcagaacggcgtgaacccgggaggtggagcttgcagtgagccgagatcgcaccactgcactccagcctgggtgacagagcaagactccgtctcaaaaaaaaaaaaaaaaaaaaaaaaataaataaatatatatatatatatatatatatatatatatatatatatatatatatatatatatatatattttcacatttctttattcaataattttttccttggtaaaccatcttgacaagattatttgaaaaactgaaatgtattatggaccaatctactcatcactacatatatactcattgccacattactatataaaatagtaaccctgttgtcctctaaccctgttttcctgtttttcttttcatggcatttattatcacctgacatttgtttattaccagtccctccccaaccactaaaatgtaagccccatgagaattggactactttgttcactactatatttccaagccccagaaccctgcctaacataccctaggaagttgataaatagttgtggaatgaagaaacaatttcaaacatcccacaataaagaaatgatttggacaattatgatttatctattcaatataatattatgaagcaattatatttatttataggaataataacataacatgggggaagtatttataatgaaatgtttaagaagaatatagtttcacacgtatattatgattacaaatacagaaaaagaaactttgtggagagaaatagaaatggaaggagatatcaccaaacattaagagtggtgtgggaaaagagaatacaggtacttttcctcttctatctagttttgggcatttcctaggggtgccacaacacgcatttctttactattggacaacttgataaatgcaatatataacaagagaagttttttttttttttttgagacggagttttcctcttgttgcccaagctggagtgcaatggtgcggtcttggctcacctccgcctcttgagacggagttttcctcttgttgcccaggctggagtgcaatggtgcggtctcggctcacctccgcctcccgggttcaagcaattctcctgcctcagcattccgagtagctgggattacaggcatgcgtcatcatgcccggctaattttgtatttttagtagagacagggtttctccatgttggtcaggctggtctcaaactcctgacctcagctgacctgcctgcctcagcctccccaagtgctgggattacaggtgtgagccaccacgcccagcaaacaagggaagatttttaaaaatcacccatgataagaggatacgatttcaaattaaaataatgacaagtagggaaaaggttgggaacagtagaaaattataagttaatgttttggtttattttagtataattagataagtttgggtttaagaatatgaaaatatagaaagctgattatcctttgagtcactagacaaaaacatagtctattttgcttactcctgtcattcaaccacattactacccttaagttcctcctatgtagaaattctgaaactaacaggtgactctaaatactcctcctgcagtgttgccccagccactgcagttcttgggtgtccacccgagggtgtgtgggggagagaatctagacccctagttcaaggaaccaatagactggccttcctctgccccctgggcctccgcctactgacccagacaccagaggctgtgttaagctgggccgggctcttcacagtctaacgtactcaatgcaatacattggcttagtgtcaccatggagtcagaacccctcatcctggtggccattgttctgtgggcttgttttataatgctctgcgcttcctccttagcattacaagctctcagtgctgagcctctgtcccaaccatttcctttgttccccccggaagtcccattggattgtaaacagatgcctccacatccacggtcctcacacaggcactccttctatctcctgctttattcgaaatctggcactctcccgaggccacttctgcagacctcatttgttcagatatcaagtgaccagtaggtgttgttaataatctcctgactgtcccctccctgccatttcaccatcatttcacttatattcttggtcaaaaacaaacaaacaaacaaagccaagcaaaacaaactcaaacaaaacaagaattctgtcggattctgataatcttgttgtcttagtccatttgggcttctataaaaaaaaaataccataaactgagtggctcacaaataacagaaatctgcttctcacagctctggagcctgggaagtccaagatcaaggcgacaacagattcagtgtcttgctgaggcccactttctcatagatggcggcctttccttgtgtcctcacatggtgaaagaggcaaggcagctctctgtggcctcttttataagcacactaatcccatgatccaatcacctctgaaacaccccacttcctaataccatcaccttggtgattaggtttcaacatatgaattttggaggaacacaaatattcagaccataccacgtgacgtccaactcagtgtcttttttccccccatttcatgactgacttctgacccactcctcaagaatcttaagtgtacaatggcttacactctttctctcctccacttcatgtcttgccatcctagatgatttcattggcctgtggacgacacatcttttagccacactgtccctgctcgctgccttctctctctccccaccaccttcaacacctaggaggagattgcatggcaacacagagggcaggaaaaggccaataccaaataacattctcattggctccttctccagaagaacctggagagagacaactctcttttttgtttcccaatcagtagtaaagttgagggtgccttctgcttgggagtttctcagtgagtatggcccagcagggataaaagaaaggggccaaaacacaggtagcccttataaaggacataagcaaaatgcttaaatgagattcttgaggtttttatgttgtctagttcagcactccagtgttggagagcagattgtggggagatggggaggagtcatagcttggaataaggagtttggttgtcctctggtaatctctttttttggctgcctcaaatcctctgtggaaagcagcttgccatatgcatgactctgtgtgtgtgtgtgtgtgtgtgtgtgtgtgtgtgtgtgtgtgatatacaagctcagtgacaggcaaccagatacagctgagtccagagcagttaaaaggaaatcctgaacatttccaaaacatacaagtaacacaccaaaaagcaaatgatgcaccaaatactgttacctaaaatttcttggcttccttgactctccttcaatattctagtctgagatacataatcttctatctttatgttcttacttcttacttatacatagaaaatctactctgatcttcttaagtgctctaattcccagacaccctcattttcccctagtcattctgcccattctggatttatttccttccctatatagtctaaaccatgtcacttatcactacaattcacttttcggcatccttgagtccttccattcttgtttttttcatttctttgcccatgcctagaaatccccaactctaggccaatccaactatccaccttctcttctcttaccatttattgcctcatgagtaccacatagagaagaatcacaaatgtattattactaatttcagccaggcccctaaattgttccctctcttaatcccctgtgtgactcttccaggattttaccactctcctcaaacactctaccatctagcagcagatgactttgctgcctacttcatggaggaaggatattaagaccctcaagaatgaactttgtatcctctcacttatctatctctgcctccttccttcctggttcctcccatccaagcaaatcccttgacctggtatctaaattccttcccttccacaatttaaataatctttatatcaacactaaatgtttattcttttcttcttcttcttgttttttgagagagagtcttgccctgtcaccaggctggagtgcagtggtgcaatcttggctgactgcaacctctgcctccggggttcaagtgattctcctgcctcagcctcccgagtagctgggactataggcgtgccccaccacatccagctaatttttgtatttttagtagagacagggtttcaccatgttggccaggatggtcttgatctgatggtcttgatctcttgacctcgtgatccgcccacctcggcctcccaaagtactgggattacacgcatgagccacgatgcccggcctaaatatttattctttagacaaatatgtattaagcaccaggtaccaggctgggctattgggataaagtgacaaatagaacccagttacaaaagatgcctgttgaattgcttgactggcaccccttttctgtgaattgcatgctctgcttttatttactggttggttgctctgggagcttccatattacaactctcacccactggcctccctgagtaactagtttgaagtgggcacctaaaccaagactggcaatcaattcgttcaatgggaaatttgtaattggaactggcagtcagaaccagactgtaaaacggtaatttggaagttggtagtagccatttactgccatgtggactaagacacagagagagccattctgcagtgagaatagagctgagacagattcagagaatggtgaagagacaataggttctccaaaagaggattttctggggtttttaaggtgctccattctccagttccatttccaaggcccagatgcacccctgtcataaaatgccagggtccttctaataaactttatttctgcttaagatagtattttgtggccaggcgtggtggctcacgcctgtaatctcagcactttgggaggctgaggcgggcggatcatgaggtcaggagatagagaccatcctggctaacacagtgaaaccccatctctactaaaaatacaaaaaaaattagcagggcatggtggcaggcacctgtagtcccagctactcgggaggctgaggcaggagaatggcgcgaacccgggaggcggagcttgcagtgagccgagatcacgccactgcactccagcctgggccacagagctggagagagaaaaaaaaaaaaaaagaaaaaaaaaaggatagtattttgtattgggtttctgtcacttgtaagcaaaaagcaagatcctatcatttttgctggaaagctggcctgccttgttttacaactattgtctgttgggacccagccatgtgtcttttgaggatagaattctaggggactaggtagcaaatgtcaggatgttgccccttattttcagtattcattaagatactacaagaactaaacacgttcaaatacagctgaagcctgcctgggaaccacagggccagggtgtgcctctgttctgtgaagttctttcgccttctgccagttgcctgagactactgaggtcagataatcatgggctttgcggaataacggctgccaaattatctactgcaccgtttctaaagctatcaattatcccccttctctcttaaattttcaacacttccctctctgttggctccttacatcagcatttaaatctactcccctcttaaaatctattctagagttaccaatttttccttcctattacaggtaaacttcttgaagtagttcatactcagtgacaagccatagcaagtaggtggccttactctctgctgcaactcacttactaaggttgtacttgcccacctaccttatcactaaatacaatgaatggtttccaggtcttatcttatttgatctttcaggagtatatgacactattgaccacttctgcattcctgaaacactttttcttggcttctgtgataccacatgctcctggttttcttgttacatgcctgcttgtttctttgtaagtttctttttttgctctatgccttcaatgtgttggtgttcttccagtttggtcccagtcctcaatcctcagtcctggttccatcctaaactctcctggggcaatctcaatcactctgttggcattattgtacctacccaaatataagacagagccctcttaccctcaccaaaatcagaaaacagggagtcactttatattctgacccttagaagtccttcatggccagtcgtggtggctcacacctataatcccaacactttgggaggccaaggcaggaggattgcttgagcccaggagtttgagaccagcttaggcaacatagtgagcccttgtctatgcaaaaaaccaaaacaattagcctatacgggtgtggtggtatgcacctgtagtcccagctactcgggaggctgaggtgggaggattgcttgagcctggaaagtggaggctgcttgagctgtgattgtgccactgcactctagtctgggcagcagagaccctgtctcaaaaaaaaaaaaaaaaaaaagtcgttcatgttactggatgctctcaaccattttgaacaacaaaatgctttttggtggaatacacattagcatgaaatgctctcattcaatgctcatacaaagccacctgacagaattggtaagaaaggaaacaaattgaacagactttaaaattacttctagggaaatatcttcacacttagaagtgttggatgtccttgtaaacaagtctttaaaagtcactataaaaagcaatatggtacatgaatataattacaggatgaatgatgtagtgtgattagatacttgtggcttggaataaaattcccagtgacagcattatatatagagttaaaaacttgggtagaagtgaagatggtatgtcctgggaaatatgttagagactcaaaatgcgacacttgtgatgataaagacaccatgaagaatttcaataaaattattttaaagattatatttatataatacgtaatttaaagtaagcataattaaattaatatattcaatattataaatagagccctgattatttcttttttcccaactttttctttcttatttaatttttttaacttttattttaggtttgggggtacaagtgaaggtttgtcacacaggtactcatgtcacaggagtttgctgtatggattatttcatcaccctggaattaaacccagtacccaaaagttattttttctgctccagtctctcctcccaccctctaccctaaagtagacccgtgtctgctgtttccttctttgtgttcgtaagttcttgtcatttagctcccacttataagcgagaacatgcgatatttggttttctgttcctgtgctagtttgctgaggataatggcctgcagctccatccatgctcccgcaaaaggcatgatctcattcttttttatagctgcagagccctgattatttcatctatatctctaaaagtttatctgttcaagttggccacaaagttttacggggggggattgtttttgtttttattttttgaggcatggtcttgctctgttactcaggctggagtgcagtggcaaaataatgtatcactgcagccttgacctccaggctcaagtgatcctcccgagtagctgggactacaggcacacgccaccacacctagctaatttttttttttttttaatgtagagaccgggttttgccctgttgcctactctggtcttgaattcctgggctcaagctatctgcctgcctcggcctcccaaagtgccgggattacaggtgtgagccgccgaggggcctgggggagtggggtggattctaattggaaaaatggaggctcaccttattttcagaagcaccttatactcaggcatatgtagtgtatgctgatgactcacttctccagtcctatctccctgctaaactccagatccaagtaatgaacggcttactgatatttctactcagatgtatttaaagtacctatgtatgcataggtactttaaatttccttgtccaaagttaaactaacattgtctcccatctgctcatctttctcattcccccctcagtgaatgccaccaccttcattcagcttcccaagttgaaatctgagttacccacatctcctatctctcccacacacccctgctgtttctatctatctcctaaatctctctcttatctgttcacttttcttaatcccctttgctttactccaggccaccatcatctcctccctagactattgtaacaaaatctgaactgtttttttttttttttggtctcgacttcttccaaactacactccaagaagcagcctcagtgttccctctaaaacgcaaatctgaggtcaaatcccacctgtaggcgtggctgactcctatctaccttcaggtctctgtttagaggccaaagcttctctaattctccttctcccacccccacacacaatttagtcaagttagatgctcttactaagttttcccacactccttatctttccttaccataacagtctttacacttctttgttataattgtttaccctttctgctagactgggaactttgtttatctggctcatcactgtcttcccttaacataagccaggaccagagacacaggatgtactttataaatattaaatgaatgaaccaataattttgttatcccagcatccagcacaatacttggtgaaaacaggtcctcaataatttttgctgaattaatagattgttgttgaactaaagatatgtgatcaactaagcaacatgtgacaagcaaaattaatattgagcatgcttgtacttaaaaaggagcacacatcctttttaattacgcttaatcagagatggctccctagagcaggtggcttctgaaggagaacgggagaaaataaaaattcttacctagtggaatgtaaagggcaaatataaaaataacaatctctgtgcagaagaaaatcactttcttaagactggggcaacttctagttgaagtctgctgtgactaggaagtgttctatcctgagatctgctagtcaggggactagctttcttcttctcaacctcggacactgggattcagccagggaatcagctgcagaatctcattactgccagcagttaaacactgaattgtacgtcctttctaatgttgaaaaaaaaatccttttactatagagaataagattcctaccaagttttatattcataggctttaatatttcatgtaatttttatatcaaaatacattagcataaatttcacaagatatcagtctagttatttttggcctgcatttcgataacttttacagacacacaatggccactctgttttctttgctctaaagtttctttgtgcacttattccttgaacatgggcctcatgttctaactttacttagatgaaaaaactgttaatttcaccagtggtttaatatctcttcatagattgatagtttagacaacataaaagtgttgattagcagtatacgtgcaggctgaagtatttgttgaaaatcttgttgggagaataagaatgataaaagagatgcctaagaaaatcttttctcagatatgctttactaaacaaagaacaggttaattactcaatgatgatttttaaagggcatgtcgacagtgtcagtgactttgaaacaaagtaaaggagctgaattcaagtgtgtgcctgagttacttaactatcttgaactgatttaggatctgtagctttaatctggggctccatctactagtggtttaatagagtgggttttattaaaattgtgatttaatcagaagccagaaatatacaactgttttaaactttttgatattaacctgatatacacagtgggctgataaattagtgagacagttcatataagtcatatatgaaaatcagtctgttattagccacaactcatgtatttttcaaaacttggagataaatgtaagcttcatctcagaagtcatattacacgttataggtttaatataatgaaatttttccagacttagaaaagatatcaggaaattaacatttgcaaggcaatttacagttttcaaagagcttttctcattaattatctcagaaaactgaataatgatgtgattattaaaggttaattaagcaaatacttgtgaagtaattgggaggtaatctatttctaatttaacaggtcaatcacgggtatttaggaaatatttttgctggttaacaactctaaccaaaacaaaaaggtatttaaatggtttccctagtgaaaaaccataagcatgtgtttcctctattaagtcaattgtttcaaagaactagcatgagaattcctaatttcaccgttttgatgatttaaggttttatgaagattctgagctcttccctcccgacgttaatccatgtcttacattgttcattttggcgctttagaataaaatatctttggaaagtaactatgagaaagcacagagggatatgttagtgaaatagccattttcttgtgggaagcaagacatttcggttatcgactacacagaagagtgaataaaacccaacgcctatcaaccaccaaacgtgactctgcttgcataatcatacaaataaattttctttaaaaatttttcatgggtgcagtatataaaatgatcaatagtctcatcagcagtggaactacaaactgctttctcctaactttgtgtagcctgggtgctgcctcacgattactaagtggtttaaaatcatatcccacttgctccttggtttatcagcgaaagacgtgattcccaggtaggaaaacgccaagtgtcccgcaaaggtacaggtaaaacgtagcagttactgcgagaagactggccccggggagtcccagggctcggtcggggcccccgcacgagctgaggaagtggacagcgggcacctttgtctgtgcctagttccctggacccgggccgagcgatgcgggtgggggcgcggttcgggcgggtcccggcgctgcccgggggaagcgcgcggcgacggcggcccggcttgggagccggaggtcagcggctgcgcggccggccccctcccacgggagccgcgccagggcccagcaagagtcgggcgggatcgctattgtttttggcgagcacataaatccccgggccgacccactgcgcacccaggtttcctcccggaggcctttcggtttcctctgaggccctatatagaggctccaggcccggactgtgcagaggtgcgcgcccacgccggcctcccggaccagcctgagctcggagcgcctctcgccctcaggtctctgcagccagaggcatctggggaggtgaggggggaatttgtccccgaggcgaggaggaggaggcgggggcgcgcggagccgaggggctgcggcgagcgggcgggaggagcaggaggatccgcttctccggggtttccctgacgccagcagcagcgcccggcgcgcgcgccccgcacccgtcagcggctccggggagaagggggaggggagcgggcccgccacggcccgagaggcggcagccgggattggagcgggggcgggccgcgcgcggagccgagggggtgcgggcgaggcgcgcgcgtgcgcgtgtgcgcgcccgggactcccgccccccgcccccgcccccgcccccgccgtccgcggtctccgcccccctcgcgctggtgtgtggagccggagtcggcggcgggtggcggcgcctggaacctggagaccgacccaccgcccccccccccccgccccggaatgtactgactccccttcttcgctctcctcccctccccgcccccttgcaggagggaggcgccctggagtctcccctccagcgagaggggctgcgcgggccgggccgggccgggctgggctggagcagcggcggccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggtaagcggcgggcgcgggcccgggggttcgcgggggcgcggcaccggctcaggcggccgcggctgcggtgtttttgtttaggatccaggaggaaacgtgcaggaacttctctgcctcggctccggttgccgaagagaaaggggatcgcgcgtggtggggaggagaagggcgagagggggcgccaccggggaaggggcggctgccggggggcaggtcgggggcgcaggggtctagttcccagctttgtacctggaggcaggttcacccctcgcctctctcccctcccccaggctcatcccacttgtaagagtgggacattcttgtgctcacactagcaccagtagaggccactacacacctcattaaataaacaatcagacggccaattcattaattttcaggaaaggaaaggggagggggcttgagctcctggttccctggccagggatttcccagcttccgaagtctcgaggaagagctggctagtctcgagggactcctcgcgcggggattggagcccgagtctgcggaagagcgggggtgtcagaggggcacaattgcccgctcacaacccctggtgttgatttaacgatgaggacgccttggagagcggctcggagtgatcgtatctgttagtgtttccgttatgaaatgcctcttctttcctggggattacaactatatttacagcctattaaccactcttaaccaagggaattgtctaagcatcagattttaggtacttgtacaatgttttcagatggcattgtataaacattgaacctcaaaagccattttcagttcttttttggaatattatagattactgaaaccacctgcattcctattaaggggaccaacgaacaaaaatgccaagccttccgggaaggaccttacggtattgttgagcaggatacactcagcagttgaaaggcaaattagcatgtaatctgttaaaattatttgaccaaggtggtgtaccataaaacttgacaaaactttcactcgtgtgagatatgatatttttacatttgaaagcagtcttaccgctgaaccagtacttgtttttccctgatttatatgaaataatatttaaaatcacactgcaaggtaacttgactgataaacttttcatttccttgcagagtgtgtatgtagctcatggcttttgccaatgttaaagaacagctttaaacgtaaagtaccactcggtattctctaaacagctacgtaaacaatagtgttttaatgtcaaattaaacatcacttatgtcatgatgtacccttatacattcagtccgtatatggtttagaacacattttggtgctgaaatgcaggttactgatccaactgtctcttagatgagcaagagaaatataactattttggaaaacaagttcctgttactcatgatctattttatatggaaattcatatgtagttcaccaaatttcaagtttttgtttaaagttttgccgataattttgtaagtaactaaaatgctagtaattttattacttaggataataaaaataatgcaagcagtctcaggaagtggtcttaacatctgtttcaacattaactcaattgacaggtttttattttgcacagatgaggtgcaaggcatatgctctctgccttcatggagtttacagtctggtgtgtgggtaggaaagatagccatccatctactgattatataattaagtaattgtgataagcactacaaaggagaataggttttcacaaagtgggtactggagtgacataacctagtctgggtgttaagagtgtctcacaagaactgagatctgaggagtgggtaggagtggaggtggggaggctcacaggtaattagtcgtttaattgggtctagaacatagatctcctgattctcggtccagagtccttcctgtaaaccgctctgcttcattacaaaagcgagaggaataactgcaataaggaggggttggtcagttctgccataaaactgcggaagagatcaagagactggagaactgagtaagcagcaactggaacaagctgtccgcaaatcagatgtcctttgtcagtagttttattttttttatttttgtagagtgatagacttataaatctttttataggggattatagtgaatagattgtagggaagtggacatgttcagtagtagaaggtggagaaaaatagagatgtgggacaataggataaatggaaagtgtttttccatctgaggttatagacatacggaggtggaggaaaaagtaagaagtaaaggactggtgatagaaaatggtcagcaagggaggagggttggaattgagtaggaacataatctggtattctgaaaaagggcagattactgaaaagatatgtagagaccttggggaagatgacatggcagcagcctgtgcaatgcatgtcttctctatttagagtgaacattcttcaccgaggactctgtagcttctgcctgaaccatttatttcatgatgtgattcattgccttacagggtagtccatttctgtgttgaataacttctgttagaaaatgttgctttgtacagtacatttcactgtagttttcaccctccccacccttcttacattttttcctctttgcttacctttttcagcattactctatcttcaggttaatctcttctctgattaattcttcatttgtctttctggcttttcttgaactcactcacttaaatattagtatctaaagcttatctcattatacatactctgtttgccctcagttgccacctgtaagctaaggactctcttagtccacactttctcacttgccactcggtaccttcactaaataggatcttaggttactgaagtccgaagttaaactctgtgtcattttccctcgtgcttccttcatccccattctctaaacatgaacaaaccagttcctggcccctgtgtctcatgttgttggaaggattgcatggatttgtcttcttgtgttgcctgtcttggtcatcactgttcatccacttgcccaagctgagatcaagaagacctcctcttcccattgccatagcggatagttctttttgctttttacctctcagctgtttcttgactctgaatcggtatcttttcatcttcatccccacctggactaacagtagtggctccataattaatctctttgtctgtactgttaccctctagaagtctgtcctgctagaatgagcttcctgaaatattttcctgagcatgccactctcctacttaaaatctgttactagtgttctgtagcttgggtgttagaactctttggcatggagattgtgaggccctttgtattctttacctctgttctcccaaacccaataaagcctcatctcttgtcacccctaacatgcaccttgcattccaccactccagattaacgacacagcttcagatctccgtgcctttgcacatgctgttctttctgttaagtcacttctcaccttgtccacttctgaaactccttatctagtcaatgaatttttctctaccagctttctcttccaaagagagttatggtcactattctgtgttcccatagcttcctgagtacttttcatcttctgttacttattttcttgtcttttctgctagtctcaacctctgaaggggttggccgggttgtcttattcacctttgtttccctagtgtagcactaacatgtagcatagagaagataaccagtaaatgtttgttgactgaatgttgaattgcctttgtttttaacccgtagggccatacagcacaaatctgattcctttatatgatggcccttcatgtgtctaatcacatttcctgtgtgcatgtgtgtgtgggccccccctgcccttcccctcaaaccttatcctttttaagttaaccatccttaattccttcagccactcttcacattacttagtttccagatcttttgtgatcttggtcatcctcctggatatgctgtagttttagcgtttttttagttttgtcatctttggaaagatctttgatcttactgagtcatctaaaagaaaagactgatggcgttgctctgcctgtctgttagaatgaggcacaaaagagatcatagaattctgggatgaatgctcaaagaagataagaaatatgactgattttcataaactgtatgaaaattaatacatgatgtgagatagtgaaaagacatacatgaaggcagaggatatggggtatgacttgtggttctgcaacttcacatacatctgtaagttgggggatataggcaggcaagaataataccttacctacctaactggattgtcagaaaaataaaatgtaaaattgttcataaactataaagtactgtacctatgtagaatggcttcagtgtttctttgtgaactctaaaaatatactatattaaattatttgaaagtgtagacttttttttcttttggcttaattgatcattgctggtttcttccttatgagtttttctctacctcaatgaaaatattggggtaaccttaataaatctcattatatggaggctgtatttaatagtcttttttccaaacactttattttattagtgacttccatgtgattgggagctatttaccatatcattggtaagtgtttaggtttctgggtaaaattgcatcaataattggagaacagtcagaggaaatgactgtaggtaagatcatattgaccggagagctaagtgaagtgaggagaagttttgtgtttacgattttgaaaaattaactttgtcatggacatagctagtgaaagatgattttaaaatagagctcaaattttggattcatttagaatgaagagagtttttttgattcaaaaattttgtaaatagtgacaaaaaaaggcattcagacccactggtatgattttggtatatttctttctacttactgcctatatggcacattatctttttacattgtaatcatggtgtatgtataacttgaaatgttttcctttgacattataccatttttctttgttgtcacattatctttaaatcattttattttaaaaacttatttaaaaatacataaatatatgtttgtttgcagtcaaacaatataaaaatacatagaataaaagattttatcacttctacccacaaattccatttttgaaacccataagtaaccccttttaatatcttcccttgcatgtgcatatgtgtgtatggttttatttttttacagataagcaggatcatactacctattgttttttcaacttgctttttcacttagtatgttggagatcgttccatgccagtacatacagattttcctataaccattatttaaaatgtgtgtgtaatattccagggagcaaatataataatagtggctaattaaagtagtagttacagaacactccctgacttccaggcattgtgccatgctctttcacatgtatttaatcttttatacagtcctgtgaggaagatgacaatttcttcacattccacagatgaggaaactgagtctcagatattaagtgccttgccgaaggtctcacaacctttcatgtgcaagagttggcattggaatccaggtttttgcaacttcaaagcctatgttctttattcctctgcattctgctgctaattgtgtattctcctgttatggatatggaagttgtttttactgttttgctgtgataaagaatgctgtgatgaacatattctttctatattttggattcccccatataggattgctggtgaaaagttaacttgtgtgtgtatgtgggggtcagggttccatttattgcagaaaagtaatgatgtcattaagaataattccattgactaatactttcataactttttgaaggttttaccacttttaattgtgaactttgggtacttaaggccatgttttaaaatgcaagttcatctgttaactgaaaggttaagctaattaataagtaatttcaaaggtcccttctgccttccaggtttctcttactctgaagtccataaaatggaacagtgggtttatttcagcttaataacttctattcagttattgtgttccaacactggtcatttctggttttcagatgcaaaagtcacctttttttcattcgctaaagctcaggttattgtatatcttttttttgtagtgcaaagtaggatatgattggaaaatcgtctatgttacttgcaaatgattgtatatgattttattttatatgtgtaaaaatagctttagggctgagttatatggcttcagtgttaagtaattgtgaggtattttaagatacagtattaccagaaatattagatgcttactcttaggcttggaagggatgtagagtaaattgaccaggttacagagctggcttatgtaaacaggttttgattccctgtctgacccctttacataaagaaaaggcagagaggtatggtggttatatatgttttattttactgaatgaagtcagttcttcagttctgaggagttagcaggttggtggtctgaagtgcagattacgtgtctctgcttttccttttttaaagaaccattagaaataaccttctttaaaattatttcatagcgagaatccttacatttaactttttattaagtcagttctataggcaaagctaggagttgcagtaattttggctggttgcaaacgtttatctttgagggctaattatgcacaaaactacactgtggaaataaagatgaattggacgtgctttctgtcctcaggaagcatttggtctaatggtggaggtaagggagatattaggtaacttgatttggcgagagaaagtgccattactgctgtaggtagaaaaatacattctggaatcattgtgttactgttgatcaaggaatagtgctgctttccctcataattttggttctgtatctttagagtagtcctaacttagttttataaagccagtagactagaattctcaagaaggagttatatatcatttcctctgattactgcagtgtttgaatgtatgagaatgctcataattgagctgtctgggggtacagctactcccatgttttttggaaatctggagattgatcatactgattttcagaattgattattggtcattaatagtacaacttactaagaagtcctgagcagagtgaatttttgtaatgatactatgtggaaattgaaaacagaatgtttctgtttttctgctgtagtggtaaaaaaaaaaatcaccaaaatatgtctttatttatgaggtctagttaagataatagcattataatttacaaatttagggatagaataacaaattataagtttcattcataattttttaattcacagcatagctttaaatgtaacaagtaaaatttgaaaatctttttggttaattgttgaaagtttttgaagttggaggtaggataactagttttgtttgtttgtttgtttgtttgttttttctgagactgagtctcactctgttgcccaggctggagtgtactggtgcgatcttggctcactgcaacctctgcctcccagattcaagccattctgctgcctcagcctcccaagtagctgggactacaggcgtgcaccaccacaccctgctaattttttttgtacttttagtagaaacagggtttcaccattaatggccaggctggtttcaaactcctgacctcaaatgatctgcccgcctcggcctcccaaagtgttgggattacagacgtgagccaccgctgcacccaggcaactagttgttttaaatttatagagtgttgtatattcaagggattgtgtgcagaaattcttgtggtgataacccttttatttatttatttattttgagatgggctctcactctatcacccaggctggagtgcagtggcatgatcacagcttactgcagcctcaaccttccaggctcaggtgatccccagcctcagcctcccaagtagctggggctacagtcatgcctcaccatgcccagctaatttttttgggtatttttgtacagacagggtttcaccatattgccaaggctggtctcaaactcctagactcaagcaatctacccgcctcagcctcccaaagtgctgggattacaaatgtgacactgcactggcctaacctgtttattaatcgtacctcacctacataggactcaaccattatgcaacctacctccggaatataactgaagactagggaataagagaaataattttcaaagtaaatgcatttctccgagtcccaaaggactttgttcagagcctatctttaattcataggcagttctaacaaacagtataatctaatttctgagcccatagctgatcagaagtgggtagaaagactatcttgggaaatgccccctgcagcagaaggtagtgacagttgcaaggaaagatacttaaaataagcgtaagaacacagagatatcttcccataaacggaagttactgtctcagccaagttgaggaaaatttctttccctttccattactgctaatggatattgcctacccctggcctttccttttatcccctcctactgtagatacagttgctgtctgggagatagatcttccctcagaaatctcttgagtcttaatctctcctcaaattagtaagggttcaggttgatgcctgaggtaggaagaaaggaagtgtgaccaggaggggaggtgaggtggcagggtatggttcctacccctctggccatgacatttatctttattaacagcgttactaaacctgattgctaaaatatgtatgtggatttttaatttgggggtaaagttaattgttgaatttttattgttaaaaatgtaacagttcatactatgtaaaataaaatgtgaaatcatacactccaacccttcttcccagagtaatcacttttaatagctatggtctattttatatatacaattatatacttaaaatatctggtacatatataacaacaataacaagttggattttgctgtgcacactgacttttaacttgttttaggacatctttccatgtgagtgtgtataaatttatgagttgtgttgatagccatatgaaattgtattttctggatatatcataatttatttaaccaatttctttttgatgctcccaaatttttgattgcaaacaaatgatgcagtgaacccacgtttataaatgtccccatttgtgcacatgtgcaagtaaaccatagaataagtttgtgggtgtggaattgtagggcaagagggcatgtgtagtcacattatttccaaattgtttactaaacagctgatttacactcctttgagcagcaaatgagagtgtctgtttccacacttccttgccaacatattggttattttcagacttcctagtctttttgccaatttgatagaagaaaaaaaacctctgtaaatttcatattttaaaattattaatggagttgagcatcttttcagatttttattgatggtttatattgtttctgagaattgcctattcatgtgttttattcatatatctatatcttttattgaatcattgattcatttataaatatagataatacgtaattaagaataggaataatttaaaactttataatttgtcaaaacttccatagctgcttgtggttcttaacttagtgataagcaaactgagtaattgggttagttacctgactcctgctaaccactgctcatgctaacctgatgtggattcataagctttaaaactgttctgttttgaggaaagaaagttaaatattttattcattgatttgagtaacaaataggaattgaaacatgctattacctcttttaagacagaaagaacaattttggtttgaagtgattaagttcatttagtcaaatacttgagccagtttggcccaaggtactgtggtgatttaaagtggaaagtggattaaaaatgtggcagaagaaacaagtttgggaacaatggatattggttccattttggacaccttgagtctgaaatgtcagcagaacatccctgtaaaagggttgcagaattagggctcagttgaaaagtctaggctagaaacgtaggctcacaggttatctgatagagatgatagttcaagtcataagtgtagttcatgacacttaggaaggaaaaagaaagcctggggcaaagacttaggcatacatctatatagatgggtttccaaagggaggaagcgttcctctgtttactgaagaagataccactattcaagataccactagacctagaataagaattatataaaatgataaagttcatttcgcctatggaggcttattgagaaacacctgtgtgaataaatgagctagtgctaaagtaatgtcacttctttccctaacccctgcaggcatgtcatggccctgggttagaacagtaggcagggagagcaaaggcatacagagccaattttgaacaattctttaagtgacatatatcataaccacccactctactgggctgaaatgaacaaagaatgacttaatatgtgtccctgcttagaacaaagcctggcttattcatggaatgtaaactgttattattgtcgtttttattattgtatactagatggagaggctagctaaaaatacatgaaaattagataacatgatttggtttttgtttttatttgatggctgtgtgtaaatagattgttaaatgagtgagcttatgttgaagaggataaggatttgtttagtttgggatattcagctaagtttcttaagacttgagctgattttgaagccgtaagtagggtttttagatgcgcagccttttttgtttgtttgtttgtttgtttgtttgttttttggccaggagggtaaaatacagagcattatgaggcaaagtaaaggcaaaagcaacagaaatgttccgtaagctgtttcttgtaaggttcatttttattctggaattaataatttgtcatatagcagaggggtgatgatgatgatgaaatcatagccagataatctgtcatggtaggaaggagggtggagatagtgcatgttccaatttaatgaaaattaactttattattacgtatttgctttttaagacttcatttatttcctgttagatgttgtgggcatcttttatgaatcagcgatttctctggagtttgttcaaagcccgagaagtaagcttcaggattgtgtgtattaggaagttctaaggagttagcgtttgccactttctgaagaatactttaaaaaaattctgtaagctttgtggaagagcgaatttatttcttcttcagagtagttacagttaagtagaggcatttctgtttcagagtcagccttgttagtaattgaaattttggggtaagaaatgtagacaacattgtgatacttggcagttccactttgttcacacttaaactctgggattgcagtgtgatgagatgctcatactaaggcattctggagctgagctcagctggtagaagttcatatctcatgttttgtgctcatatgaatggcaggtagaatggcttgttctatttaaattagttcatattctctctctctttgtctctctcattctcatagttgaattgttttaacttaaatgtgtgtatgatatgacttctctgtactttatgtacttttattaaaaattaattaatttagagacatagtctcactctgttgcctaggctggagtgcagtggtgtggtctgagctcactgtaatctctgcctcttgggctcaagtgatcctcctgcctcagcctcccaagtagctgggactacaggtgcacaccaccatgcccagctagtttcttaattttttttttagaaacaagatcttactatattgtccaggcttgttttgaactcctgggctcaagtaattctcctgccttggccccccaaagtgctgggattacagatgtgagccactacacttggccctgtagtcatatatttatgttatgtttgtagcacgtggttaggttttgttttcttttgcctgacagtttttgtcttcttactaaatcatgtctatttaatgtaatagttcatatatttggctttaaacctcccattttattatttacttctgcttgcactgcttattctgtattcccctttctctcttttcctgccttccttggattattttaagttactctgtatttccctctcttttagcttgccagttataatttctttcactattcatttagtgtttcctaaatgcatctttaacttgttatttgtatgatttcatggacagtgcaaggcctctataacacctgaattccatttgtccttctcttttgttttaatgttattatgttattgttgtgtattttagttctctgtatgtttaagatccatcagatgttatttcatactcactattcatttagttttagttatttaaattcattaatttattcatttagatttacccacgtatttcgtttgtgagttgctcttcattttttttttttctgcatctctgatctttcatctgggatcatttctttctgcctggagaatataatttagcatttagttaggtttgttggagatgaattttctcagcttttgtctgtctgaaaacatttgtatttcaccttcatttttagatttttgtggagagggtgctggatgtagaattctaggtaaacagtgtgttttttcaacactttacatatgttgttccatgtccactgaactctatcttttctagtaagaagtcaactgtcttatttttcttcttttgtgagtaatgtgcttacctcccgtctttggccacttttaagatttgttctttagttatggttgtcagaaatgtcactatgatgtgcctagttatggttttctttgtatttatcccgcttattgagcttgttgtatgtgtgggctgatcactttcatcacttttggagagttcttggcttggctgttaatcccttcaaatatttttttctgaattaaattccattagaatttagttcacttaggctcccttacatccttatctctctgatgggttcagaaaaactatagatttgtagcttgtctgccctgttttggttgttaggaaaacagtaatagtcctgataactttacattctgattagaggcagcactctctatattgaattcttaatttcattttattgaccttttcagttctgtaatttctttttatttctttctttcttttcttttttttttttttgagacggagtcttgctctgtcacccaggctggagtgcagtggcatgatcttggctcactgcaggttcatgccattctcctgtctcagcatcccaagtagctgggactacaggcgcctgccaccatgcccggctaattttcttattttttgtacgtttagtagtgacggggtttcatcgtgttagccaggatggtctcctgacctcgtgatccacccacctcggcctcccaaagtgctgggattacaggcttgagccaccgcacctggcctcttttttttttttttttttttttaaatagtttgcaggtctctgctgaagttctccatcttgtgtttttattcctttaacccactccagcatgtgtgttcccgtaggagttttgcttttatgtctgttttatcacctgatttgggagggtttcttttcatgttcttagttgtgattgaatgacaggtgttgtgtatgaaaaattatcgagataatctggatgatactgtcttctcaggatttacctttacttctggtaggtggttatgctggaggtactaacagtctcctaccacattacatagggattgaggtgatttaaaattaggctttagactctatgagttgaaatagtttaggtatacctttagttcttagatgtagccctttgaggctctgatccacagtttaaggggtttaccctccctcttggcaggccctcactccagtttttgtccccttagggcttgggtctgtcgaaagctatgctcatctcagcctcttcagcagtagcctttagaatctgccgatagctctaggccaaaaggagccccacataccagatttgtccctttggcttttctttctttttgcatcttggttcctcaattcctcattgccttgattgcctttacacagatattttgtgttttgtctagtttctttagttattctcagcgggagaattggtctaaaccatctactctatcattcctgaaagctgaattctctcaatgcctctttcatcatttctgttatttgtggaagtttgtctggtttttcatcacatgtagtctgctgtttggtgtcccatttgtatttctttggaaaattattgagtagccaaaagcaatcctcctgatttcagattgttctgttttcatatacacagtattcttttaagtttctttaggatttctgtaattgggatttctgcagttgggaattctaatgatattctaaaatttgtttctctctctctgtaaattttccggggaaatttttgctccagttgatagaacaatcattcttttagcttctaggtcttttcaaatgtctgtttgtggtgaccatgatgatatgatggtgtctatatatattcagtattgctggttgacatggatgcttttctttctttttttttttttttgagacagagtctcgctgtgttgcccaggctggagtgcagtggcaatatcttggctcactgcaaactctgcctcccgggttcacgcctttctcctgcctcagcctcctgagtagctgggactgcaggcgcctgccaccacgcccagctaattttttttttttttttttgagacagagtctcgctctgtcccccaggctggagtgcagtggtgccatctcagctcactgcaagctccgcctcccaggttcacgccattctcctgcctcagcctcccaagtagctgggactacaggcgcccgccaccatgcccggctaattttttgtatttttagtagagacggggtttcactgtgttagctaggatggtctcgatctcctgacctcgtgatccacctgtttcggcctcccaaagtgctgggattacaggtgtgagccaccacactgggccctgaaatggatgattttcaagcttgtgtgggttcctgttctaatatttcaggtatagatgaaagaagagaaagttttagatttgcaaccatttaacagtttgattgacattcctagattattggtttaacagaatgatctacattcctatatcattagtttggtggtttgcagggagtaggggcaagatatagccagatagctatgagacagggaggtttactgctaacgcattgtttgcaatgctgagattcatcagttgtggagctagctgtggcagcctcctgtatttttgtttttgtccccctacccccccccctttttttttgagacagtgtctcactgcacccaggctggagtgcattggtgggttctcggctcactgcaacctctgcctcttgggttcaagtgattctagtgcccaatagctgggattacaggtgtgcacaaccacacctggctaatttttgtatttttagtagagatggggttttgccatgttggccaggttggtcttcaactcctgacctcaagtcatccacgtgccttggcctcgcaaagtactgggattataggtgtgagccactgcacctggtgtgtttctgtccctcatctctaatcctcaacatgagtgctgaaccagatgctttgccagccttttttcttggaggtatcatgggtccgtccacatatgcttgtcgctattctgtgatttccagtggaggtacagattttcccccttggtgtttttatttattaattttttaaaaatttgttcagttattttagtggatattaagataaggtgttggtgggcattggttaaatgcatgagcttagttttgccatcttggactgagaatctacactgggtattttgttgttgttctcatttggtttagtttgatgtctgatccaattaaaaagaatagtgtttttttttaacttttatgtacatttagattgaaattctgcaatcactgaaggactgtgctaggctagttagctcctgactgatgtaaaacctttgatagagtggggctttttttttttttttggagacagggtctcactctcacctaggctggagtgcaatggggtaatcacaggttactgcagcctcgacctcttgggttcaaatgatcctccccccttcagcctcccaagtagctgggactacagtcatgcgtcaccatgggctaatttttgtattttttttttttttttttgtagagacagggttttgctatgttgcccagctggtcttaaactcctgggcttaagcgatcctcccttcttggcctcccaaagtgctgggattataggcatgagccactgcgcacagccgagtaggggcattttttattcaacagacattttcatgattgccagctgcgttttggggcagtgccagattttgggagcacagatgtcagcacgttctttgatcttatatacctgttattgaggcagagatacctttctctgaggccaagagactttttttttttaaagagagagaaacagtgtttgatcaaagtttttgttttttaacccattagttagattgttgaatatcaattaatatataaacattgataatagtttttatatctatagaaaatattccagttaaaatcttatctataatttcagttgaattactcatttttatagtaaatttctgtttattctctgactagatgattatatcaattaagggtttatggtttatatatttttatatatatacacatacgtatatatatacgcacacacgcacatataatagatataatttacccatgttacacatatttagaaagtaggatagtatggattttatggcatttttattttttaatttgttaaataaggaattcagagtttagtaaggtaggtaggacatgagacagaaaagtagaggcattatatattcatttttacttaaaggaagaagagttagcagtctgcttccaccttaaagctagagtttgctagttgggaaataatgctttggaagtggtttgacagattgagtatagtataaggaattgggaaaaagcaggcaactgtggccaaaaagtagattggaaaggaaaatggctagcttcaatatgttggcatggggaaaacaaggttatatctgttagaggcataaaatactctgtacagagagttggttgtcttcattttatatccaacaagaatagtacaatttagggaaagttattaaattgaacctttcagactaatgctttgccatgatgtaggttaatttccctatatgtcgttcatccttgctcaaatatgtattttatttgtaatattataaagttgatataaaaaatacacttgatgccagattttcagtttttaatacagtggctttcacacttgttcaggtgttagaacatctggaagtagtggtatactttgagagatatcatgaactatattttaattacatgaaacaaatgaagtgtaattttactagctgtagatataactcatgtgagtgtaactcaactcggtagaaatatttaaggagcatttgttatgtatcataaatgcataatttcatgatgaaagtgaatcatggaagagctagaagaaaatagaaaagaggtttttaaaaagccttatcaatagtgtatacagtagtccccccttatccatgggagatacattccaagatcctagtatacgccttgaaaccatggatagtatcaaatctatataccagtttttttccctgtacatacatatggcaaagtttaatttataaattaggtacagtaagatattaataataactagaacagttatgacatattgtcataaaagttaagtgaatgttctgtctctctgtctcacagattatctaaatattttcatatcatggttgactatgggtaactgaaactgtagaaagtgaaaccgtggaaagcaaaactgtggataaggagggactgctgtaatatcttttaagattatatcttcagtaggggctggttgccttagccattggcagcatgctgaagtgattctttttaaaaatatttttagagtcaggatctcactctgtaacccaggctggagtgcagtggcatgatcatagctaacggtagccttcaactcctgggctcaagcctcctgagtagcttggactacaggtgggtgctaccacacctggctaattttaaaaatttgtatagagacagagtcttgctatgttgcccaggctggtctggaactcctggcctcaagagatcttcctgccttggcctcccaaagtgcaggcatgaaccatcgtgcctggccctaagcgattctttatgtgtagttactactttcagggcatcattacacatctactgagagaaaatttgtggttctggggcctggaaatctgaattttgagaagcatctgatggattttgtattcataaagtttgagaaacattttctaagtgctgattgaaaagaacaggatattgcttcagaatttaaaagaaacagtgtttgagaatgaactcctcctccagggaaaaatgtaatttatgtatgatggggtagttgctatttattcacttagatgttttttgtttgtttgtttgtttgtttttttgagacagagtctcactccatcacccaggctggagtgcagtgctgccatcacagcttactgcagccttgaccttgtgggctgagttgattgtcccatctcagcctctcaatggctgggactaccatgcttggctaattttttgtatttatttgtagagacagggttttgccatgttgcccaggctgggctcaaacttctaggctcaaatgatcggcccaccgtggcttcccagattgctgggattacaggtgtaagccaccacacctggcccacttttgttttaagaaatgtctttataactgaatattgaaaacaattgccgttctctgaaagtcttttagttgtttttccatagaaatgatcatactatatctgatggcttttaatttaattttgtttgtttgtttgtttgtttgttttttgagatggagtttcactcttgtcacccaggctgaagtgcaatgggccgatcttggcccactgcaacctccgcctcccaggttcaagcgattctcctgcctcagcctcctgagtagttgggattacaggcatgtgccactacactcagctaatttttgtatttttagtagagacagggtttcaccattttgaacaggctggtcttgaactcctgacctcaggtgatctgcctgcctcggcttcccaaagtgctgggattacaggtgtgagccaccgtgcccagccagcttttaattttttttttttaactgtgaaatgtcattagaatttggattgtatttcattaatgtaatatctggaagattcaaagttataatttttaaaagttttaattttgctttattaactgactcaactgttggacggaagcaggaacataaatgaaaaggtcatctgaaagtctcatgtatacaagctttttctaactctccaaaacaaggtgaatttcagacaaattcagtaaacctttattgagtacatgttgcatgctctatgttgggaccatgaggatgattaaaacttacatcctgtcctggtaaagttcacacttgtgggaatgagatagggtaggaatacatgtaaacaagcgatttgtgctttgcctaaatttaatgaatttaaaaggttattaaataaagtgaccatcataatacatgaagaaaaagtgtgtgtgtgcttgcgtgcatggaggtggggttgtggtggtgatggtcatgtttcatacttaggcccgttgtagtagcctaggtagtttacagaggtaaattggattagcatgatggcagtgtagagaagtacatggaatagaaagatatttagatgataaagtagaatttggtgatggattggatatggtggtgagggagagggacatgtcaaagatgattcctaaggttctttaggatttgcatagcaggatgatgggtgctgatgtcttttacggagaaagaactaagtttgggggacaagaagaacatgcgtttaattttggacattatgaatttgatacacctttgtgatatccaggggcagcattacagtctggagtgtgatggaagacatgggctgtagatttgtgagtcatatgcttagaatgtggttgaattgagaaagatgggttattataagacagagaagtgagcggagaagtaggaggaaaactaggagaaggttgtatcacaggaaccaaggaggagagtatctgattctgctggcagaattaagtatgctgatgattggagagtcttttgcatttacctgtcagtcactgttgaccttactgacagctggagatggaatttggaagcaggttgagggacaagtgggaagggaggaaatgaagactgaaaagttccagaaatttagccatgatggggatgactgaatgtagtggttgaggtctcatgagttgggtgtgtgtgtgtgtctgtttaatggatgagattctggagcgtatttaaaaatggaaggctctatttgagagggatagtttaagtatgcaaggaaaatgggataactgacagtgtaagtttcctgggaaggttgggagaacacggggttttgagcacaagtagaaagatttgcattcgacccattgtaggagagagaactctcctttaacgagagggaaggaacataagaacaggtgaatattattgttaatgaggcagtgaggccttttgctgtacgtgataagcaggaaatggttttcaggagtgttgaggaattggttgaccagagaggtaggattactattaccagaactaatatgagaatgtaccatactaggagatttaacaggattgtaaattatatgggaatagtattgttttcagtgccttttccccctcatctgccaggcctcagtgagcccattggagattgtagattcccagtaagtatttaccctactctagaatcttaaatgaaaaatgcataaacagtagctactcttgtctgacttgaattttgtggactaatgatagaattaataagtgaaggaggtctcttactataacagtgtttaattcaccatttcaacaaatctctccctgcagcctactaagctttttctttaattaagtacctgatttacacagcagattttactcatttgaggactcaagtcatgtctaaacagataaaggtatcagctcaggcatagttcaggtaccttgtaaatgcaatcagagttgttctgcagggtaattcagttttagacatccatttctaaaaacgggttctgtctgaaaatggaggccttaataaccaatttctcgttattcagaggccagttatctagtttatttatcaagattaggcagtcaccttgtttttcactcctttctaatctctctgactgttttgttgttttaaactcatgagtaagataaggagaagaaaaacagagaatgtacataaattaatggctaaaatgaagtgttcctttgcatgtttctttttcttatgctttatttctgtgactcatacggagctgttagaagtgacttcatataatattatacagtgtaataaaatgggttttcgatgtgtgaggataccctcatgttatttagattatggacacaattaacaattccagacagaattattttctcatgtttgaagtagtataggcacatggccctttatgggaggggggaagctcttctctgtgtgcccacttttcacatccctctccagcatgactctcccctttctgtcagtcttaccccaggagtccctggcctccttcctctccttgacactgtttgctttgcaagcatatgaaatactggcaccctatgaccagggtagactacaaccagggttggggtgcaggagccagatggagaaattcaaattatgatcatgagaacatgttcctctaggtagtggccatacttttatctctatatccttaggacgtaacacagtgcctggcatataatgtgtctccagaaatattttgtttttgaattaaagactatttcaaaattacagagtcataggaggaatcatttaatttatttttctgcttttataggtgaaaaaagtgaggcttagattcatagcacctatttaagttcctctgacatgaccagttatgctttagaccatacaaagaagtaagtgaatatgatatacaattccagccttctagaagtccaaagttaaatagaacgtccagcagccttttatctagcagggatttttgtgggggcgggaaagggacagagggaaggatgtgatggtggtgctttgttttggttgtggtgcctgtgttgcttgatactgtgttatggcaggtacagagttgcataatatagcttttgcccttaaggaacttgtctaatgtaacctgagacaacatattaagaatcagtgtgtctcaaagcagtatatgattaaatgccagatgagtggtgcacttttatgtatgccaactttataaaatgaaaaaatgctaatgatccatcacgaggcagacatgcactttcagttgctattctgaaagtggaaacagattggacttgggggaactctgcatctagaagtacaagttgatgattattgtccatttgatagagacactggaagggtgtcagtgtaaacactggccatgtgaagattgagcctgttgatggtttcttttgtatcataggatgccacgtcaccaactagggaattctgcccaatcagttgagccaaatagtgctgtcctattgtaaaattgtttaatctgtgtgcttgtgtgtgtgcttgtcagaatttgtgaatcatagaattgttttaactggaagaagacccccaagatcatctgcttcaaccccttccttcctctcttttccagagaggttgcactttacttgagctgtgactaggattatgccacattcttttgtaagttgtaacctatttttgtctgttttgaatttcctttttttgctaagctttagcacaaagttcaccaggttttgaatgaatgtctcatatttgcaataatttagggaacagttgagcatggaaggagagaatagaaatatggggagggagatcgtgaaatgatgtttccagtggaattaatagaagtacaaaggaccaagaattaaggtgcggctcagatctcccttttgtctgcttttggtttgtgatggtataacattgcctgcaaacagccacgatgaatattttcatttttattaatagcaatatgggggcatgaatagattctgtgatatttttagatacgcagagactgtgaagaaaatgacatttagtatataatttttaccctgctcttaaggtgtttgtaatctagttgagaggtcctaccttcaaaaggtttacgatctgattggagactgaaggacctaaagaagttaagtaacaatgtcatatctctgtcctttctgctaaatgaatgctacttactatttttccagtgcctagaagagtgccaggcccatagttgattttcagtaagtattggttgtatagataaatagaaggtactgacagtaagcatgagaggacctctgagtggtgtggcatttggagaaggcctgggatcttgtacagtgcaaagcttaagtaacttcattctaagtttgtatttccaactcccccaacctcagcatgttctccccacccacctcctcacaccccaaagcagtccctgtcttttgttaactgatttttttctttggaagcaagcctgatctttctcacatttattttgctactgctcaggctaccttcttttcttatctctacctttcctctttctcacaacattgctgttcctcttcaaggatttagaaggatcatgttttggtttataagacaactgtgttttcttaggtccttcttctctccagggattattgtaggaggtaaggcactttctgtggaagaactgagttatcagaaaaagttcagaaacatattctatgattatttagaggaaaactgtaggatagtgatatcttataataacatagcaatttttttaaattaattaatttatttattttgagacagagtctctctctctggcacaggctggagtgtagtgacatgatctcagctccccagaacctctgcctctcaggttctagtgattctcctgcctcagcctcccgagtagctgggattacaggtgcccgccaccacgcctggctaatttttgtatttctagtagagatggggttttgccatgttggccaggctggtcttgaactcctgacctcaggtgatccactcacctcggcctcccaaagtgctgggataacaggcatgagccaccgttttcaggttgtcataactacattctaattgactgcatatttttaaacacaaattaaactagttatgttctccaccctactcagttttggcagtataaaggcctgtttcacagagaagaacacataaacaagtaagtacaaggaagcttgtgtgaatgaagttctgctgtacagctcagtgactttctctgatttaagatgtagctcttggcaatttcaaatagtttgtgttctctgaaggagaagtccagtctatttaactgtgtttagcaaaaactaattatgattctctgatgggaaatagattctcagactcatttattcattcaacaagcatttattgagcagctatgtatgaggcactgtgctaggtaacgggagaaataagttaccagtctaacaaatggcatatcatacgtaaaaataatactgctgaggagaaggtgatatatgctgtaaaaggggtgcagagtgctttgggttttctaaaaatgagaaggttacttccatgaagcaactcagtgtaagctttatgggatgatagaatttgatagatcttgaaggctgggtacatggttcctctgtccattgcgcaggatgttggccctggcttagcagtggagacagacctatggcgatgggaagcgggagaggaagtataatgagcaaacatccagaagtgggaaagcattggtgatatgggcaacagaaagtaatttacttggaggtttagggtggtgatgtgaagtggcacaagaaagggatagaaaagaagcgtccttgatctgacagtggtgtatactgtgaattggaagagtgggttcagtctaggctgtttacccaagttggtgtttcatggaccattgttcttctaatctagtagtttaatagttttatattaggggaggggaaagtgttccctgttcaagtaagctagagaatccctgcaggagaagcagggagaaggatattgacaatgtagaatgctttctgtgatatactgtattcagttgtgttgccgtattaaacacagtggatgtttgaatgttctgtagatttttatcacctgaaatttgttggttttcatgctgatgtcttcaaggatgattcaggaggagcagtataggtggctggtctagtttcatttcccagccccagtccacaaagggctctgtttatctaaaacaatggcagtgtttcctaccgtcctgctaaataagaggtctaacacacagtaaagtgttcttaaaagattttagggacactgaggtgtagggtgtggcacgggcaaccgttggttgcacagatacagtagatgctctatgtttctattgagttaagatacagttagctgtattttccttgtatctttctgcagatctcttccttcatgcctcctctagaaacactagcagcgctgggtgtttctaaggtcttggggaccttaggcaagctggttaacctctctgtgctttagttttctcatgtgtaaagcactgtgtgctggagatttttaaaaagtgtgttgatatagtaagtcatttaatctgtggttatatacctagtaaatgacaagcaggaatttgaactcaggccaggctcttaaccagcttgctgcattacgaaatactaaacagtgtggttttccctcctggaattccctttctttctaagtgcattatctcttataccctttgtttagtcagactacttcctctatttcaaagagaaaggaaagaagctcttttttaattgttcagagttgtgtatggcaaagagaatgcccaaatagattttgttttggaatcttattgttactggttgtttactgccccacatccttagctccaaagagcagagaggatttactgtgaagtttggcatgtattgtaggctattatgccatgtaataggcccaaaattgtggccctaggaatacaaattatgttaagacatttaaggcaatttctagaaatctttttcccttgaaaagagtaccaataatttttctcgctaatggccaaaattactcaaatcttacttttggacttttaaaatatatttttactgcgttatagttgaaatgtaggtatggttgaaacgtaaatctagatcttaagtgtactattcaatcaattttgctgttggtactattcaatcaaataggccagtgggttttctttgtatttaatcaattagtatgggaaaatatttttattttaaataaatgtctctctttattttttgtgtatttctaaattcatatgtattttcaactcattttttcactcggatacatagtttaacaacagcctattggaagtactcttttatatgagtttctgctatacttgaatagtttcccttcagaaatgaactgtttgtgttggagctacatagagtgaataaatttcctgggcggaaacgataataaaatattcaggaagttattaggaaatgagaacttgtgttcttgttcagtcagataagcttctgagacctttgcatatatcaaagcagattgtattagaggaaggaatgagagatttggcaactttcttctaatagtgatagggaccttggtcaatagaatgatggaatatatgatgtataaatgaaagaaaaattctcaaagcaaagttgtttgagaattgttttttctctctctttttgtttgtcagggaagaaaagtgagagctttctgaagttaggttatgtaaataacccagtagggaaaactgttcctgggggagacctacaaataattgatggcaataagcttcaggagtatgaaagaagtggatgagtatgcctttcccccattgattccactcacattttttcttctctgtgctttgctctcttgttgccattagacagtttctatctgtccttaattttagccagtttgttctaaagtaactgtgaacactgtaactctctagccagtgcctttcttttattgaatggaattggtgtactagttgttttatttaacaaacagagtttataggcttgttttttcctcaacatgtcttcatggcagagacaatttacccttaagttggtgagccctggatcccctcacttgcatagacctcttctaggatctgggagaggctctagcagtgtagtgtgtttgttagttacatatttttgtaacatttgcaaaattgaaaaatttttttccatttttttttttcttcaaaaaggccctcaaattatatatgcttcaaatttcacaaaactcaggtcagccttggttcatggtagaggttgggtgttgatttctaattgtggccgaggtagatttggttagtggattaaaggacatgaggaaggaagcattagtgaggaagttgaaccattgactggtgtgtatagtggccagggatctctttctgagtgtcaggggtcatctcttctccctgcaaacatgggccagaaagaggcgggagaagttgggtaggactggaagaaggacagtggagggaaaggtgtgctgcagccaaggtggtaaacaaattaaggtgttctccttagatttcaaggatgcatttgcaaatagcgttttcaatagcattttaaaataactgaagagtcatttcaagataatatatttcatcttgataataatacattttaagaattttagaattattgaaaaatttgaaaagtcaatttcataattaactgattgacttgagattaaagtctttatcttattaattagaatatattgctgaacacataaaacacagacatgttcatttttgaagggcgttgctgtaacttgggttttgctagcttcttggtttggtagatgtttcatctctctcccctttttctcattgtctcacctgtatttttttctaccttttcatttcatgttccctttactttgggattcaaactcctcttagacttctcaggattttgaatgactggactatagataatcacattttaaaactgcattttaatattctgttctctttaaagaaaattaggtactctgcatggcctggggacaaatttacagttaaatagaagtataatgttctgagggccaattgtaactaccctgtggttaactggctcaggttcaaatacagttaaaattattttacttttcctaaaattccttctaattggactaacttatcagggttgataaaaacatttccagaacgtagtatggatctgccacctggtggtgaaatattacagcaagtactaagtgttttgtttttttttttctgagacaaggactcactgtcacccagactggagtgcagtagcaccatcacagctcactgtagcctcgacctcctggactcaagcaatcttcccaccttagcccccagagtagctgggaccataggtgcatgccaccacacctggctaatttttaaagtttttgtagagatagggtctcactatgttgcccaggctggtcttgagctcctgtctcagcctcccaaagtgctggcattacaggtatgagccaccacacccagccaaatactagtatttttttttttttttttgagatggagtcttgctctgtcacccaggcttgagtgcagtagcccaattttggctcactgcaacctccgcactccctgctccgggcccaagtgattctcctgcctcagcctcccgagtagctgggactacaggcatgcaccactgcatccagctaattattgtatttttagtagagatggggttttgccacattggccggactggtctcgagctcctgacctcaggtgatctgcccaactcggcctcccagagtgctgggattacaggcatgagccgccacgcccagcctaaatacttgataagaatttaataatggattcttgcctttgtggccataatatttagagtcgagtctacttaagctctttagatatgtaacattttcctcccctaagtttttttcactgagaaaatgttacttaaatgcgatagagtaggtaaattttgactgatgtgtttctgtctaccgcatcgtaatataagatgacatttgtagaattactgagctgaaataaattctgcacacattgagaatgtactctccttaaatttgaagatgagcttttgagaagagaagattgctgttaatttttctaaaatttcaatgtggatagtcattgattcacagaaaaaacagtaatatgaagttcacagaacaaagaaaaaacagtaagatgaagttcacagaacaaaggatttttttttttggaaagaaagcattttgtttattcacttaaaaatattagcaggcatattaaaactacttttagcaaatagactaacagttttatcaccctcaaatgaattattaatacatatcagtattttatatatgggcactgtgttaggtatacatgataaaatagtgaaaataaaaatgtctcttgtcctcctggagtttataatctagctagaatctgtaatctaacataatgttaagggccataaaggagaagtgcataatagggagagttcaccctggctagtgtatcagagaaagcttccctaaggaagtgacgtttcagctgagatctgacagatacagaccctggctaaaatgtgtgtctgtatccctttaaagtgggaaggagagtggcaagtatgaggaattgaaaataacagagtgcctggaatgtagtgagagaagggactgtggtgtgaatgaaaacaggaaagacggtaggagcaaataattcagggccttgttggatgtgtatcaaggactttggacttcatcatgagagtaatggaaagctgttgaattgtgtagttaagcagtgtcagatcagattaatgagaaatgaattggagcagggcaaaactgaaaagaggtcaggcagttggttagaaagcaattgtggtagttgtggcttggactagagagtgtaaatgggcgtgatgagaggctgccatatttcaaatatatttgaggtagaatagacaagacttggtgattgaatgggatggaagggggagaggtagagggagatgccaaggatgggcccaaatttctggcattcatacattcaataaatatataaatataaaacatatatatatataaaacacagtttggtccttaaagatagaaagtcgagtagccccagcgttcagttcacaatacattatcattggacagtgcaagatatctcttattttgtattttttactctgccttcatctgccacactcagtcccatttcccttgtctccttaggcttctactctaatatgttttatatatgtttttgaatatgcattaaatacataaaatatgaaatgttgttttgtgtgtttttaacttgtgatactgtgctgtacatgttattttcttcgttattctgccttatgttccttattactagctgtatggccataggtaagttatataatgatttttctgtttcctcatctgtaaagtgaggataacaatagtattaacagtacttagattatagataaacttttttaatcctcccaacaagtattcaggtgtctgcctcaagggatcctcctgccttagcttcccaaaacactgggattacaggcatgaggcactatgcctggcctgtttttcatttattttttattttatttattttcattgacaaataaaaattgaatatatttattgtggacaacataataatgttttaaaatatatagggattgtggaatggctaaattgagctaattaacatatgtattacctcatatacttaacgtttttctgtagtgagaatggttaaaatctaccctagaacttaaagtataattaaaaaaaaaatctcccagcgattttcaagaatataatacattgttataatattaactacactaaccttattgtacaatagacctcttgaacttattcctcctatctaactgaaattttttatccttttgctaacatcacccaaatccccacccttcaacctctggtaaccaccattctgctgtctgcatttatgaattctacatttttagattacacatttaagtgacatcatgcagtatttgtttttctatacctggcttattgtacttaaaatgtcctccaggttcatctttattgtcacaaatgggaagatttcctcctttttaaaggctgaatagtattccattgtgtatatataccattttttcctttatccattcatctgttgatggacactgggtaaattccacgtcttggctattgtgaataatgctgtagtgagtatggaggtgaagatatctctttgatatacttatttcatttcctttggatatatacccagtggtgggattgctggatcatagggaagttttatttttcattttttgaggaactttcatattgttttccacaatggctatactgtccatttatgtttcaattttacctttttctttttgtgtgtgtgtgtgtgtttaatgtgtgtgtgtttaatgtgtgtgtgtgttcagtggccccaggtcttctacagtttcttctttaatagttttaggtttcatctttaggtaataaatatttattcaacaactgccttgttctaggcattggatgtaaaaccgtgaaccaggtatacaggggccttagctgaccccatggagaaacaaagcaactggatggatagtggtagtgatttaggaaatatggatgatgaggaagtttggggcagaagtgggggttggatagagtaaagatcattagttcagttaaaaaagtttttttttaaactacagagggcccttatgccagctttttgtagtcaagccctccctccactcctaactcttggcattcactgatctattcaccatccctttcccttttccgggcataaaatatgtaatcttttggggctggcttctttcaccaagcataatgcctttatcacacaacaacatagatgaatctcaatgttgtatgaaagtttgttccttttcatcactgagtagtattccattgtatgaatgtaccatagcttatccattcacctggtgaatgacaactgggttgccagcagttcgtagggattatgaataaggcagctataaacatttgggtttataacgttaggtttttgcgtcaacatgttttcatttctctagggcatatatctcagagtaagattgctgggtcatatggtaagtgtttaactttatgagatactgctcagctgttcctcagaatggctgtaactttaaaattcccaccaacagtgtatgggagttatagttgattggcatcctcaccagtgttaggtattctcagttttgttttgttttagccattctattaggtattttagtgatgtctcatagttttaaattgcatttccctaatgactgatgatgttgagcatctttttctgtgcaacttgccctttttggtgaagtgtgtatgcaaatcttttgcccattaagaaaattggggttgttttcttgttgttgagttttgaattctttatatattttttatacaatttattttgttaataatttgcaaatattttctcccagtctgtctttttatactttcaatgtctttcacagcaaaagtttgaaatttagtgaggttcgacttgccagtttttttcttttatgaattatgtttttagtgttatgtctaagaactctgtgtctaagccaggtttacaaagacttttctcctttatttcttctaggaattttatagttttacatttgacatttagatttatgatccatattgagttaatttttacataaagtcaagattttcttttgcatatggatatccagttgttccaaccttgtttgttgaaaagactatcctttttccagtgaattgcattaggacttatgtcagaaatcagttgaccatagttgtgtgggtctacttctgtgttctctgtttggttccattgatctatatatctgtccttttgcctatcccacattgtcttgattgctgtagctttatagtaagttttcaagttgggtagtttgaatccttcaattttgtttttcttttctgaaattgtttagctattctactttctttctttttccctgtaagtttgtcagtttatctttatgaaaattttggttgagattatgactggaattgtattaagttcatagactaatttaggaagaatgggcatcttagctatcatgagtctttcaatccatgaatatagtatgtctttttttttttttttttgagatggagtctcactctgtcacccaggctggagtgcagcagtggcacaatctctgctcactgcaacctctgcatcctgagttctaactgcctgtttctagatttctttttttttttttttttgagttggagtctctgttgcctaggctggagtgcagtggcgcgatcttgattcacacgattctcctgcctcagcctcctgagtagctaggattacaggcacatgccacccatgcctggctaatttttgtatttttagtagagatggggtttcaccatgttggccaggctggtctcgaactcctgatctcatgtgattcacctgcctcgacctcccaaaatgctgggattacatgcgtgagccaccgcgcctagccagaaacaattttatttgttccttttcatttgtatgtcttctgttaattttctttgccttattacactggataggattttcagtacagcaaaaaatggtgaatgtggacatctttgccttgtttctgattttagggagaaagcactctgtcttttaccattaagtatgatgttagctttagtttttttgtagattctcttttttgagttaaactcccattctgttcctagtttctgagagttttttaaaatcatgaatggtagttgaattttgtcaaatacatttctgcatctgttgataagatcatgtggttttcctttatagtctgtcattatggtggcttacagtgagtggtttctgaatgttgagcaatcttatattaggataaacctcaacttggtagtggcttaatattccttttatttattatatgtaactggatttgatttgctaatgctgcattgaagatcatgccatctttgttcatgaggaatattggtttgtagttttcttgtactgtctttgtctggttttagtgtcagagtaatgctagctgcataaaatgagttgggacatgttccttccttttttattttctggaaaagatcatgtggaatgttatttcttctttaactgtttagtagaatttaatactgagatgaaatgggtcttctacaagataaatttactttcataatcagaataatgtaattgtagaaacttaaactatagaaatgaatgatgagaatatcatgtctcacaattcagatgattattaatattttggaattctttttctagttttttcctctgtatacataattgtatatttttgaattgcatataaatgtgggtatatatttaaaacaaaatttgtgattatactacaaataccattttatttctggacccagtgtggtttctaattttgttgtatggatatgccataattttacataaacattcttctaatgttgaacatttaagtgtgataaatgtcttttatgtgtttttttcctgataatttatttgacttatttctagaaaagaatttgacatatgtaaggctgctcacacacattgctaaattgctttctagaaagtatatatacgtttttactctaaaataggtaccttaaaaagtatgtttatatcttcagatatgtaaagacatataaaatatatagtaatatatatctgactatgcatattcatatttttttttaaaggaaggagtggaagtgaagagaatatatatcaaggggttagcaagattaagggaaagactaaagaaatttttctatgagacatctttgtagatcagggcaaagattcagtggaaaggaagatattgaaccaggagcaaaaatgcagagagttgtttgaaatgatgaaatatggtctggatgaaaatgtagggaaaaatgatatcaaggagagaaatgcaggaaacaaaggaactgtgcttcttttaggttgagacctgaaatagctgatatttgaccagtttttacctaaaaacatgtagtttcaaacacttttacctgatacttgtgatggaaagtaaagaggaaagatgcaaaataaattttgaagtgcaaagaagagaaattcaatttatagaaaagggattgcattttcccaaataggaggcaaggctatcttaatagaatgggtcagggtaaaaagagtgaaaaagttttgtataaatagtgtggggaatgtacagttatagtcacagacaaagatgagttaaggggcagtagtctcaacacaaaatgaaggctaggattaaaggagagggaaaggactgaagaggatggggacattcaaaagagagcattttagttaattttggtaaattaattgggcgtgaaatagagaagatgaagtaagagagagtaaagtcttgaggctagaaaaactcctaagaagaaggaagatgcttcctaagaagattcagaaagagtaaggaaggaaaagtgttagattttaatttgttgagcttgagttgacttgaaggaagagattcagatttgtgcatcattatggttgatagttgcagttctgagaatgaaaaagctctttgaggaaacaaatacagacaaaaggtcattttatttttattggttagtaattcaacaatgtcagatattttcaaaccacttatctttctgtctcctgattataatgatgagtgaacactagatttttatgtttgattaaaagcaatttatttttgtctccctacccccttttcagaagtgggaaatttcacttctttttaagaccggacataagtatgtgtagtaaagaataagaataggaggatagattagaattaattagttcagtgatttgtatgtacctgataaagtattctaataattgtttttggtatcttagagaaaaaatatctcctaggcaatatttttttttctgcatataaatgaaaatgttttgacatatgatataggactagtgaaccaataacttctcctgggcatctacctcaccatgtagaaaatggaatgaagactttggcaagcagtcaaataaaaatatgcaatgcatggaaaataacaaatgcgttaaaaagataatattgcccatattgagggaagtacaagttaaaacaacttacaccattttttttttttttgctccttaacttggtcaacatttaaaggcttcccagtgttgacaaagaaaagggaaaatgtctttctcatatactattgaagggaatatagattgatacagccttttttgtaggtggtgatatttatcaaaatttaaaatatacattattttttacttagtaattctgcttctagaaatctatcctacagatacctctcaagtgtgcaaaaagttatgggcacagagatgttccttgaagcattgtttataatagcaacaaattggaaatgacttaaacactgaccgttgggtatagccctcctacataggatgaccatatgtctaaatttgcttgggacggacccagtttacaccagcataattatttagagcattttattttactctcagatgtgtcctggtttggaagataatttacctgtttggtttatgttcacactaatagcatggagaactatgtagctgttcaaaataatgagatagaactataggaattgatatagaaatatattcaagatacattgttatgtgagagaaacaagttgcataacaatatatattattccatttattttattttatttttatttatttaagagggagtcttgctctgtcgctcaggttggagtgcagtagcgcaatcttggctcactgtggcctccgtctcctgggttcatgggattctcctgcctcagcctcctgagtagctggtactacaggcgcatgctgccaagcctattactccatgcatttaaaaaagtaaaatctctaagctctctgcatgtgagtgagagagaatgagagacaggagttaaaaatgtctggaaggattcatactaatttgttaatatgataatctctgcttaaagatggcagcccaatgaataggcatatattgaattttttaaaatataaaagcagcaataacaaaaaggtgggaactgttgattgccagcagatgctataatttttaaccagagagcattaataaacaactattacaattcttaacataaaattataagtattatactctgtcctgtataaataactattgtattagaaagaatactaatggaaaatttaaaaattatcactatcattccactattaccaatcattttacatgttacctcctgttcctcgtatctttatgtacataattcttacatcgttataatcagagcatatagtttcatattattttaaattacaccctatagcatattttttgttacaatatagtatctagcatttttagatgttttatatgtgctaagtactgtgttaaatggtttgcatgtgtaatagacttaatcctcccaattgcgttattgaggcagttactattatcccaatcttatagatgagtaaactgagaataagtaatttgcccaaggccacacagatacagcaaatggcagaactgggatttgaactcaggcagcctgactcttgaacccacgctcttatccactactattactacctccctttacaattttttagtgactgtgtaataacagcataccataatttacttagccgttttcctggttgtatatttaatttgtaggctttaaaatctgaacctcaaaagtttttattaaacaagctgatgcctactatgtgcaggaacctatttgaggtactatggacattggtacacatatgcagttatggtctagtattgttttatcttgccttatgtattacattcctgaaaagctatatacgtttgaggtgaaaatttgtttatacaaactttttttttccaatcgggtttcattattttaaagatacattattccagaaaaacaaatacttaaaaactagaaaatatttaataaaaattagcagtgagctcagcactgtttggtgcctttaagggttctgcttttgcgcatagtgaactgtattcgttttgttgttgttattgtttgtttgtttgtttgtttttctgagacagggtctcactctgtgtcccagggtggagtgtggtggcatgatcactacttgctgcaaccttgacctccctgggctcaggtgatcttcccaccacagcctcctgtggagctggaactgcaggcatacaccaccacacctggctaattttacacttttttttttttttttttgcagagactaaatggattctgtaggatattgtgggaaagactgggaatctttcccagtagaggtctcgctatgttgcccaggctggtctcaaattcctggactcaagtgatcctcccacctcagcctcccaaagtgctggggttaaggcataagccaccgtgcctggcctgtgagctgtattctttcatgtgacagttgcaagaaaaattacttaaataaatgcatgccaggatttgtgattaccgaataaaagtacataaaattgaactctctattcagatggagaaattacatgggtaatctccaaatcttttgtttacctttagaatatttatttatgcttatattgaaataaggtgaaattacaacttcagggttcatacagagaagtcacatttgtaactcaggtggatttattagatagcgttttaactacttctgttccctggattagtcacctagtcaccactcttgtctttgtgagatagagatatcaatttaatagaggaacctaagtactacacaagtgtcagctgctgtagttgattaagggggataattaagagctttattttaaagctcacctgctgaatatctagatacctgttatataagagcaaaacacatggttatctaacaaataacttataatccactttacttaattatggcattagtttttgatttgctgatccttctattaaaattttatattaaatacagcatttagttgatgagtttcattgaaaatgttcatttttaaattgatattgaatgtagttggtgtttggttactcagtgtatcttctgtacctggtctttttcagtgttcttatatttatatttcaagtcagtcataaagattttcacacataaataagattactattttgaaattgaaatgataaaataccataaagtgcccagctttagaattttaaattattttatgtcataattattgctttttaataagctttattttttagatcagttttagatttacagaaaattacagttagtgcagagttcccatatactccacacccagtatctcccattgttaacatcttatattaaaatgatacatttgttacaattagtaaacctatattgatatattaactgaagtctatactttattcagattttctcagtttttagtttttaacctaatgtcctttttttctgttccagaatcccatccagcataccatattacatttaattgttatgtcttcttgggctctcttggctgtgatagtttctcagactttccttatttttgatgaccttgatagttttaaggagtactggtcaggtattttatagaatgtttctctgttaggatttgtctgatgtttttctcaggattagactggggcttatggttttggaaggatgaccacagaggtaaagtgccatcacaccatttcaaggcattgatacataatatcaacatgatgtatcactattaacattgaccttgatcacctggctgagattgtgtttgtcaagttctccctggtaaagtcacctacctttttccatactgtactcttttgagaagaaagtcaccatgggcagcctgcacttcaggagtggggaattatgttctccctcgtagagggtggtgtttctatgtgaattatttggaattcttctgcatggggtatttgtcttttttctccatttaaaaatctttcaactgtatattatgaactcatgggtatttattttgtactttggattataatccagtaatcctttattttgttgcttaaattgtttcagctttgaccatgggaagttcctttttttttttttctttttggatacaaggtcgtgctctgtcacccaggctggagtgcagtgacatgcttacagctcactgcaacctctgcctcccaggctcaggtgatcctcccacctcaacctcccaagtagctgggaccacaggcgtgcactaccaaccacgcctggctaattttttgtattttttgtagagacagggtttcgccatgcttccctggctggtctcgaactcctaagctcaagcaatccacctgccttggcctcccagagtgctgggattataggcacgagccactgtgcctggccggaagctccttaatttggccccggtgtctcattgacatacctccatcattgtgctttttgttttgttttgtttttagcacttccttacctttgggcactacaacatgctccagactcatcatttgtatttcttgcctaattttagaattaaccattccttcaaggagccctggttccttctataactattttttttaattgcgatataactcacatactatataatccacctatttaaaatgtgcaactcagtagcttttgatatattcacagatgtgcagccattgccgcaatcaattttagaacattttcatcaccccaaaagaaatcttataccccataagcagtctactgtccatttctcatgttccccggtcctagataacactcttttgatttacctattcgggatatttcatgtaaatgaagtcatataatatgtgatcttttgtgcctggcagcttttacttagcatgatgttttcaaggttcgtccatgttgtagcttgtattagtatttcattcctttttatggccaaataataacttcattgtctggatataatacatgttatataatcattagttgaaggacattggtttatttgcgtgtttataccttttggctattatgaataatgctgcaatgtatattctatacaatagcctttctaaagattttgttgttgtttgaattggaattagtatctacacaattgattggtatacgttttaagtttcttttaagtgataattatcccctcttcacctccctgttttcttctttgtcatttgtccagaagaatttccacatggttgggatattgctggttgcttccccatggtgtttcttaccatcttcctctgtcttttttatttttatttttgtttcttaattgttagttggatctagagatttgatcatttcagggttttgttggactgccacataggtgatggtaatttattctttcatcaagaggtgtgtaatgtctgtttgggtctgtttctctgttgctattagctaccagggtttagaaaaccatagctaggctgggcacggtggctcacacctataagcccagcactttgggaggctgaggcgggcggatcacgaggtcaagagattgagaccatcctggccaacatggtgaaaccccgtctctactgaaaatacagaaattagccgggcatggtggtgtgcacctgaagtttcagctactcaggaggctaaggcaggagaattgcttgaacccaggaggcagaggttgtagtgagctgagattgtgccactgcactccagcctggcgacagagtgagactctgtcttaaaaaaaaaaaaaaaacttaacagctaatggtcagttgtctctggcttgttttttaaataacctataagctaatgttgatttttacattttgaaagtgtttttaaaaaagaattaaaaaaataagcaaaggagaatttgcgacagcaactgtgtgtagcctgaaaagcctaacatattttctgtctggccctctacagaaaatatttgctgacttctgtaccgtttactttttattgcctagagctgttgattcattaggagttgcaaaatagtgataatctatcattttttcatttatttggtagagtacttctataaacagaaactttcaccaacaattttattgccaccaggaacagtttgatggggaaagatgtttaatttttttcctcttccttttgaaaagttttcaagatgatttggttctatagcattcacgaaagatgaccaattagtctttatttgtttttttttttttgagattaaagtaatggaattcaacagatttgaccatttcagttgttttattatcattattgaagcctaaatgtcccatgggtcttcagaaagttcatggaaaatgcatatatgaaaaaactatgcatggatttcaaaatttctttacatcaaaataaacttgtgttaacttgttataagatgcctgaataggatctagtttgaggtgctaccagggataaaacatcattttgagaaaagcccctatcagagcagtatgaattctgctaaaattgaagcaagaacaaacgtcaaatttatggtgaagcttgggtggaagagtgctaaaatattgatgcttacgaaaagtttatggggacagtgcccccaaagaattcagcaggttacaaatagataactcattttaagaagggacaaaacagcgttgaagatgaaacccacagcagcagatcatctacatccatttgcaaggaaaaaattcatcttgttcatgtcctaattaacagcacaaacaatagcaaacacaatagatatctcggttggttcggcttacacaattatgactgaagaagttgagcaaacttttcactcgatagatatcaaaaccattgtgcccagatcagctgcagacaaaagcagaactttgcatggaaattttagacaagtgggctcaagatcctgaagcattcgaagaattgcaacaggagatgaaacgtggctttaccagtacaatgttgaagacaaagcacaatcaaagcattggctaccaagaggtggaagtggtgcagtcaaagcaaatgcagaccagtcaagagcaaagatcatggcaacggttttttgggatggccaaggcatattgcttattgactttttggagggccaaagaatggtaacatctgtttatatgagaatgttttgagaaagccaaaattttagcagaaaattgcacaggaaagcttcagcacagagtccttctcccccagggcaatactcctggtcattcttttcatcaagcaagggtgactttgtgagagttttgatgggaaatcattaggcatccaccttaaagtcctgatttggcttcttctgacttctttttgtttcctaatcttaaaaaatcttcaaagagcactcatttttctttacttaataatgtaaggctgggtgcagtggttacacctgtaattccagcactttgggaggctgaggttggatgattgcttgagcacaggagttcatgactaacctgggcaacatggtgagaccctgtctcttaaaaaaaaagaaaaattagctgggtgtggtagcatgtgcctgtggtcccagctactcaggagattgaggcggaaggatcaattgagcccaggaggtcaaggctgcagtgagttgtgatcatgccacttgcactctagcctgggctacagagcgagaccctgtctcaaaaaaacaattaataataatgtaaaaaagactgcactgagatggctaaattcttaggactgagttctttagggatggactaactggttggtatcattgcttacaaaaatgttttgaccttgttggggagcttgtgttgagaaataaagacgatattttaaatttttatcttttaatttcatttttccacgaacgttttgaagtcctctcatatttggccagtcagagcctcttttttttttttttttttttgagaccgagtcttactcccatcacccaggctggagtgcagtggtgcagtcttggctcactgcaacctctgcctcccaggttcaagcgattctgctggctcagcctcccaggtagctgggattacaggtgtgcgccaccatgcctggctaatttttgtatttttagtagagacagggttttgccatgttggccaggctggtccggaactcctgacttcaggtgatctgtccacctcagcctcccaaagtgctgggattacaggcgcgagccactatgcccagcccagagcctcttttgagtgtttgagatgaccttagtggccattgatagttttattttctattatgatgagatgtttcatattcatctcattttctaatcccagacctggaactagccttttttttttttttttttttttgtaagttcttttcagtggaaaatgatgcgtagagaccaaaacctgagtatggaaagtgctcattgccactgggttggtcatcattactaggccttttaagtgaagtgagctaggaaatacctattttttaaagtagtaaaatgaatttatattagtacttaaaattgaaggctaaaagattatactttaatgttactgatttttacatctatagtgtttttcttctacaccaagaatatcatgttctccaaatcagtaaagttactcatttgctttatcccacaacacacacacacacacacaccctcagaataacaatactaatgctaactgcaataaaatggtcattaaaacagcttaaatttttttgcagttcttttggtccttagagtatatcctactatgtatagtttggttactgggttcttaaattctctcgaactagttctctgtgtgattttaatgacagctggtcaattaggtttgtctaatttatactttcaatttttagagattttttaaaatctaattttgttttttaattatgtaaaatgtttacatagcctcaaagtcaaatctatgaacaagttctgtgaagagacttagcctcaatccctgtctctttcaccatatttcctctccctgtgtgtattaaaagttatatatatgtgtgtgtgttaatatcctacatttcttaggtaaatacactcatttttctccaaacttacttgttttcacttaatttgttatagaaatcactccatggtagaaaataaacttattttacagtcttgcgtacaactgcatagtacctccttgtgtcagtgtgtcatagtttattcaacatgtctcttattgagggacatcaaagttgtttccaggttgttactacaagtagtggtacagtgaatagccttgcttgtacctgcctgtttttatattttggccagtgtatcttagggagagattcatagacatgggattgctaggtaaaagggtaaatgcatatataattgcgctagattttgcagattttcctctatagtgaatgcactattttgcatttccatcagcctattttcctatatttgcctacagagtatgtcatcaaacatttggatttttgccaatatgataggtgagcaattgtatctcactgtagttttaatttgcatttcttttattatgaagttgagcatctttttaaatgattaagggccatttgcattccagttcagtaattaattctacatctgtatgaaaatgatatgcagcagtgtggatagtcttattttactcctggagatgcatttacaactgcttttggtttatatatatatgacttcattgtgggtattttgaggttggtgtcctattcttctgatgctgttaacttctttcttagattttagaggtttcccctcttttcttcaatattattttgtatcacaagtgtgttatcaaacttttaagagctcaacgaatgaatgaaatttgtctatgacaggacgacagcttaccaatgcaggactgagttaagaagcttttgaatttagtttatctttatcagtaaatgcacagttgaatagaagaattctagaacctggtttacagaccttgtgagactatgacaggatttttctaacacatctgtttattttgcattgaaagcttgtgtatgcatagaattctttgcagaaactagctttgataatataagattcattattaaggatttttaatcttgtgttcttttcctttgcttatgtttaaattgttagattgtcctatgggatttcataaatattacttctgttagtaaagctgctgacagcagaagctttcaataaattattcatgtgctatttgttttctgtgttcatgaattaattcaacttagaatttttttaactgaacttggtaacaatttgtagacatatgggtacttgaataaaatctgtaatacttgttttccatatgaggaaagtactcttagcaatatttagagcaacatcagctctctagaacatagctgattactaaggagtaatggcaaaatcgctttaaaaatgtgaaataattactcttataaaactgctgctttttcaagatgtgagccacggaattatatcattttctacttttcttgttcactatcatttgtatacttactgttcactttcatttattgaaaacttcagatgttattttacgtcttcctctccattccaaatctaccattgttctcgataatttttatctacttgacttgcattctcaatagcattttcagttctttaacctcgtcatctccagtcacttctcttccatgccatttcaaacaccagcgtctataaatgtgccctatcgctttgtcatcactcaggagcgctaaaatattaaaataataccccagtctcacatagtctccagtcgttccaggttcctcacattatagccgtgctatttttatccatctcagttcagtcctatttatttccttccctgccttagattccatgtacaaccattttgatatcttttttttttttttgagatggaatctcactctgttgcccaggctggagtgcaatggtataatctctactcactgcaccctgtgcctcccaggttcaagcgattctcctgcctcagcctctcaagtagctgggattacaggtgtgtgccaccatgcccagctgatttttgtattttttgtagagatggggtttcggcatgttggccaggctggtcttgaactcctgacctcagatgatccacccacctcagcctcctaaagtgctgggattgcaagtgtgagccactgcacccagccactttgatgtcttgaaccctcttcattgtcactttcaactcatctgcctagaaaagtttaatttcaaatgtctactttccttccttttctactttataaaatcacattctcctatttgaacttctttaaatacagttaccaacgtcagctgggctctcagtgtagcccagtaattctgttttgcctctttagtgctctcttccattcttgccacagctatttcagatgttttccactacctgcaaattctggtccttcccaacaccaccacccttctctcatcatcagcagatgaactcatctcatattttagaggctattcaagccgttaatgattcctgtaactaactaccaccagacctactcatatgttcattcttctttcttgttacaagaggggcagcattccttcaatccaaaattaatccttctacacatcttttctcatgtaagcattttaatgctttaactttccctttaagcgttactttagttgcattgtccacattagacatgctgtattttcattttcattaaattcaaaatattttgtaatttctcatgtgatttcttctttgatctgtgggttagtttataagtgtgttgcttaatttctaaatatcttaggattttccaggtttctgttattgatttgtagtttaattccattgtggttagaaaacaaactttgtacaatttcaatccccttatgtgcacattaatagtcaaggggattcttctgccaaattctggagtatgcacgctctcacgcgcacgcgtgcgcacacacgctctctttcccactctctctctgcagctcttttctgtttgtactctgatctgcaaattgcagccaccttggcctccccaatcctaatctctgcctcttcaactccgtgagactgcaaagctctctttggtttcccccaccatgtgctgaggcctggaaatggtctacaggctgtaaaatggtatcattttagggcttactttgtttacctctctctcaagggtcatagtcctgtgctgtctattgtccagtgtctgaaaagcattgtctcatcgattttgtccagtttttagttgtccaaggcaaggagggtgagtcccatccttgatactctattgtggccagaagcctgcatcatcttaccgtgtaattgcctgtatctatttcagtctttctactggttctttccatcagcttttcaacatgctcaagtctctcctctattgcaaagaatatagaagaaaaccaagctcatgtcgtctttatttaccaacctatctctcctctaccttttacagccaaactttttgaaagttatctctatccttgctactcaaaaatattgtttgtggactgatagcatctttgtcatctaataactcattagaaatgtaacatctcaggccccatcctagaactactgaatcagaatctgaattttagtccaggtgcggtgattcatgcctgtaatctcagcactttagaggccgaggcgggcggatcatgaggtcgggagttcaagaccagcctggccaatatggtgaaaccccatctctactaaaaatacaaaaattagctgggcgtggtggcacatgcctgtagtcacagctattcgggaggctgaggcagaagaatcgcttgaacccgggaggcagaggttgcagtgagccgagatcacgccactgcactcctgcctgggctatagagcaagattccgtctcaaaaaaaaaaatttaataaggtttaacaaggtaattagaatatacactataatttgagaacactgtctacattttccttcttcactttccatcttgttccttagtgtgttgtagtctgtcatctgtttataggactacattagagctgttcttgcctggatcatcagtgactttctcaatgtatatctaatgaatgggggtctctctatctaatgaatggctgtgttttactctcagcagttcatcttcctttctgatatattcctttggcttttgggatgccctgttctcttgtcctctgacctctgtggccttttcaggcttttctttctctgcctgtctcttaaatgttggtgttctacagaatttggtccccagctttcttcagattttacatttctctgcctgtctcatcttttcctgtaactccagtttcaacatgtattcttcattctgaatctctcctgagttccaggattatatgtcctccacataagcaccttaaactctccatgttactgtggacacatgatctccttcatcatgtcctcctcctcagtgactggcaccatttagccatcgtccaagctagaaacttgtcattcatcttcaactactccatcaccctttcccctcctttactcaccttactttcgcatttattcagtcttaagacgtattgattccactctaaaaattcatcatgtctgccatttttttttctgtcactattgctgctttcctaaacaggacttcagtaggtttcaactgagattaccacagtggcttcccaactggtttccctatctccaatcttgttccctttaaactaatctccatttggcagtaagaatgatccttttaatattaagtaaatgtgatctttacttaccatcttaaagcccttcaagacccttaccaactcttcttaacttccaaacttattagcttaatgtatgaaatcgtcactatctggtcactgccttcccagttgtgaatttctttgagtactttgccacttccactgccagcttgtttccaggcctttgtacctactgttcctttgacagagtgtcttctgctcttcactggctggctcctgaggtttcatgtcattttgcaggaatgtcctccttgactgtctaggccggttagattctcttcatgtacgtatgtactttgtacatatcctgtcatggctcctatcacactgttctgtggttgtgtttgtggctgtgatcatatcattgtatatgtcctccactataagcactcttaagggcagatagtaagtgtcttgttcccttaacctaggtgcttagcatgtggcacccactctacaccaggcagggttcctgctctcattgagctaatagtgtattgtggggatggaggtgggttagggtgcaagaaacaaaagcaacaaaagaaaaataattttattcttatacatgatagatccttagtaatatttttgaaagaatgtgtaaattattattattgttttgagatggggtctcactctgtagtccaggctggaacgcagtggcatgatcatggctcactatgtcctttatctcctgggctcaagcagtcctctcaccacagcctcccaagtagctgggactacaggcacatgccactgtgccaggttaatttttttaaatgtattttttgtagagatggaggtctcactgttttgctcaggctggtctcaaactcctaggctcaagcgatcatcttgccttggcttcccaaagtgctgggattacaggtgtgagccactgcgactggccaaattattattttaaagagcccttcaagtgcagaaatcttgaatgttactgacattactgacttaagttcttgaaagttcagctttctaaactgaaagctaagttcagctatctaaaaatgtaatatacctttctggacctagtgttctgtggtaattaggttattgttcaaacccttcaaatctaattcttagtttttttgttttcttatgtagtttccctgaacagaactgtggtaatcaaggactagtggaggtgtactttagaaatagcagtgagaattaatggttagctttgaaaatagaaaagtaaaataataggtgttctatggtataattgttttttattaagaaaggatatgttttattcattgtattttataaagttcaagccattgatgctaaaattagaaaaagtttgtcatcaaatagctaaaatattgatttgatagccaacagatgaagttacttgaaataagctatattagtctattctcacactgctataaggaactacctgagactgggtaatttatgaagaaaagaggtgtaattgattcacagtcctgcaggctgtgcaggaagcatggctggggaggcctcacaaaacttacagtaatggtggtggaaggtgaaggtggagcagggcacatcttcacatggagaagtaggagagagagtggaggggaaggtgccacacacttttaaacaaccaggtctcatgtatcaccagaacagcaaggggaaatgcgccccatgatccaatcacctgccaccaggcctcacctccaacactggagattataattcaacatgagatttgggcagggacacagacccaaactgtatcataggcagaatatttagagcacctcttgaaaaatgtggtcactttattaattttgaactctatatgaaaatattttattaaatttcttgaaaaatcttatctactcagtatcagtgaagtgttttcattataagcatcagaaacattaactaacttaagtacaaagggcatttgttaggatgatatggggttgcttaaaggataaacagaaaagataaagaaccaaacaaatgtccactgtttcagttgggccagaggaattacttttctgcgaatgattacttttctgggcagggcattggatttcttgagtctatacgcctaagagtgcctgctgcgtgttgtgtagtttctggtttattgtaattgcttagacaacaacccaatgcagtgttttctcttgatgtcttaatattgtaaaagtatctaggaataaggacattttcctaaataacagtatcattaatcacatctaagaaaattaaaattaactcagtaatgctgtctaatatactcagcatttaaagtcatctggatattctccaaatgttttttgttgcccaggatccagtaaggtttcactcattgcatttgcttgtttctcattagtctcattagttcatgtaggacagtcttcttattgcctttgttttttatgacattcactttattttacttgaagagtccagggtagttgtcttgtagaatgtctcacattttggatttgtgtaattattttttcatgcttagatttaggttagacactttgggcaagaatactacatgctgcttattgcatctcatcaggatgtttatgaagccaggttgtcccactactgttaataatgaatttgatcatttagttaagatggtatctgccaaatctgtccattgtgaaggtacatttccccctttgtaattaatgatttgtggatgacactcaaattgtgtgacttcttttttccagtggttttagcattcatcagtaatgaatcagttattactgaacttttaatgaaaagtttctaaaaagtttcctttctaaatagacatttctgattaggcactaaagagaaggtactggtagtcacttaaaaatccttccatttttactgtttagatgtcagaccagttgtattagacagctgggaaagagctttgctttgattcctcacaattattgtcatgattcgtattaatcttttaccttttccagaaataatacaatttttttattagagaacttgattattttaaaacacattaatgaagggtaacataggccagtgcagtgctgtacaatggaaatatagtacaagccaaatacataatttgaaatcttctagatagcacattagaaaagtaaaaaacaggttgaactaattttaataatatattttatttacatgaatatatccaaaatattttaacacgtaattagtataaaaattgttgatgaatattctacattctgtgtgtgtgcaataagtcttctaaatctggtgtgtattttatattacttaaaatcttaatttagatgagctacattaagttaccaataactacatgtcacacatcactgtccctattggatagtgcagatatggtggttacaatcttgggcacaaaggaaccagactaacttgattcagatcttgccttcttcaccagctggcatcatgactttgggcaaattcttcattctctttgtggtgtagttttcccattgtaaaatggggataataatagttcttactactagggatggggaattgaaataattaatgtaggaaaagcactgaatccatctctggcacatagtaaatgcttagtaaatgttaactcttatcattatgcctttagacttcgtccaataattcccattctgtcttagaagtgtccttgtattttgtaagggaagttaggactagatattggatcccttgacttctgttttatatcttgctggttttaccctcagtcccttgctttacaaactcttttgtagtgactttctaaaccaataagatgaaatagattttttaggagacttttaatttcaagcattctcgccccttgttaccataatttattgaaatgaatgggaaaacccagcacctctgcaaatggcagtgagtaaatgagagatttatcattatgattttttaaacccacaaaagattgagagctacaatatattgggttgctttttctttgtaatacaaatacatctctcccacagaagcctatgtaattgtagcagtaaggtaaaacagattcacatacaaaattaaggtgatctcgaagattgatgaagtgtagttgtatctagttcagagttatttaggatggcttccagatttgttgattacccagtcttatattaggtcataataactgcagaagatagagaagggagtattaaatgaagttttgcaaaggagatgtcctgtttaaaaataacttgatggtttactgtgatataacatttggtacctagaatactagtatcattgcccatcatagaaaaataaaacatcattaaacaaagaagtatcagttagttgaagcctttgtaagcattcactgaatcagcattcctaaagacggtgatgttgctaaaatgaaatggtggtagttgaatattacagtgtaaaacaatgccatcattcaggggattgaattgtacctccaagttaatttttacattatattatcattgcagccatattttcatcagtatagcaaaagtggaactgaaaaatactcatttcagaaatttaaaagactttgcaactgtattgggtgaatgtgcatcagtattgggtcttactcttaggagaatcttctggccaccagtattaaaaagtggcttataagatatttctaggctgagtgcagtggctcatgcctgcattcccagcactttgggaggctaaggcgggaggatgacttgaaaccaggagtttgagaccagcctgggcaacatagtgaggcccggtctgtaccaaaaagacaaacaacaacaacaaaacccaaaagctttcatgaacgttctgtaattaatgtgaaacaattcttatatatttctcatctagcagaatgaaaaatgaccaattcagatttcccccacttttgagctaaagtatagctaaatatgagctaaatattgctaagactgtttattattaatggacttttcctgagaattgttttggagaatttccaagtaactggttagaacattaatggtactgtttgcaggttatcacattgccccttgtcttcttgcacatcatgaagaaattatataaaatattaactttagttatttatggtactttaagaagttacataaaacatttttacaaaggacagacttcaagtcatcttgagatcaaattttggagactaaggctgatcttagaaaaagcaatggagatttgatgttatccacagtcattaagtaccactaatacttaattccatcttggcccaggcacctttcctacctataggacactgaaaaaggataaaacaaaacaacaaacaaaaaccaaggtgcaaatagccatggcaagacgggtcattttaatactctctaatagtctagcctgctcatgggaagatagaccttagaaaagaggaaaaagcaaacaggtaattgctgtgaagattacacatagcgtagaaggatagaggactaggatctcttcagaaatagttgttagaaaaggcctctgtagaagggacagtttggttaaaacatgaaggaagaagctagccatgcgacagagagtgggtgcagggcaagtgttccaggcagaggggatggcacatgcggaggccccagcgtgagaaaggacatggcttgttcaagagactgaataatgtggcttattcacagcccattgagagaagtgagaggaagtgtgataggagattaggttggagagaggcaggaaccagatcctgtaggcaggccatggtaatgaatttgggttttattttagctgtactggggagttctttaaagattagggaagaaagatgatcaaacttggttttaagatcacttaatattattttacacataacagttgtcaaaatatgcgtagaagtacagtccatattattttatacataacaatttctaaaatgtgattgtgaaaactaaggtcctagactgttagcgattttgggggagatattataggtttttgaactgtgaatagttaactatttattgaggacgtgttatctgccaagcagtgaggaattttatacaaattctctctcatcttcacagaaatttccttgaaaggaggcataatttttcctgtttgatgggggagaaaatgttagatacagagagaaattaagcaactagcacacaagggctaggattcaaaaatatgtctgccttactttactgtcccatagctttttttagtgtctttttgcagggaggaagatggaggggagaagaacaaggctgaaaattgaagaaaaggaaagcactcttataaatttttgtggaataaaggaatttagatttttttttttatttgggggagtggttgggaaggtagtggctgtaaattagaacagtgtatcaaggtacattaccctatagaaattgaatcaccctagaatttccctataggacattatgatcctgaacaagaattttagatctagctttgattagacattgacatccagtgtttttatggtatagttgtatgccgtgaagttttaaaagcatatatgtttatcagacaattaaaatgatctgtataatattaacaattaattgcatgttttccccaggagaggggttctgtaaagttgaaatatagggaagatgatgtgtctgaggtagatcagtctttggagaaatcagctgtgcagggcagagagagactgaactctggaaccaggagcactaactgttacgtagcaaagcagggtggaaaatgtttgttaacgcttaagtgttgcctgctcttagttaataacatgaatgttgttgagatctttgaatgttaaattattttaattttctaattttctaaggtagttgagaatttgaagcaagatagtctgaaccgcatagtgatagtggacactaaagaatcaagatggatgaaatgtaggatttggagactgacgagaagggatgggatggttgaaagaaacattaacaagtagtaaaaaaagaaaaataggaagtcctttgacagtagtgtcttagcttatgataataaagtgatacttttcttacaatgaacattatacagaatgcttgcatttgtaggtatataaaaatgctacttatccttctgccctgagtttctgctactactaaactttgaacctcttttggcaataagacaggtttcattttacttctgcaagtattcagataccatatgttaatgttttactctgggtacaataaagtttagaattattactggtcacacacaattaagacatgcaccgagggatatgatttgttgatgttgttgggagttacaacagaaaggagttccctgtggatattttctttctgtaagatggaattctatcaagaagtgtgaagtattctatcagaatgtgaggaatagtctatcaagaagtgagagctattccattaagacgtgagaaatttgaagagacttgggaatgtagaagatattagataggatcattaaacctatttcaaaatggaatccagtgactctggccatactaaaccaaaattaagcaaatataattggctgggagtcaggtccctggggagaagtataagccagtttttatacaaagtcagctaaggagtgagtgtttgataacccttttattgtaacaaaaagtgggtaaagaaaatgatgatagatcttttagaaaataatctcctgttccaagcaaaggattgttctccaccaccaccaacaaaatttttgttactgaaaaaaaagataagaagaatgtgtatgcaattgttcatatatatacatatataaaagtagcaaacagaaatacacggagtaaaaagtgttctccctgtacgctctctgctctcttttggcagctcaaacccactactctccccagggagaaaacaatgttaactgttcagtgtttgttattctagtcttttccctttgtatttgcatttaaatatgggcacacaagcatctgtacatgtgtacatattttaatatcagaagagtcatactcgacatattttgaacgtacattttttattatttatgtatcttgacaatcttttaatctcagcatacaaatgtaccccagacttttcataatgttcctctcctgtgcagacgatatgtgtgtatgaatttatgaatgaagatggctatatttctgcttaagtaatactatttttatgtaaaatatttagacaataccaaaggtgaaagaaaaaattaaaaatcaactgaaatccttgagataatccttattttggcgaccatttaaaaaatgtttttctttagctatttacacgagtgtgaacatacatcacacctgccacatataaaggtataatatttatttatttatttatttagagacaaggttttctttggtcatccagactaggtctccctcagtcacccagactggagtgtagtggtgtaatcttggctcactgcatcctcttcctcccgtgctccagtgatcctcccacctcagcctcccaagtagctgggactactggtacaggtcaccactcctggctaatttttgtcttgttttgttttgttttttggtagagatggggtttagacatgttgtccagactggtcttgaactcctgggctcaagcaatccgcctgccttggctccccaaagtgctgggattacaagggtgagccacagcacccagccaatgtagtatttataagtggattatacatacaagatgatttttgtcatggaactattttatctgcttggggatttttatctttcctctactccctttctcctatctttcctctcccagtaaccagtagtaacaacctggtgtacatttttcctacctttctcaatgcccatataatcatatacatatgaaattatataatttacactcatcttcattattcatttttcacagaactgattctacatcaactgaaatgtagcccactcattttttttttgctggataatattctaaggcaaggatcagcaaactgcaataaacggatcaaatccatccagccacctatttgtataaataaagttttgttggaacatagcttcacccatttttgtattgagcagtttaaccttttaaattctttacctgttatatgtgacacaattttccccccaatccattgtcttttgctttgttatggtattttgccataaaaaatttttttttaatgcaataaagtaaaacatgcctcttcttttctagcttttagtttcctattttgatttaaaaggctgcctaactccaggattatccttgtattttcctaaaatttcttctaaggtttttatcacttgcattttttataggcctggaatacatttttatgtctatattgagtggcattgtagtataacgtagtataagatcacagataatgaacaaatagctaacaataatgtagtataagatcacagaccctggttctgtgatttactacctgttcgacctttgacaaggtccttaacatttatatgttgttttcctctctaaaatggggctgattcttgtacctgttttgtaagatgatagtgaagcttaaatgagtggttattatgtagaaaatatttcgaacattatctggtacatagaaacatgtgcttttactgttattacatggtgtgagtaggcatctcatttttttcccatatggataaccagttgtcctagtaacatttattgagtagttagttcatccttttcctcaatcgatttaaaatgtcatctctactacatgttaagtttccaaatatatatagctctgtttgggggctttatagcctgttatgtgtctttatcctctgctccagagccacagtggcttagttactatagctttatacatacttgtaactaacaagtggagtccctttactttgttttgcagaattactttggctcttactggctttttttttttgctcttccatatagttttgtaaacactcatcagaatttacaaaaactgtttgttattaagtcttagtgtggaaaggagtgatactaagtggccattattagaatggaacctgcagtctcttattaatactttaaccattggaagtttttagaagttatctggttatgtaatctaaagattagtgccatccaccatgctaggtgggtactgggaatatagcaaatgaaaactgtacaaagatagatcataagcctgcatttcccaaactataccctgagatacccaaaggaacctcagagaactcccagggtcatttcaaacttctagggaaacatggccacatctgttggacattatgcgaacttctagctcaaggtagttcacagtttcaacagctgattgtgccatcttcattttgtacctgtgatatctttgtgaagttgagcttttagtggttactgttttaaaaagcaagtactatgcaaaaatcagtgtggaacaggaaatgtgggtggcagtatttagttgcacagcatctaagttttagaagttgtgcagggccctgtaggtgaaaacatcccatagtaactaattgtggttattttaaaatgaaatatatatatatatttttcagtttgcatgtattattttttcaaaaaggtgttaatttgttgggacatagatactcattttgtttgaacctaactgttaaaagaaataggatggttagctatctcttttgacctatggaattcttgaaagaaattatagagaaaataagggtaccaggagccaagcaagtttgggaacctctctactttaacttaaagttattacaaatattcaaagattaagaacatttggagtgctctgtaggtagcgcatacaccatgcttgcttagaacaggcaaaactaacattgcctgggcacctgggacagacagcatttctgagcaaatgatatttaagctgagcttgaaggaagactgagaactgactgaaaaggagtggtggtgggaatagcttgtgtgaagaggcgggagcggtggggaactgactgggagagcaatgcaggggagctggaaataggcagaagctagatcaggtggtgactgacgtggcagtcgactaaaggagtttcttcaggtttctttgtaaaaggcaacggcaagcctttgaggggttttaagtgaagagaggatatcttaggtcactgccctcctactgagagaacaaaatacaaaacgatatacagaaatatttaagtaactttttgtaaaaattttgaagtgccttgattttgaaaggcatttgtaagctttcctttgagtgtaattcactcttactttttcaaacacatatactttttttcgttgttcaacctggctcaattttaaaaatgaaataaaaagcaagacagtgttaaactgcgaaacatttaaattgtaattttgggggtattttttcaaatggcaaaaattgtgttgtaattttgaaatagaatgtattttattatcagtaatacaatatttcagatttttaatttgtgtattttaaccaccaatctaacacatttatcttttaagtttctgagttaagtttggggggtataatagagatttaatagttacatagtaaagatataaaggtaatttctcttagtttagctatctttttatactttttatttatgtgtttattctactatgattccagtaaactaatgcaacataaacattttgatagtaataagaaactaattgcaggttactttttaaaaatttctaagcttattttcaggaattttaagacttgaaaaataaatttcatggtcattaaatgggcatagagacctgaaacactttttttttttgagacggagtctggctcttgccaggctatagtgcaatggtgtaatctcggctcactgcaacctccacctcccaggttcaagtgattttcccgcctcagcctcccaactagctgggactacaggcatgtgccaccatgcctggctaatttttgtatttttagtagagatggggtttcaccatgttggccaggctggtctcgaactgctgacctcatgatccacccaccttggcctcccaaagtgctgggattacaggcgtgagccaccgtgcccagccacctcttttctaatacctgcttgtggtgtttgggaaagtgtaattagtctgattagaattagaatttgtttatcattgaagtattggaaaacttttaaaacaattgaatgttatttcttttcctctgccagtgtgttttatatttctttagaggtgtttgttcattatataatatagaatttatgtcatccttaaattcataatgcaaataaattataaagaagtgtgtagatatattcgaaaaacagtcttagtttcatttgctggattgggtttctctgatttttcacatgaagaaagctgatgacaacttgagttgtttacaagggaattggtcagaagttttcttgaagaaaagtgataaagctttaagttggaaagctttccaacaggctgagagtataaggtttataacaaatatttttctttaaattttgttcttcccatgttcaaagaactgacagggacttagagaaagtaagctaattccttccgtgctctttacactaaaatgaattctagatgaagattaaatgtagaaaatcacaagagtaatagaacaaagcaaggctgaaattttttatgatcttgggataaaaaagacctaagtataactatgtttagttttatgtagcttaaaatttattcttataacaaatattataaagtcaaatggaaaaaagaatatttgtaaaatatgatagcagattgctttttaagtcagtcggatgaataaattctctagaaaatggacaaagtgtgtgtatagtaaatttatgaaaaaaatacaaataactgataaacataaaaagatacctcttaagaatcattttaattttctgcctcttttatgttcaacagagaatttcactttgaatgcagtaacttaaagtatttataaatctgattctagggtttgaaataaaacttttattagatactcatgtcatttaacaaggcttgtttatctcaggtagaaggtttttttttcccctaatgttcttctaaatggctcaaagtttggtttcctacttgaaagtaaatcttatttattagacatttgtagtgagatgactatatttatgtgtcacattcaaagaacaacagttaataatttttggacttgttagtaatatattttctgacaaataatagaagagagatttgcttaactttgttctttttctttatttttgtaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtaagttttaagtgatttttttttttgcattttcaaatatttataacatacatcttgataaaagcactgttctcttggagttttcttttaattagtagcaacaaatatactcatttaacagatatcaattgtgcatatactctgcgtatgggaccttgctgtagggcttgctcagtgccgtagagaataaactgtagcgtgtttccacttgtctgatggcttaatattgctatcagaagtactgagcagttcttttctccttttaaacttggaagtggcagaggaagtggtataggaaaattaaatcactttgacggccaacttctatcttacccagcataaccatttagtatggttttgtaaaacttgcagtaaagtcagaatcctggttccttgatgccttaaccaaggaaatgacattcaattggattaattgttttaaaatctacagagtgtatattaaggtggagagcagaaagttataaagagaggaactttccctccttttcagagtatccttatttgaagaatgatggaaagtgtaagaaaaattagggatcttgaagagtaagatgtggtttctaagtaagtcatgtctgttttgtagtagatactagcgttcctgagatagtgtttctttacttgagtaccagatgaaatagtttttgtgaagggtcatgttatacaaaaatgttatctttaagtcctgtatttactctcaccttggtgaaacgcccacgtgtgagacagaacctcagagacagtagtctcccatctcattcctactccaggattatggtttcccatctcatgctcactccagagtatatttgcttatacattcagagcataatggctggtttttttcctctttggggacaaatactcaaagttgaatttgggtgtgacaaagtttctgtaattattccataatcatagattgaggatggaaaaataaaagaagaaaaaaatgggtccttttgccaatttcccttttctttccttccttctctccctccttcccttctaccctcccttccttgcttccttctttcctctttttatttttcttccttttcttttctttcttctctctcccttaaaaaataatctatttgccaggctttctccaacatgtttcataaataaattagtataatgactgcctctacaacgtcacttaggtcagtgtctgtttataatttaagttcttaaatatctcttatctgggctttattcatgggctccttcctctcggctgtccccccatatactatcatcaaatccagtgaattctgcttagtaatttctctgtacttaatccactttctccttcccgaggctactcccagtcttccctcaccacagccttataagcatctgcctgctaccttattcttcccctcctccagtccagtctccaccctgtctagagtactctttctcacccttcagtgatcctccagtaacaccatcaaggtaacatctaactcttaaataacaggcctgttgattccttttatgagctgtcctccacttctccaaccttatttcttaacatttcaccctgcctctgtccccacccccgtcccctacatccaccatcaccctcaccacagttttaagcactggcagtactgttttgtttcctttcatttattctctgccttccagcctttgctcatggcatccccactgcctgttaattttatcctccaccttttcctcactttcttctcctctgctaagtttgtccattcttcctctttgataccttcaggaagcatttttttgacccagtatctaagcaagcagcaccgtagaaggtgatacattctgtgatgactgcatacagggttctgtaggaaagttatttaaaccactcttggccctaggtatcaggagtaaatagtgcccaagctaagggattaaataaaagttcttttaaatagttgcatggtatacattgtctagatatacatactgtgatttatttaaagatttctttattgatgaacaattaaatggattaaaattgttggatgttataggcaatactatagtgaactgccttctgcaaatctttatttctgtaaaacagattactggaattgggattgctggatcataggatacactgtgtgtgtgtgtgtgtgcgcgcaattaaaaggtactagtttgtcagttcctcaaaatgttaaccatagtgttaccatatgacctagcagttccacttgtaggtgtcctggggtagttatgggttatgcagagtgactgcaagtgagtacaagatttcttcccggaatgatgaaaaggttctgaaattagattatggtgatgattacacaactttgttcatatactaaaaaatattaaattatgtactttagatagtgaactttatggtatataaattacatctcaataaaacctaaaaaaattctgccaaattgccaatctaaaagacttagagttttttggttgcaagcagtagaaactgattgtagccaagtcaagcaagaagggaagtttttgaaagaacattaaataggtaactcatagaattaagtatgagaggtctttttctctgagctgtctcatttctccacaaccaaaatttctgtttttctgcctgggcagtatgctggctgtgagtattttgtgcccagaggtggggtaatagggtgttctaaatacagacattgttaatatcttcttgtcaactccgggtcttaactcccactctcctttttctcctgcagttctccagaggcagcaggacaaccggcttccttcttgggagcgcaggaagctgcagcgttccctgccttgttatgtcagttactagtcctccatctgctttccctactcagaaattttttgaaatctcttgtctgccaattctccatatgtttttgtgagcttacattttaaaaattattaattttcatgagacctcaggaggaagaattttttgactctttaaaaatacaactgagctgggcgcagtggcttacgcctataatcccagcactataggaggccaagacgggcggatcacctgaggtcaggagtttgagaccagcctgaccaacatggtgaaaccccatctctactaaaaatacaaaaattagccagtatggtggtgcccgcctgtaatcccagctacttgggaggctgaggcaggagaattgtttgaaccctggaggcagatgttgcagtgagccaagattgtgccactgcactccagcatgggtgacagagtgagactctgtctcataaaaaaaattaattaattaatttaatttaatttaatttaattaaaatagaaccatattttggttttattgattaagatttcctcctttccccaacttgatcaaattctgtgtttatctttgttaattcttatcttctgatattctggtttcttaaaagtagatttttggtcaaatctggggagctcaaggtaaaaaagcagattttttagataattttatctttatttttttccttcaaaaatccccttgaaataaaaaaaaaataagaaaaagaaaaagtttattgcagggctgtaaaacctgtgtgatttatgtttggactaattcaccatcataaaactagaaaacctgtaatcatttctcatgatttgtttgctcttccttaaagaaacatattgttttattctgagcatagcaatcactttttagatattataatagctagttaagtgtttatgcaatatactatatataaattatttattttaagtactttttttttttttaacaatcctgtgaggcctgttattctcattttacttgtgaagaaactgagtcttagggagtggttaaataacttgccaacttcagacacccatgaagtggtggtgttgggattcagattcagatatgtgacttgaaaactgatgctcttagctgctacatcctgtggcgtctatatttatgacgacatttttggttcacattttattttgagatcattttaaacgtagggagtaggtgcaagaatagaaccaagaaatctcatataccttcacctagattacctgattgttaacatcttatcgtatctgccttaaccccccaaaaatgcatacatccaaagacatattttttcggagccagtaagagtaaattgcagacaggttttcctgtaactgccacctaaatacctacgtgtatatttctttgaaacaaggacattctcctagataaccacagatgtccatcaaaattaggaaattaaccttaatacaatactactgtttaatttagatttcactgattatctcaataatgttctttatagtaaaaaccaaaagcagagtacccgcctgtcctcctcccacacatactcttatttctggcccaagattacatatttcacttggtggctgtgtcctttaaaactctttagatataacttggtttttccttgcctcattttgagtttgtttgatttctccctgaatagattcagattcctcatttttgggagaaataccacagaagtaatgctgtgttctcagtgcatcatgccaagaagcatgtgatattttgttctgttgctggtgatgttaacttttactacttaagatggtctgtgcagtgtttctccattgtaaagcttggtacttttgttagttaataatgagtattttgggaagagatactttgatactctgtaaatatactgttcctcatgacatttttgtttactagttttggtgtccattgaggattcatacgtgaatcagttattactatcaaatggtgatttttctagttccatcatttctataaggcaaagcttttccttttcttccacttatttgtttatatttgcatgaaccgacagattcttgtcttattcagtgggttataatgcatgttaataccattatcccagatttaatcagaggaagctcccttcagtctgacttctgtgcccttttgatatgtccacattgttctttggacagttttcttactttacgtcgtaagatgtaccaggttcatcttgtgctttctctccttctgcactcttagaattggccatttctccaagaaattatttagaaaaggtagagacaccatatgtaccattgctactgaagtaatatggatgctgcaccttctctgtggacagggctaggaaatatataggggtgtgtgtgtgtgtgtatatatatatatatatatatatatatatatacacattatatatattatatatatgtatagcaatgaataaagactagacaaaatgtgtacatgtttcacacatacttttatatttatatagatatcatatatatttttatatctatgattatataaaaccatgatgtttacactgatacctccattctagaccagtaccataggacttattctacccatctccttttcaatgtttataccttgcttctctaactgtgaggaatctgattccagttatccttaatgcatttacttatttgcccagtatccctgtatttagctaatttccatggactttcttctcaaccctggttctgccatatgttgtagccatgtgagctgacttgctcctggctcccaagacaaaattttaaagtaatatttaaataaattttatttcttctcttcctttattgtccaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccaggtattaactcattatcaggactgatggttttatgtttatgaatgggtaaacattgttctgttagaatttttaaaaataatgaatgttggccgggcgcagtggctcacacctgtaatcccagcactttgggaggttgaagcgggtggatcacctgagttccagcctggccaacatggcgaaaccccatctctactaaaaatacaaaaattagccagacatggtggcaggcgcttataactccagctactctggaggctgaggaaggagaattacttgaacccgggaggtggagggtgcagtgagctgagattgtgccattgcactccagcctgggcgatagagcaagactccatctcaaaaaaaaaaaaaagaggaatgttaatatgcggtatgacattttactgtcagcataggaagtctcagtttcttacagaagtgaaaagaagaaaatgtgccagaagatccactctttagggaatgcattattaaaaatttatcaagcaataaagtatattcactgtctaatggtattcttcttggtcaaaaaaatattagtgctgtgtcttttgtcaagccttctctccaacaataggatatttttattgttaggtcttttcacttgtgcaaatcagagacccatccaggctagttcgtataagggatgggttgggtggtaagtgttaacatggtggctctagagacaatggcaggcaagagtccttggatctttatactccccattttagtgtaaattcagctcctatttcagtctttcttctttttgtgtgtcttctcagttcctgccccttctggtgttcctcataatcaattttgtatatcttttctcactgtataacttctgcttactcataacttcctcccagttgtagctcatcatagcccctctagccttttggtgtttcatgactgtttaccttctgttctcactgctaggtgccccctccatatttctcatctcaaatttgagtttctgaatataattgaactatccctacattatttgggaagagttatatgtctattaaataggctcatttttaatctatggactggttcgcaaagcaggactgtgagctacaactcttgagggtgttcctaatagcccttcaactcataaatgtaggttctttttttgtcgttatccctcgtcattcctgtctcagtatattctcagcaaggacagtatcttttaaagtgtgcgtttgtgcgtgtgtgtgtgtgagcgcctgtgcacgcatatgcatatgtgtatgtgtcttgagacacggtcttgctctgtaacccgggctagagtgcagtggtgcgatcttggttcgctgcagccttgatctcctgggctcaagtgttcctcctacctcagcctacgagtagctgggacaaacggtacacaccaccacatctggctaatttttttgtattttttttagagatggattttgccatattgcccaagttggccttgaactcctgggctcaagtgattctcctaccttggcctcccaaagtgctgggcttataggtatgggccacagtggccagcgtgagatgtatattattagatcttgtcacacctttgctcaaaactccctaatggttttccatgtcattcagagttaaagttctgggctgtaaagatttataatcttaataccacttccttcctttctctcccctatcccatctcctactcttttctccctcactcgaagattgtgatcactttatgtttctagaacaatccagatatgctcttggccattttctctttctggaatcctctttcctcagatacctgcctgggtcactgtcttacctctctgctcaaatatcgctttatcagtgaagccttccttgaacactctgtttaaaacaacaatctttgatttccacccccagtgttttctccttctaccttcattttacttcagaacatattaccatctgacatgttctatcttacttgtctctctccctcattagtatgtaagctcaaccagagcagggaatttttgtctgctgccaaaaacactttctggcacatagaagccagtaatattggctatgaatttgtttaattgattctatcaaaattcaattaaatatacctaagtaattcaagttgaattaaaaaaaagaactattgccatataccaatattattcagtctgcttgctcacttgcttttacatgacagaggtaatacttctcaacacctagggtagcatttaagcaaatcctcaaaatctgaatccaagaaaacaagatttgtagtgtcaaaaggtgagatcactactcaacatctgaaacgaaaacataatgtggaatgttttgcttacttaagtaagggagagttgtgcttgtcaaacatagttttcttgagcaaagctaagtccttatctcctatagagtttttcagaagacattgttttgggttgtactggttaagagacagaggtggattaatgtcagtcatagaaatatgttttgtggttgattacggaggtgggagcaagttaatgtcagccttaaaagtcagtgactccaccattagttggctgacttttaaagcctgggcttatcactgattggctttcaaagccacattcacccttgtgagttgtcactaatcgattaggcaatgtttccttgttaccatggctacaagactgtcattaattggttagacaagtttaaagctagtcctggaggttgttatcatggctgtagaacatcttttccaaagcatatgggcacaagagtcacatctcttctgcctgagacctttttgtcaaaactcaatattaagttaatattaccttattgaggagagaactctgtcttctgcccacaagagtgtggccttttcatgtattcacaagaggacaactctataaagtgaacacacattaattctaatgtctgaataagaaatacaaaaatatagtggtagctagattgttgctcagttacaaaatcaagggactgacagactgagcaagttaaagagacgaaactcagaaagcttttcagaaataacacacagatacagggaaggaaaggaaacctcttatccctgtgagtaaggagaatgccatgggtcctgagcttgctcagtctccactgtttgtacacatggcttttatcttatctttcaatgtgaatgggattcatgtcaaatatctctcgattgattgacaagtacgtaccctgaaggcaggagcaataagttatacatccttaagacccctaaagagcctagcacaatgctttgcacatagaatttatttgagaagtgtttgctaatttgaatggaaatttttgtatcacttttgcttaaaatattttgtcatataaagccacacagactgaataagaaccagtcattcctcaagattaaagcagtaaagtgctttgtcgtgtgtgtatgtggtaatgatggggtcttgctatattgcctacgctggtctcaaactcctgggctcaagcagtcctccctcctcggcctcccaaagtatcgggattatgggtgtgagccaccatgtccagcctgttttgtcctttaattattgtctttgttaattttttttttttttagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaaggtaagtgttgtctgcctaaaagccttcttcagccttagcttgagactttgtcatatcccatttgggactattgactaatttaaaaagattatcaactttatttaaacacatcataatgctcatatgtcatccttcaaatatgttcatatgatatatatgatgaggatatttaaagaaaaagatactttcaaaatattaagagataattattccctttgttcctgttgaagccgcagtgtactcagcttaagtcttcaggattttcttccctaaattgttgcaagagctttggtcctgagtagcctgagtcttctcacacattctcatatgcatttttttgatagtagtttttccactgcacaatcagtatgagaaactgggctggccacagtggctcacacctgtaatcccagcacttcgggacgctgaggtgggcagatcacgaggtcaggagatcgagaccatcctggctaacacggtgaaaccccgtctctactaaaaatacaaaaaattagctgggcgttgtggcatgtgcctgtagtcccagctactcgggaggctgaggcagaagaatcgctttaacccaggaggcgaaggttgcagtgacctgagatcgcgtcactgcactctagcctgggcgagagacctagacgccgtctcaaaaaaaaaaaaaagaaactgtattcctcatcctgttgtttttgccttttgaatcctatcagaaatcacaaattcttcatctttcacaaaataccaaccactttactgtccttcctatctcctctcattacttccttatgcagtgggtgcttttcttaggtgtgttctcataagagatgtggggtggtggtaggtaggtatgtttttgcttccaaaataatgctgtcttgtgcactgtaggatgtttactggcatccctgccttctacccataggtggcagtagcacttccgcattgtgacaaccaaaaatgtccctggatactgtgagatggtccttgggaagcaaaattgcccccagttgaggaccattgttctacagcagtgctgttcaattgaaatataatgcaagccacacatgtaatttaaaaatgtcttacagccacgtttttaaaaagtaagaagtacatgtacaataataaatataatagtaatattttatgtgatgtaccagttaatgtgaaatgtagttctaccaaaagaataaagtttatgtttagtgggaaacattttaacacagctttagcttgtacatttattttaaaatttcagaaattcagttctgcagtcatacaggccacatttcaggtagccacatgtgactagtggctattgacttggacagggcagatctagagtttcccagttgcaaaatcaaaagtgaacagacaattttaatttttatagttcagtatccaagacgtagaaacaggtatctatctagttatctgggtgatcagccttcagtgatcactggggaagatggaatacaatcagattgttccccacgtgctccattagcaaaacatggcatcctccccaatatcacctgatttctttctcatcatccatccactcaccaacttcctgtcttcacattttgcttcctccctgtctttccactcctctttccagctaaatattacataagcaaagaatttataagacttcatttttttttttttttgccaactgaaacatagggaaccttaaaatagtgataaaaatgtgaagttcttacagtagaaattttaattggctacaagttagaacaaaatctttatcaggagtaggaaggctgaaatatattattttaaaacatattttgtcatgaagggacattctgaagatataaaacttatatataatgattttttatgtcagaaataaatgtgaggctttctatgattctcatttgttcaataattactcaacaaatatttaccaaatgctggctatgtcatgcatgttctaggtgctgggaatagagtagtgaaccaaatggagttcttgatcttacagagctcatagtctagtgggaaagagtcagataataagtaaaaatttaaaaatgtcagtttatggtaagtgctatgaagaaaagacaaattatatcaggagtgtcaagagaaatagaggtaagattgctattttatacaacgtgttagataattgttcttttagtagaatgattctcagactggggtctgagtgggccagggtatgcacatcatgatagaaaagtttcatatcttcctgaaacatccaattttattcaaagatatccttgggagcagatgatttttaactaaatcaaatgtgaatatattatggttaataacactgctctgaattttaaggataaagcagtagactttaagattgagttaacttatttctgcctgtagttctctaggctcctgaatactcagattaggtggctgaaaagtctgagaagcactgccttggtatgtcactgtctcaagaagcttcagaagaaaataagagcaggacagtgttggtggtgttcacattggtctttccagactctagcacagtgcttggcccataactggggaggggaagtggtggccaatatatttagcttgaataacccaaagtaatgttggaaaatataagtgaatggagcacaggagtgcttttggttggatgtatgtaattacccaaaatatctttgtttctgctagagccttatgagatatgtagataggcctcagctaataaattatttagacccaaaattagaaagaggcttagaagttgaaagaaaaaagtggctagaaattcagatagtgttaggctggatctagtaaaaaaaaaagatcttaaataactaaacatccttctttattactcatcttaagacttctttgaaagtgaacttaagaacatttccatggcttttataaatgtccaaaaattgatctatatatttaacctttgatcaaatttgttcagatttacaataatcatcgctaatgaaagaggggggtggaaatggatcccattcactaagtagttttattttaaagggagagaatctggaaaatataaatgctagtgttcaaggtgattgacagaaaaatgtaatttagtagtcaaataatgttatcttttaatggaatgatagatctgaaccccactgcaagggaacaggttaaaatgcttgatattattacaattgacagtagtagaaaaataagattatttaaaaagtaaatggaagacttccacttctgggaaaattgagtagatatatttttccctattccttttgctaaatacacctaaaaaccctggatgttacatgtgaaacaaacataagaagactctgaaaggtagagagagaaagactgagattgagtagctagggagcttgagacccaaggaacagcataattgttagttcttttttttctttcttgagacagagtctcgctctgttacccaggctggagtgtggtggcgtgatctcagttcactgcagcctccgcctcccaggatcaaatgagtagctgggattataggcatgtgtcaccactgccagctaatttttgtatttttcatagagacggggtttcaccatgttggccaggctggtctcaaactcctggcctcaagtgatccaccaatcttggcctcccaaaatgctgggattacagatgtgcgttactgtgcccagccaacttggtggttagttctgtgggctcagtttcccgccccccccgccgcataagaccctttcaggaacctgggctgtgttttgcctcatatatcccagacttggagctaaagaagctagcaacctggaaatcctactaggcacaaacaaaaaaagcctcaacagaaggtgctctctagccaaaggggcaggaaaagagcatctcagcaagacaaaagctgttagactgtactttctcctactccagtcaaacaccgcagaagaaactgtggccccaccctaccatgccagtcaaagaccatgccaggagcctagacttccacccttcccaggttgtagtgaagcatctcagcctccttgctaagtggtgtcaaagttggagtagggagccaagacttttatcctagccaggcagtaatgaggcccctcccatgtaagtagagaacaaatggagagcctccactttcaccccatccagccataagaggcaacccttcccttcacactggggtggtatcaaaggaggcccagcggagagtcaaagctttaccatcatgtagtagcaaggctcgcttcatggtgtcaacaccatgtgaccatgtgggggaacaataatgagacaatcctaccccttctacccagggaggcatcagtggaggcctagtggggagctggaactcccaaccctgctaagaagcaatgaggaaacccctccccacttacatgttaatggaggctgagtgggaaacctgaactacccccacctgacagtaatgagacagcacccccccacacacacccactttctctgctagagtggtgttagaagaagagagctaaaacagaaggattaaataagatccagagtgtcataacatagtacctaaaatatccaggtttcagttgaatgtaatgcatcatgccaagaaccaggaaaatctcaactgaaaggagaaaagacagtgacagagattttagaattacctgacaaagattgtaaagcagtcatcatagcatcacttcagtgagcaattataaacacatttgaagcaaatgaaaaagtagaaatctcaacgaagaaagaggtctcctcagtgcaggtttgaaaaaatttacctctctttcaaataacaacaaatacaaaactaaattaaacagttttcttttttgcttttctcttcattcttaccaccctaaagaagttgtctttaacatctgttttcttctccgtttctttatctgatgtatctgcaagattttaccttctacatgtctttggaatccatccatgaaggcaccatgtgccttattctaagttacagtcggtgcagtggcctcctaattgttcttcctacttgtactctggcctcattccaaatacaccttcacactcctgccagagcagtcttttcaaagctcttattttaccacagcactctcaaccccctacccacttttaaaaatgtttaatggatttccgttgttcttaggttaaggacccaaattcttaaaatggttttcaaagccttatgcagtctggctccatcctcatcctcctctattttcttacactttgccacactgatttcttttagatccccaaaccactgtgatcctttctgccacaattaatttgcatgtgctagtctatctttctgaaatatttttcgcacctcattatttagttagcttctactcattcttcagatctcagcttaagggttactttgtcaggaaaatctctcctcatccctaatttcctggcaggttcttttgctataccattttgtagagttatcttctatgtctgtgtttcccacttgagatgcatgacagcactgattgtgtttttgctcagtgctatatccccagctgctacctgacacatatagacaaaccaattaatatttgttaaatgaatgagtaaatctctctccttaccttctttatccaactttttaagagtagtcaatacttttttgctttctttttgtccctattgttacggccataatcttttgctctttaattctggaccattgtaattatataatcaaacttctgctttagtgttttcccatcctttttttgtttcttcacgaagtctgagtgtgtcattactctgctcaaaagcctttccctaagacctgaaaccataaaaattctagaagataacattcaaaaaactcttctagacattggcttaggcaaagacttcatgaccctgaatgcaaaagcaaacacaagaaaaacaaagataaatagatgggacttaatttaaaaagcttccacacagcaaaagaaataatcagtagagtaaacagacaacccagagctcgggagaaaagcttcacaatctatacatctgacaaaggactaatatccagaagctagaaggaactcaaacaaatcagtgagaaaaacaagcaatcccatcaaaaagtgggctaaggacatgaatagacaattctcaaaagaagatatacaaatggccaacaaacatgaaaaaatgctcaacatcattaattatgagggaaatgcaaatcaaaaccgcagtgcaaaaccaccttcctcctgcaagaatggccataatcaaaaaatcaaaagtaatagatgttgatgtggatatggtgaaaagggaacacttttacactgctggtgggaatgtaagctagtacaaccactatggaaaacagtgtggagattccataaagaactaaaagtagatctatcattcgatccagcaatcccgttcctgtatctataatgaggaatagaagtcattatacaaaaaagataacttgcacatgcatgtttatagcagcacaatttgcaattgcaaaaatatggaaccagcccaaatgcccatcagttgatgagtgaataaagaaattgtggtatgtatatatatatatacgtatatatatatacacatactactcagcaataaaaaggaatgaaataacaccattcacagcaacctggattgaatgggagaccattattctaagtgaaataactcaggaatggaaaaccaaacatcctatgttctcactcataagtgggagctaagctatgaagatgcaaaggcataagaatggtacagtggactttggggacttggaggaaagggtgggaggcgggtgagggataaaaagctacatgttgggtgcagtgtacactgtttgggtgatgggtgcaccaaaatctgagaaatcaccactaaataactttttcatgtaaccaaacgcaacctgttccctaaaagcctattgaaataatttttttgaaagcctttccgcttggtcaaaaaataaaagttctccttagcactccaagcttttccagactgaccctaggctactcagggataccttatgcccagcaatactgaatttacttgagtccattggctgtatatattttttcacattgttttttttctttgcctgcatctttgaattttggagttctaaaggctcgatggtctttttactgtgagccatgaactaattgaatgaattaattctgccaagcaaatggacattatttctcccagcctttttttaaagggagtaaaatcaatcccgttaagaaagactgactgctatgctactggtactcacatatgccaaatatcaggcacatcaagtatcaacaatattttttagtgtaattattagatataaattactgtatctcgctttcaaaaatgacaactagtgtttcaaattatgttcatctcagctgggtatcatatgtatacattgctgatttctcatttgatgaacattaagttttttgtttctgaaacttagtagtaaattttatccaggtataaaatgtaggattttaatttttgtaaatttttcttattttgtgaggcaccaaagacccgtcttatctctccatttattttatcccagtcattcctgctctattccattatataatatcttacttctgtgtttcatcaggtaaacctgggatttaagggtgttattaagacatttctgataggaaggttgcttgataaaggttagtcatgaccttgcagggtcgtatttcttggagaagtcaccaaatctgattctggctttcagctttctgtgtccagaaacttaatcaagtttatcagattcaggaagactgattacctagactttacaatgtaatgaaatttaagccagactagcactttatttatttagaatgagaattataaatgtggccaagactgtatagtcatttcctctgattttttttttaatcctataaggaattcttttttttttttgagatggagtcttgctctgttgcccaagctggagtgcaatggcgtgatcttggcttactgcaacctccgcttcccgggttcaagcgattctcctgcctcagcctccgtgtagctgggattacaggcatgcaccaccacgcctggctaatttttgtatttttagtagagatggggtttctcctgtaatcccagcactttgggaggccggggcgggtggatcacctggggtcaggagtttgaggccagcctataaggaattctatatgaaaagccaaattataatcagaacgttttttaattgatccatggacacagactagaaatgtaacagtattaagatttggaagaaaagtccagcctgtgaaaaccagtttagatgtggaacttcaaaataaaaatgtatgtatacatttattattgtgtttggtactgtattttgaatttatgtcatctctgaaagtgacttttaaagtggcagctttaattaggtacttgtccctagaattaactgcatctcttgccctatgtcaggtacctttatatgtctgattttgttagtaactctccaaattaactaaacttgttcactttatacaaatttgatcagagtattgattgttcttcaatgttataggattattttcttttctctttaaatcggcttaaataactctgtagagttggccagtattcatcaacatcctggttgataatggcatgatggtgactgatttgtgcccagctaccacacccagggagctgctctctggcaaccattctctctttcttcccttcctcttttcctctctctcctagataagctaccatagggaaactttcagtaggcactgtgaccccatgacttactgtttcggatctaacattttgccctctttatgttttctttctgttattaatctcagtgtggcatagctgtggtggtgtaactaactctcagattgattccagacttcaaaattacataatttggaaaaaaactggccagaatagggagacagggatgggctgaaggaagtgaaattggttccaagagtgatacccctttggaaataactagaagtgtcagggataattcattgtaacatttgatttgcatttgtgatatttatgcatgtaaaatatgagcaaagcaaattggactaaattaaattctggtaattttatattagtcttggttcatctatagctatataaataataatactctttaagtgttttctctattttatgtggagagtttttcaggtattattttcctagtactgaaatgtatcttttttttttttttttttttaacacagctctgaaagattggtattgctggcaggtggtagcctggagatcagtgatgttactgaggatgatgctgggacttatttttgtatagctgataatggaaatgagacaattgaagctcaagcagagcttacagtgcaaggtatgtaaatatttactgtataatttaaaaatcctgtgtactttctgggtctgctaatttttaagaaatattaacatgggcgaggcaatacagcaaaacaattaaaagcataactcctagaccagactgcttgggtttaaattctaaatcttatatttcctagatatatgactataggaaacttatttaatttctctcaacctcattttcctcagctgtaaaatggaaataataagaatatttaccttattgggatgatttgagggttaaaagagctaatacttataaaacccctggaatagtgactaggatattgtgaaagctcaatgttagttattgttgttactatttgtagtggtggtggtggtggtggtggtgacaggaagggtatgatctggggcatctggaagattcacttttcttgtctcaggatgttttctgatgaagacgtctctgttctgtgaccccgaattatttctctcctctctgttggtgtccttttcttttgggtgaacagatcacccaggaaggagtacactgtgcctctcaatataacttggtttgatgatttggtgtttattttcctctcttcatacttctgataatcactgcaagggtagttgttcttcctttttctcctactcttcccttttccccttataggttctttgattcagacgtcagaaaataaagatggcatgactacatagtcttgtttttatccccatttcctgtgccattcctccatatggaaatgtaccctcaagtgctggctagaggtgactaaagtgaccaaaggtcacttttctacctcttcttcccaccccctcaaaactcccagattggtagctttcaacctaggaagactgctcccagtgctgtttctccctaagagttaggagtgctgtttcactcctaagaatgaaactctgaccgggactgttgcctgaggaatgccccacaaattggagtaaatcatagtggttctgaggttcctggggttctttgctcggggcctcagcctcctcttttcttaagttcaccatttagatacaattaagacctggcctttagtgctttcacaaacatatatattaccagagtggttggtacccttgatgcacgttagtttatagccaagctgaacacctgaataatacaattactctcagattggcaaccaagtgaataatgtatgctatctcatagataattactggaaaagactgaccaagaattaaaaataaccataaatatatttaaggagataagaaaaatatttgcaatatgatgcaaaaacaagaaaatataaacacagaaccaaatagaaatattaagaatgaaaaatatactaaaaataaagaataaagcaatctgcatgatagagaaaggtatcccatttttaaattttgttttattttgattttttttgagacagggtctccctctgttgcccagcctggagtgcagtggtgcagtctctgctcactgcagcctctccctctgtcacctaggctggagtgcagtggcacaatctctgctccctgcagcctcgacctcctgggttcaagcgatcatcctgcctcagccccacaagtagctgagactacaggcatgtgccaccaggcccagttaatttttgtatttttggtagagatggggtttcaccatgttgcccaggctggtctcgaactcctgggctcaagtgatccacccgcctcggcctcccaaagtgctgggattataggcatgagccactgtgcctagccagagaaaggtataacattgatgagcaaactcatgaattggaagattacattgaggaattctctgagaatgcagcattatatgataaagaaagataacacatggagtaaaatctaagagatacgataggtataggtagaaggactatctagataaataggtgtcttagaggagagaaaggaagagggaaatatttgaagaaataattaagataaatttttcagaattagacttgtagaacaccttagactaaaaggactagtagactgttaaataggtgaaagaaggaaaaacccaccttgaggcccatttacagtaacatacaataatgtataattatatatacagtaacgtataatatcaaagacaaaaaaattctaaaagcttccagtgacaaagagcagatcacctacaaaagaaaaagattggattgtacctaagtgttgatttgagaaatctggtatcgggaggacaatagcgtaatctttttaaggtgttaaaagatgttgaatacacacaatttatatgcatccaaaatgtgagacataataaaaattatcacacaagatctctgaaggtttgctgcacaaagatacgttgaaaacacttttggaataaatactcaataaaagatatacctgggaaatactgcaagagccttttaaaacaaagggggagttggccgggcgcggtggctcgcgcctgtaatcccagcactttgggaggccgaggcgggcggatcacgaggtcaggagatcgagatcatcccggctaaaacggtgaaaccccgtctctactaaaaatacaaaaaaattagccggcgtagtggcggccgcctgtagtcccagctacttgggaggctaaggcaggagaatggcgtgaacctgggaagccgagcttgcagtgagccgagatcccgccactgcactccagcctgggcgacagagcgagactccgtctcaaaaaaaaaaaaaaaacaaaaaaacaaaaaaacaaagggggagttttaaaacagctcccagattctttgactatccttctatagagtggtggggtttatgtccgttgctcttgaatctaggcaggcttggagctatttggatcaatagagtatggcagaagtcatatgtgacttccgaggcttataaaaagctgtgcattggttgtcatacttggagagaatttttttaaaaggaaaaaaagaaaaagcagtgcggatttttcctggctctctcgatgctaagaatatacaatggggaaagcatagtctcttcagtagatggtcctggaaaaactggatagccacatgtgggagaatgaaatcagatccttatctcatatatgtaaatcacatatacaccatacacaaaaatcaacccaaaatggattaaacacttaaacataagacctgaactgtaaaactactaaaagaaaagaggggaaaagcttattgacgttggtctttgcaaagaccaacgtttttttggatatgaccccagaaaacacaggcaacgaaagcaaaaatagataaattggattgcattgaactgagacgctcctgccagtaatggaaacaatcaacagtgaagagacaacctatggaatgggagaaaatatttgcaaaccaatgaaaacagaagaagaaaatgataacaagagcaaaaattaatgaaataaaaaaacaaacattcaaaacagagaatgtcagcaaagccaaaagttggttctttgtaatgcataacaatattgataaatccctgggaagacatacattacttgacagagatctttatctagacccggggttggcagagtacagcttgtgggctaaatcttcctgactgcttgtttttgtacagcttgtaagctaaaaatagtttatatatttttaaatagttgaaaaatatcagaagaataatattttgtgatacatgaaaactttatgagatttcaaaatttattgttcatgcagtcttactggcatactgccacactcattcatttatgtattgcctatggctgctttcatgccactacacaggagttgagtagttgtgacagagaccatatggctcacaaagcctaaaatatttactgtctggctctttacagaaaaagtttgccaatccctgatgtaggttttacaaagaactcctacagatcagtaagataaacaaagacagaaaccaatagaaaatgggcaaaagacttgaacatcgacctggaagaagatgtctagctagctattaatatttgaaaaagtggttgtcgttattagtcttcagagaaatgcaaataaaaaccatagtgggatatcactgtattccactataatggctaaagttgaaaagctcaacaaataccagacattggttaggatgaaaaccactggggactctaatgtactgttgacaggagtatacactgacacaatcactttaaaattctgcttggcagaatctattaaaaactgtacactggctaggcgcagtgactcatgcctgtaatcccagcactttgagaggctgaggcaggaggatcacttgaggccaggatttgaagaccagcctgggcagcatagtgagaccctatatctacaaaaaatgaaaaaattagctaggcatagtggcacacacctgtatttccagctactcaggagactgaagcaggaggattgcttgagctaaggaatttgaggttacagtgaactacgattgtgccgctgcattccagtctgggtgacaaagcaaaaccatctctaaaaaataaaaacttaaaaaaactgtacacagaaataccctatgatatagtagttgtattcctaggagtatacttaccagaaatgtataattatatgcccccaaaaccatgcacaataatgttcttactgggaataattcaaatctccatcaaaatacaaatgtagagtagtcttccagtcatacaatggcaaattatcagcaatgaatattgacagatcactgctacattcgacaatgtgggtaaatatcacaaacacccttgaagaagccagacacaaaagaatacctactatatatatgtaattacattgttatatataattccatttgtgtaaacttcaaaaacagacaaaactaatctatggttttagaagtcagaatactgattacttttggagaagggcagaatcgttaccgaatgttgcacagcccggcttctggtgtgtttatgttcagtttcttaatctgggtggtagttacaattcaagctgtattgttcatgtgtgccacatgagatcatctctttttttactgtttacagattataactcataatgtgcaaaaacatatttggaaaattttgttttgagccctgtcccataattgaaagcatttatttttcagatagggaaagcagattttgagaaatagttggagagatatatataaatacagtcatacctgtctgacttctgttatttttttaagaagttatagctataggaaatgccatagtgagtgttaatgtagaaaaggttgtaagttcatttttcatctgttaaatgtttcagatttattgtcttatcattaactcctggagtttctacacatgcagtgacgtgaattagcccatcatgtatttcctgtcatctcagattgttgataacacttaaaatgggtcatgagggttttttaaaacagaaacttttcctttttctcttcaaacagttacaacagtctgtgatacacatgtctcccgtgccaccaaaaagaaatttttccatttgtatttttgtggaacaaatggataaattctaaattggctacccctttgacattgtaaatacctataactaatctaccacttaagttttaaacctcactgtctttccttaagccacagcctatgtcactctacttctttgactcttctgctctactcttatccctggccacattaagacattgatctccccttttctctcagtctttgtgatttcacttccctttacttcatgatcagttacaatattctgctgtcattcattagaactcttagttctcttggcttcgggataaaaagcaaattccttatgtcatacatacagagtacatccagatccttcatagttggctttttcagcgttaactggagaggcaccacagaggagtgattgagagcaatcttgccccagtgcgcctggattccagtctcagctctgtctcttagctttgtgaacttggccaagttaattaatttacctatgtctttgtttcttttatcagttgaatgggttgttttaaggattaaactcttttttttttagaagagccagcataaagcacttttattgtaataataaaattggaaactcatatgtgatgttgtggggagaggggcaacaatttctgtcaccagttcactacacaggacatcaaaggagtgacaagggactgaagaaggaaaagccaggaaacgttgagatcagcagagagagtcaagtggcagaaaacaggagatgttgaagctgcgatgacaagcatcatttgcttaacattcaaggatttgtcatgatagctgggctttcattgggtggttaagtctacaaacaacacctttaatttatactttcaattaaagttcttaaaattaaggaagtggtggagcttggaaagttatgagattacaaaatttctgaaagtccattagaaaagccacaggatggggcagaggaaataagccaggccaccaagaaggcttcagaggtccccgctggcccagggacagatacctgtagcatccaacatcgcagtgaaaatgatctgctttcaaaaggcagaggatttcaggggagggtagagtggaactgatggaggcaaaggctccccatccccacctcagtttttggtagggcttttaatttaaccgaaggacatctttcaactttgagaataattcagccctcaagagtgcgtcagatctgctatggctttgcagcgcaacagcaagaatgtttagtatataatagattaaaatttcatccaaaaaaaatttaaaataaagattcttataacctccccccacaacactaaatcctgttctaaagttaaccagtcacttgttctgttaatatttgaccatagacttacttggaaactagatcgaaaagactgaagctgaatcatcaccccaaagtgaaaatgaaataaactgagtaacttaaggcttatggcatatagtttaagtaaaatgagaagaaagaggaagaggaaatggaggtgccagaagcaaagctgagtgacagaacgcattcagtcagggtagatgttatacaggttgtagtggatctacatgtggaaaagctccatatggatttatgtgcatgtgtctggaggcaccagatccttctgtggcagatgtaagaacaggaagccaagggaggaggccattcttgccatcccagtcttagaagctccatgttgaagacaagagtggcatgatgccctggtgcccagtggcactgaaagcatagtctagagatacattcagtttggctctgtgacccacattcatctgggcaacccctacctcccactcccgggtcaccttctgcttgcctagcacacacttaaagggctcatttctgtcctttgaagagtcaaatttctttccatcttaaagcatcccggcttccggaaggtatccaactcctggggagatgatctccaccttcgctcccaggacatcggcggatgccggtgggcaggcagtgtggactgagagggacctgtcagtggttcccaggctctgcctcatccctgctgtccatcatctgcacacatgggcacccccgcacgccccgtcctgcactaggagtaaattcttagcactttccccctaaatctggaatggagatggagtcctctttaccaaattagttttctgaacatactgtgctgtttgatagcagtgttcccctgtgtccccttacttccaactacaatttcctgatagaccctcaagattagtttacttgacccctctgtgaagcttttcttaaccatcccctcataattggtttcttaaaatagttctctttttaccagtagtatttcttactgatttgtttatatgtcctcttcaactcctactagactggagttcttatcaacaggaactggtcttactcatttttaaaaatcatagtaggttattaacgaatggaatgagtgaatgaaactttaaatggaaattgttaaatgtggcaccagaatgatttgatttgatttgatgtttgtggttactttactattcatgttttcctttgcactttgtttttcatagacttctaatgtaaaagaaatgggattaaaagaaaaatcttctgaaagttattctggaggaagatgaaccattacctctacttttatgattgaggtcataattgccaccttcacatgcatacatgtttacaaacaattcatcagttttattcattcccatttttgaccttttgataccttccataagccaacataatattaaaaaaaataactgaagccattaaaggtgaactttcctccacatggctgccatctctgctttaaaaactcttacacatttattactgtcatgattcaaagctaagtgcattgacgtctttaatcccaactccatgagatgctccactactttgacttgataccagtgtgtcatgctgtttctctttttatttctttgcccgttccttttgttttgccttcatgggcatcttttcttccacttgttgattaaactattagtgttccaccgagttctgttgtcagcctgctactcttcacactctacctgcttctggtttcaggtataatttacatacagtaatgcccagattcccagaccagaccccttgtcaagcttcagacatttgcaattggatgtcccacaggtacctcagaaatcgcatgtccaaaattgaacttaacattcttctctcaaaatatttttcttctttgattttctgtatcttgatagtgtcactgcctacctttttacctgtgctagaaacatgaaaatcattcttgattatttcaatctttttattttttttccacattcagttcattagattctctttctccttgctttcactcccctgattcaagtccaagtcatctcttacctatattactgcagtagtttcctaactgatttctctagttctaacctggtctctcctcaaatccattcttcacagagtggcaaaagtgattaaaattctttcattaaaaacttggaaaaatgattgcaatgatataaatggtgcttacaaattaataagaacaagattaatatctgttaaaaaaggggggaggtggaaaacatagtttgcttacagaaatgagatgaaaatggccagttgacctgaaaagagttcaaccccactaattgtataagaaatacagattaaagtagcccatttttgcgtactgattgaattttaaaataataacctactcttggcaaaattatatggggattctcatacactgctggtagtggtacaaattgatgtaaccttggagggcagtttggtaattttatcaaaagctttaaaactcacacattcattgaccagcagttccacatctgataatttgttttgatgaaataaggatgtgtgcaaagatttatgcatggaagtatgcatgcaatgatgtatatttagtggcaaaaattataaaccacttaaatgcccaaaaataggtgattggttaaataaaacagcctacctatgtatcagaatacaatgcttcctacaaaaatcatgttttagaagtttgttaaatggcaagagaaaatactttgggtatattaaatgacgaaaagtaagatcccaaagcaacatgtgagaagtatgatttgtgccacaaagttacattgtaaattgcatcagatccttgactttcttataaaaattagcctcacaccaattaggaagaagctttatgtatcttcctcttgaggccttctccctgtaattttcagaatactggatgtttacttatcttgaaaggatcatttttcttctaagctccaagcagagagagaactggattctgagtccattaatgagtgcatgattgtcattgcttctcaaggtaacttaatttcaagggcaaccactagctacttaaaaacaccatgcagttattttgcttgtactatcacttctgcctagaatgttcctccttccactcccttgcctggctttcctcagaaacctctgaaactctgactcctacctattcctatcccttgtacccttcttccattagctgtgcattaattatgcacatgtattttatacattatctgtcttgttttacgtatcacatttacattttccccccagtttttgtatccagtttctaccctactagactgagttctttgaggacaggactggatcttgtcaatctttagatccttagcacctaatgtagtagtgcctgatgctgtgtatttgaccacaacggattgcttaagaacatattctccgtacttctggataagatgtcagacagtaaattataatccattcttttatagtatgctatctgtattcagaatatttcagaatttcactttataaactttatatttttaaggtattactgtatgttagaaaagtctttacaattgctttataatcctttattggggccttaatcattttggattggtttgcagttcttcttagatttttattgcatcagtggtcatgttagctttgagataaattccacattttacaagcttgaaataatttcctaatagttatgtaaatttattctgaaccacagtagcctcatttccatggtaactaaccaccttcagaagagaactttcagatattctagaaaagaccagaaatatccatgtgaaataaaatgaactaatgatgtaaagttagaactcagatttatgtggagtacagatgcatgatattggaccctgaaaatgttgcagatagaagagccgttcaaagacctgaagattctgcctgtttgctgtttgtacatcaggcaaaatgcaacctaagaaaaactcagctgtattgtgatttttgttactaaaatgaccccaatgaggaagctttgtgggacaaataagcaaaattcatggtgcagaaatggatttgtggtgccactaagagattaacattgtgcttcacagaaggaatgtggtctcatgaaaggatatatggtttttggaagcatatccctgatttcgagcctctggcaatgtgatcttgggcaaattaatttatttacttgaacctcattcttcctatttgtaaagtagggataagagtccttctttgtggtggtgttgtgaggaatatccttgatacagtgcctggtacattataggcattcagtaaatgtacctcagctaatgttcccagggctcagagaatctttcctttgtaagactccttcacttgattctgttgtctttgatttcttttttgccttctaaaggattctgtttcctccttagattatttaaattgacatctcagataactttctgtttgcttttgttccatgccaccagccatccatcagatggcaccatgttttgtggtctttgagccaagccagtcacaccccattcctcatgcccagtctagcttcttaggctttctcacctaagtctgtgcttgctgggctcctgcctatctaggacaacatgacaaaatactagtaaatattcttcattctttatttaaagagcataacaattgataatacgaggacaaagtcatgtcccttccagcccagaagtaagtgaaaagatttgactatcattgttggcattactctgcttcttaggttatctgtcttgatctcagaatttcaagcattccttaataattagcccactctgggtctcttatttattaattttaactatcttttcttggatatatattcttttattgtatatattcagttttattggtggaatgtcttttttttttttttgagacaaaatctcactatgtcgcccaggctggagtgcagttgcgcgatctcggctcactgcatcctccacctcctgggttcaagtgattctcctgcctcagcctcctgagtagctgggattacaggcacccgccatcatgcccggctaatttttgtagttttgctagagacgggtttcaccatgttggccaggctgttcttgaattcctcacctcaagtgatccacccaccccggcctcccaaagtgctgggattacaggcatgagattatactgcacctggcaaatgtttttcatgtagtatttactaccttatttttattgaaccatatttcttctgccttaaaggggtatcatcaaatctacaagctttggttaagagaaccatgacaggaagaatcttagtaattttaattatattgtcagtaagcttcttgtattaaatatattgaatctcttaaacttcatttaagaaattcccattctcctcttcaattttagttaggttcccctttcttcattaaagagatgatagaattaggaacagcaggaaaagtggagcagttttataatttttttaaatgccccctttcttgctaaaaatcaaactaaagagctccaaagtgggcagtggaaagataatgtcctagtgaaaagaatatctaaaacaggtttcttcattttgtatttcttcccccgctacctatttctacccctaactgttaagggtgtattgatggcactttcatataaacccagtttacacacaggaatggggtcttaccccatcaggtccccacaggagcattttatatcagagcagcacagttaccctcagtttatctgaaagttacatgcattgaatggtgatttaaattctgagaataactgacaaaaagctaaatgaatctaaattattctactttttcccagtccctattgtaatgataaccaagatttctttggtcttttttggccagagaagtctcttaggttgaaatcatatcagtggttttcaaacttgtttttttttttttggccagggaactcaagcaaaatcataattggaagtgagatatttaaaatagataaacatggaactactcagatggaagcagggcagggtaggaatagttgccacacccagaccctccattccttgtttagatttttttcttgttgatgatttcaaatacagagttttgtccaggggccgtagctcatgcctgtaatctcagcactttgcaaggccgaggcgagtggatcacgaggtcaagagattgagaccatcctggccaacatggtgcaaccccgtctctaccaaaaatacaaaaattagctgggcgtggtggcaggtgactgtaatcccagctactcgagaggctgaggcaggagaatcgcttgaaccctggaggtggaggttgcagtgagccgagattgcgccattgcactccagcctggcgacagagtaagactcggtctaaaaaaaaaaaaaacagggtttcagtgaccatgttaaaagtaacagcaaagatacttttcaaacactatttattctgtatctactgcaaataggcagaaggcagaatccagtatcactggagatacaatgacatatagggcacattctcatcttcaaggatacagtaggtgatacagagaagtagttagacatttctgtcccaggatgataaaaactataagattacgtgtcaactatgtctttgagacttattcttgtccaggtgatttcagtgattcttgtgcagaaagtagaaggaaaaaaaagatacgatatttttaacagataaatttattctttgaattcttaacatcacattatgaattagaaatgatagtacatctaaacatttttaaaatatttaagaaatttttaaattactacataatatttgtacatatttgtgggatacatgtgatattttgatacatgcattcagtatttaatgataaaaatcaggatatttgggatttctatcatctcaaacattgatcatttccttttgttgggaacatttcaaatcttctagttattttgaaatatatagtatgttattgttaattatagtcaccttattgttgctatcaaacacagaaacttatttcttctatcaactgtaggtttgtacccatttaccaaccttcttcatcccctctcaccttgatctcttgcccagcacacacacctttcccagctcctggaacctgtgaaagatctaattcagtaatgatcacagacctaaatagtttgtagtttcaaagcagaatttacatggactgaatttgacttgtgaactttgaaatcctgagaaatgggtcagatggttgttctgtgccattttcaaaaccaaatcattttgtaagatcctgctgtctgccatcctttttaaatcatgttttacatagtatttttttaaaagaactatttttcagaatacagtgcttttctcctttttaaaaaatcttaatcatagtaatttcccaataagaaagcaaaggtggtaaagaatactttttcctaaggaaaaaatattttataattgttttcaacatttttttgtgttagacatttttcataataaaaagctgaaggaattttacagcaaatacccaccaccttcagtcttcagttgacattttactgtaatgctgtatcaaatatctatcattatattaatcaatctaaattttttgttacatttcagagtaagttgcagacatacccagatccttaagcattcatatcattagctaagctttaatattttgtttgcagtttttttctctttcgaggtaaaatttatatacagtgtaatgcacaaatcttagatgtgctgtttatgtgttccagcaaatacacattactatacaaccaaaacccatattaaaatataaaatattaccaccactgcagaaagtttccacattcctcttctcagtaaatcctctgcttactaccccagagggtctattcttttgttttttattccccactataaattagttttgtctgtcctaaagcttcttataaaagtaatcatgttgtctgtgtttgtttgtttaaggcttctttcacaaagcataacgtatttgaggtccatccatgttgctgcttgtattagaaacctgttcttctttgttaatgagtagtatttctgagtagtgtatgccaggccttttcccagagtggtcataccagttcacattcctaccaacagtgtatgtgagttctggttgctccacattctgacccacatttagtggtgtcagtcattttaactttagtcatcctggtaggtgtatagtagcatttctatatggttttaatatgcattttcctgatgagtagtgatgttgaatactttacgattgcatattggctgttctggcatcttcctttgtgaggtattttctaaacagtgttgatttcctgggtagatggtacatgttatagacatattaaaactaattcttaaagtgttctgtcaggaaactgtctacttattgatacctgaaaatagtggacaataaaaaaaattgatataatttcaagcctgttttacatgtctttagaaatagttgattttagctattatttatttgtgagtttgttctcacactgctatgaaggaatacccaagactcggtaatttatgaaggaaagaggtttaattgactcacagttctgcagggctagggaggcctcgggaaacttagaatcatagtggaaggggaagcaaacatgtccttcttcacatggtggcaggaaggagaagtgccaagcaaacccttataaaactatcagatctcgtgagaactcactatcatgagaacagcatggaagtaaccacccccatgattcagttacctcccacagggtctctcccacaacatgtggggattatggaaactgtaagtcaagatgagatttgggtggggacacagccaaaccatatcagcttctattttgattattttgggatttgaacattttctccatgtaaccatttgaaattctcttgaagaagcaaaagaacaatctcatgtgctgtgaaatacctgttatttataaatggattctaaatatttttggccacataaactactggttcagaatatctgtgcctttagtaaataattgaatttgcctattgtattagtcagggttatccaaagaaacagagccaataggaagcataagttttccatataaataaataaatacataaatacatgtatgtgtggtgttatgaaatatgtatacatatattggttttcatccccagttcctggcgcatatctcccatagcctttgttacagtcttctcttatgttgggtatgttaggcctcaggggcaggccttaggaaacagaatctctctgatcttctcctgccctcctttcacctgccccaaggctctaatcttccccagcctttctgatggtgggttttaggacccttcccaaagaggggcccacctcatatgctggaggaaagaatactgacatcatgaagctttcataaaaactcgggaggagtgggttcagagagcttctggatagctgaaaacatggacgctcctagagggtggtaccccagggaggacatggaagctctgcgcccctttctccctacctcaccctacacatttcctcattgtatcaatgtcctttatattaaaccagcaaatgttaagaaagtgtttctctgagttctgtgagccgctccagcaaattaattgaacccagagagggagtcctgggaacctccacttgaaacacattggtcagaggttctggaggactaggcttgtaaccggttgggggtgggaggaattctggggagtgagccctcatcatgtgcaatctaatgctgtctgcaggtagatagtgttggaattgaattggagaatacccagctggtgtccactgctaggtgtgtgggggggaaactcccacataatttggtcacagaagcgttcttctgtgttgatgattgtggtggtgtgagagtagaaaaaaaatgcagcttgagagggtgtttttgaaactgtgggtgtatgtttagagaaagagagaagagacttttattataaagtattggttcacgtgattatggaggctgagaagtcccatgttctgctgtttctggagacctgagaaagccagcagtatagtttgaaggcctgagagctggagagtcagtggtttaaattctgctgtgagtctgaaggcctgagaaccaggagtgctgagggtaggagaagatcagtgtcccaactggaacaggcagaaaacaatttcagcctttttgtttctcattggactggatgatgccaacacacattgagtgccatctgctgtaactcagtccacagatccaaatgcttttctcttctggaaacaccctcacagagaggcacagaaatagtgagtaaccagatatctaggcatgccatggcccagtcaagttgacacataaaatttactgtcacacatagtatactcgtcttcatctaattacaaatagtttaaaaatctaattacaaaatctaatcactgcattggcaaaacaccatttctccccaaaaccctggagaaatcttcccatgcttatgaggtgtaaattatttgtgaagcattggccctacctgaaatctgggtcaaagggaactacagatctagagcatatcacaccagtgtgttaaagtgaaaaaataatgtaagcaagttatattggcgaaagtcgttattgtcagccccttattctgggattgtaatggttgatttccaatgattacgtaatataattatactttaaatgtaaataatgctttatattattgagggtctaaagggatttaatagataaagtgcacgttacaatacctgacttacatctgatactgaacaaaatttagttctctcttgtaaaaccctatgtagaggtattgttattagtccactgactgataaagcttctgaaagcctccgaattatattttcctctttaaaccttatcaaaaatagttgttccattttaaaatactgcaagagttagggtagtagaattatgaggcattttgacttgccaagaaatttaattatagtagaaataatatcaagcaatttttattttatttccaaggtataatttatactgtgtcacatttacattatatggatatacctgacaaatttttaaaatatctttcatattaacaagaaagtattttcacatatattaggtcttatgtccttttaaggaaaattgatttccctaagattacaaaacacatttggaggcaaagcccagattaaaagctcaggacttctgattcctagtctagtattctttaaaaaaaaaaaaatttgtaatagttggtgtatatatttatcgggtacatgagatattttgacgctggcatacaatgcttaataatcacatcagggtaaatggagtatccatcacccaagcatttatcctttgtgttacaaacagtccagttattctctcttaattatttaaaaatgtacaataaattattgttgactgtagtcaccttgttttgccatcaaattctagatcttattaattctaattatatttttgtgctcattaaccattaccccccacccactacctttcccagcctctggtaaccatcattctactctctatctccatgagttcagttgttttcatttttagctcccacaaataagtgagaacatctgaagcatgtcttctgtgcctggcttatttcacttaacataacgacctccagttccattatctgatatgagcgtagctagtcctgctcactttcagtttctcttggtgtgaaatatctttttccacccttttactttcagtctatgtgtctttacaggtgagtttattgcaagcagcatatagttgaatgaagtttttaaaattcattccaccaatctatatcttttaagtggagctcttaatccatttacgttcagcattaacattgatatgtgaggttttgatcctgttacattgtgaattgttttctagttgttttataaatttgttgtttcttcttctgtcttttggcttgatggaattctgttgtgttgccatttgattcctttctttttctttttttgtgagtttgttttataaagtctttgtgtttttttttttaacttgtgttgtcatggtggtgaatgtcaacctttcattaccacatttaggtctcctttgagcatttcttatagggctggtttggtggtgataaattttctcagggaaagactttttctgggaaagaatttctccatttatgaatcttaatcttgctggatataaaattcttggctgatgtttggtggtggtggtggtgatactgatggtggtggtggtggttttccttactgcactttgaaaatgccagctcattctcttctggcttataaggattctgctgagaagtcaactgttagtctgatggggttttctttataggtaactagatgctttttttcttgctaattttaaaattctttcttttactttgactttagacagtctgattataatatgctgtggtgcatattccaagtcctttttggaatatattttcctcaggatctctaggcctcctctatgtgaatgtctaactctcttgctagacttgggaagttttcatcagttgtttccttaaataggttttctaaactttctgatttttctttcccctcaggaatacccgtaattcacaagtccagtcactttatgtagtcacaaacatcttgaagtctttgttcttttttattctttttaagtttttgtctgactggattatttcaaaagacctgccttaaagttctgagattctttcttctgttcaggcttgtctattgttgaagctttcaaatgtattttgtaattccttcaatgaattgttcagttctagaatttgtttgaagatatctatctcgataaatttctcattggtatcctaaatagatgttctgacttcttggtactggttttcagatttctcttgcaatctcattgagcttctttaaaatcagtatttttaattctttatctagaagttcaaggatttatttttggttaggacctattgcgggagaattattgtgttcctttgaatgtgtcataatatgttgctttttcatacttcctatatctttacattggtttctgtgcatctggagtaacagtcactacttcttatttttgaatttgctttcattgagtggggagactttttattgaagatatgtctataatgttgattggatagggcgttttggctttccttctgggtatgcgcagtggctttaaggattctgtgtgatttccttggctacagatagccttagtgttaaatctgtggatttttctgtgtgttagtgtgcagttattggtggagtctgtgatgaggttttgctggagactggaatgcctcatgggtccttcagtggtagtggtggtgggctaagtatgtctatcattgtgacctggtatgtggtatatgctggcacccatgttggtagttccaggtaggctgattctttggccactgggtggctctctcaaatgcctgttgtagtagaggtagaccatgcaggtgagcagactcttgacctactgggaagccagggtggtatgggcaatgggaatagcagtagtagtgagaagctcttctcattcacaagtgttgtgcccttgttttatcagttgttgcaatgggctgtgcatgtcagcctccaggccagtaggtggcacttgcaggtaatagccagctatattgtcaacagtaggttttatgcctaacctctgtttctgaggacaagtgcttgcacaggtgtcccagatggtggattgagttgcagaattctcaggaacctggatccccctaacctccacttccctctgcggagtaggggccaagctgagtggagctggagcaggcaagcttgtactcaggcctcccaatggtgggtgcatctaccttccttgacgggggtggcagggcagttctcaggcccctggtgaaattcttgggtgagggatgactgttgctatgccgaagtcttaacatgggtatggaggggcagtcccagcagccacagatgtggcttgtgtaagtaggacttacttccttctcatgccccagtcctggcagagttccctcccactcctaactgtggcagcagatcagcctgttcagtcatggcagtgttctgcaactcagtccagggccttaggagatacaacccagcttaatcccaagcctccatggcagctctcctcctgctcaggtcccaagcaggtagggggataccccagtttcagtatcagctgcccataccagtttctcagttctggttgcaggagtccagactcttgcttgagtcccagttcttcaagccccagcccgaatttctgacaccaaagcctggcactgccacttgttcccaggaccatccacagcttgttaagagctgggattgagaatggcctcttactgtagctgcctatatctgatggaatgtatgggacgtccctggagcagttccttgtccagtcactccccaggtgagatccaggattcaggagggtcaaggtgctctcctacagcctggattgtacaattcccctgtggaaacatggactgcagaaatacactcactcaccctctcccctactggggatacattcctgattttcagccagtcctggccacacgggttacctgttttccttcttctcagatgttgaagtttccttttgcttttctcttgaactcccatgctccctcttggataatatatttaaagtgtgattgtctacacacaatttttgttcttctaagtggatgagatatgctggaaatgcttctactcagccatcttggagagaaacttgaaatttctgaagttctgtagatcttatcctaactctgttttattgaaaactttaacaattcctacatcaatactaatactgtttcccttgttgatattttgttggaaggatcccttctcattgttcttttaaaaaaaaaattgtttttgaccaaatgtggtggctcacatctgtaatcccagcattctgggaggctgagacaagaggatcgcttgaggtcaggagtttgagaccagcctggccaatatagtgaaaccccatctctactaaaaatacagaaattagctggcttggtagtgcatgcctgtagttccagctactcctgaggctgagacaggagaattgcttgaactcgggaggcagaggttgcagtgagccgagatcgtcctgctgcactccagcctgggagaaagagtgagactctttttttttttttttttttttttttacaattttttcttctagatggcctgcagattcagcttgttaaatttgataaaatttctcctgggatattaaatggcatttcattgactttacagattcatttcaaaagaattgtgattgatatatttacagaattaagtctttgtagccaggtgtgtgtgtatattattattaccatttttttgagacaggatctcactctgttgcccagactggagtgcagtgtgtggtcatcgctcactgcagccttgacttcctgggctcaagcaatcctcctgcttcagcctcctgtgtaactgggaccactacgacacccagctaatttttgtatttttttgtagagatggcgatctcactttgttacccaggctggtcttgaaatcctggcctcaagcattccttctgccttggccttccaaaattctgggattacagtcatgagccatcacacctgtcctcacttttatttttaattaaatatttttaatagataacatatgaagatgttctagaaaggatatatagtgaaatattactgctatgtcccagccctcctccacagaagcaaccattatttttttcttatccttctagagatattctatgcctgttcaagcaaagaagtgtgtaaaaatagcataataggtgtaacaagcaatcttagagattgtcatcatcaggagcagatccagcttttttgaggtctgcagtgaaaactactttggaggccttgtttaagacagtgagtagcgaggtgtggtaatacacacctgtaatcctagctattcaggaagctgaggcagaagggttgcttgagccccggagtttgagttctgcctgggcaactatagcaagattctgtctcaaaaatttttttaaaaagacagtgaataccaaactatgtacaaaatgagtagttatttagaacgagaaaagaaagcacaataaactagtttttcaaagctgataaacactacaaacgttaccaaaacccagaaaaaacagcactttaaaaatattaccttatacacgtatgtgttgtaatatttgtttttgctgcattttgtttcattgtctcctcatatgtcagtgattttgtaagtcattttctatgaaaatagaaagctaatttggtcttttcctccagtgtttaagatatagtcatttgaatatgactccacacctttgtgtctcggtgttgggtcctgttagtacagtgggcagaaggagtattcctggaagtcttcctatactgagacagtttaggtatacacaaaagttttggcgaaaaccacataaatatatcccactaaacccactaatggtatatgtagctcaatttcctcttgacttctcttaagtacaaaaatgacttcagccactccatcatgacctggcataagggcaagtcaacatggaagcagcagcagtcttgatggactgtggttaaaatagcttactatttggtggttcctaatcttttgctgcttcagtgttcagggaatatccttatgtctttatgcaaatgtgtgagtgtttctgatagatgaatctcttgaggtgaaattgctgtatcaaagagtttatacaatttagatttttatagatattactaaatcaccctataaaagattgtatcaatttatatcatcaccaatatatataagactgcccgtttctcatactcttgttatttgcatattacttacatgagtgaggttcaacatcttttctcatatattaggaaattctgtgtattttcattttgtgcactgtctatatcttttactcagtttttatttgtaatttttttcttattaatttgttggaacttgtatatattagggaaattagttctgttatctgttttccccctgttcattgtctttttacttcatgatagtttttaattatgtatacttttaatttttctatgtagtcctcttgaatatacaaaaaccccaaaacaccaaactgttgtttttcctattctctactttctgctcaacgcagaaaacctctgtgatcccagaatgtgggggttatttccccacacaccaagcagtacttcagtggacacctgctgtatgtcctataattcagttcagttctgacactacctacctttctatttttctaatagaaacagtactacttactaaataccgagtttatttcatatgtatattcttgcctcctcaccatttccatgtagagatatggcactggagagagtgtcatatctcacaggttgagagctcaggaccaccagactaccatctctcttcaggtggtagtcccaagtctgggtctccagaacttctgactgactagctacagattgaggttcccatgatccccttgttgggttttattaatttgctagagtggctcacagggctcagggaaatgcttacttaaatttaaccgtttattataaaggatattacaaagtgttaaacagcatagggcaaggtacgtgggaaggggcatggactttccatgtcctctctgggaaccacccttcaggaacctgcatgagttcagctacctagacgctctcccaaaccctgtccttataagtttctatggaggtttcattgtgtaggcatgattgattacatcattggccactggtgatcaattgaaccttgagctcatctccccttctggagtttggggaatggagctgaaaattccaaccctctcatgtttgattccactgttaggtagccctcatctggaggctatcaagtaccccatcaagacttgtcttattataggacaaaagttgctcctatcacccaggaaattccaagagatttaggggctctgtgtcaggaaaccaggatgaagtccaaaggcagatttcacagtatcacaagccaatatgtttaaattttcttttgtgacttccgagtttgtgtcatacttagtcctccctccaagattatattttttaaaaatctcatgtcttctagtgcttttatggcagtgtttggttttaatcattaaatttttgatacgtatggaatttactttggtgtaagaaatgagatacaaatccaacattattctttccaagtgattacagtttctaggattttttattgagttatgtatcttttccctgatgtaatgtgtcacttcaatcgtatgagaattttcatacatatttgcatctatagttgtgcctccatttttttatttgaatagaaacagtgctacttattaaaatgccgaggttatttcatgtgtacattcttgtctccccaccatttccatgtctgaccactgctactactgtgtcctatcataacattccatatatgcttaaatccaagcaaagggtggatttccatctttaaaaactaagcaggcattttggacaacacattcttggcagtggaacttggacaacatttatcaaacatattagggaaagttctcactctacattataaaaaggacaactgtatatcaaatgttacataagtgaaataagatggaaacatttttaaaactgcttaaactattttcttaaagagactttctccactgccagagatcttgaattacctcctggtcagtcttccagaagcaattctttatataattgacgaacttggcttccactttgggaagaaaaccagctttttctgtacttccttgctgttttgctttaatgtcttctacagaactaggttctcttggtgttttaggaagtttgtttgtttttttttctcctgttttttgaaggattcttgatcttggtgttgatggttttgaatcttttccattttggtttgatttttgtgcatttttggctggagtgtctcatacagatttcttcagtggagcttattcttgtctcctcttcctctccacaacccgggtaaccttgctaccacctccaggggcagatcactttccaaatgtacctaagagtttcatgtcctcctcttcttgatcttctaagcctcttcaccttcctccccagctcctaagtgctgttacctgatatgcacaggccctgaaccatacttcaacccaaaggccatgggtggtgttatttcaaagaccccaagggaaatcattggctgttcaaatcatcatgttcaaagttgccactattactttatttattttgttttgttgttgttgttgttgttgttgttgagacagagtctcactctgttgcccaggctggagtgcagtggtgtgatcttggctcactgcaacctccacctcctgggttcaagcaattctcatgcctcaacctgctgagtagctggggttataggtgtgcgtcaccatgcccagctaatttttgagtttttgtatttttagtagactgggtttaatatgttggccaggctggtctcgaacccctgacctcaagtgatccacccacctcggcctctcagagtgctgggattacagatgtgagtcatcatgcctggccagttgccagtattattttaattggactgccttcgtaattcattgtctctgtgtcaacaatctgcagttcatcatttgcaccagcctctaagctgaccattcttaaagataactgatgctcattttcatcattatccaccttaagatggtaatgtttgtcagcctttggttcacaatgaaaaacatggtcctcaggcctcaggggctcatgttcatgtccattgaatcttccatggggtggtggcacacacttaggtgggagagaaagcagatagaaatgaacaactattgcttaagagaacagccacacaggatggaatcaaaccaggcgattctttaatattttgtttccttaataaaattacatatttttcttcctaaaggttttatactttacttgttaggtacgtatctattttattgtttttgtagttatgaatttggtttttagatttacattttctgatttttttttgatacgtaagaatgtgaatgacaacaaaaaacatgttaatcatttattctgctagtttaccagagatttatatttcattctaatagtttttcagcttattcttttggcttttatttttcttttaaaaattatttaagtaatgcagtaacattattaaagaatcaaaccgtatcaacaaagtaaacctcctcctttattgccccttccccattcccacccctttcctcagaggatgactgttattagtttagtgtgtatgcttccaggtgtcttcaaaaagcatttacatacatgtacatctacaaataaatttttttcattagcagatattatatcatctagtttgctctgcaaattgctttttgtcattactgtatttaaatttctctctgtttgtacctacaggactataatcagtatttaaatgccccaaagcgatgtttatcaaactttaatgtacctgcaaaccacctggagatcttttaaaatgctgaaaccgattcagagggtttggggtggggaaacagagattctgtatttctaataagctcccagatgttgccagtgctattggtcctatactacactttgattgggaaggctgtaacatatgctttagacctattgtagtttgtgtaattattattcctgttcatgaaatcattggggtccctccccactacagatagtacagtaatgcacattggaatttctccaggtgagagagattttcttgaatattctgagtagacagtcattgtcatgatgtgtgtgtatgtgtgtggtaggggccggtggtggatttctccaacccttttcccgtatttgtattttgtttctttttcttattttttttttttttcttattttttttgagacagagtctcactctgtcgcccaggctggagtgcagtggtgcaatctcagctcactgcaacctctgcctcccatgttcaagcgattctcctgcctcagcctcccaagtagctgggattacaggcacccaccaccacgccccgctgattattattattattggtttttttttttttttttgagacgaagtcttgttgtgtcacccaggttggagtgcaatggcacgattgatctcagctcattgcaacttccacttcctgggttcagtccattctcctgtctcagccttccaagtagctgggattacaggcacatgccaccacactcaggtaattttttgtgtttttggtagagacagggtttcaccatgttggacagggttgtcttgaactcctaacctcaagtaatctacccgcctcagcctcccaaagtgctggaattacaggcataagccaccacgcccagcctctttttcttatttccttaaattagctaggacgtgcagtagaatgttgaatagcttcatcaatagctactctctgacaggaatatgaaattggtacagcctttggtaatatttaccaaaatgtaaaatacaaaaacaccttgacttagttattccctttaagaatctattcttctaaaacccttgcacatgcatacaaagatatgtacaaggatgcatattatagcatttacctgtagtagaaaaatgaaaagtaaccttaagtgtgcattaataggagaataattacattgggatatggtcataccattgacctactatgctatatatgtggctacatgtatactaatatgcagtattattaagagagaaatacaagttgcagaaaattagttattggttgactcagtctgtattttattttattttttagagatgggggtcttgctaagttgcccaaattggagtgcagtggtgtaatcataactcacagcagcttcgaactcctgggctcaagcagtctcctgcctttgcctcctgagtgactgaaactgtaggcatgttccacatgcctggccaattttttttttttttttttttgtagagataggggtctcactatgttgcctagactccagtctgtattttaaaaacaagttaagtgtgtgtgtatatgtgatgtgttttaaatacatagaaaaatgtttggagagttcacacaccaaaaatatgaatagtatttctctctaaggagggtactggtgttgacaggtagtttgaagcttgataaagaggaggcttttatgttttctgtgttctgtacaccttttatactgagtacttttcaccttcttaactttgaaaatgataaaaaggaaagtagagagatggagaaaataaagcaaacaatactgtcagttaacagaaaaatccaactgtagaacagtagggagaatcagagagcaggtgaattcaaaccatccagtagtcaattttcttaaatagtcaacaagcatggtaaaaaatcaaatggtacaaaaacatatgtggtactgttacagtcctgccaatgcaccacagtgtagcaatctcttgtgagatatcacctggagttcagagttctttgtctcagtgatgaagagaattaaggggcgtggacacaaagggtgaggttggaacaaaagtttaataagtgaaagaagacagctctccacagcagagagaggacccagaagaggattgccgtttttacagttgaatgcaaaggctttttaaaagaaaccagtgagggctgaacatctcatttacgtaaggtgagaatttctgatagctctacccagtcctcctaatgtgcatgcaggcggttagcttgagttattccatatcgctttgttccccttactgcacatgtgtcaggagacgggattttccattgtgggcatgtctgggcaagtcacctgtgtagcctttcttatctgtgtggctgtggacatgtcttaggcaaacctccctgtgcaagttcccttatctgtgcctgcagcttgatttttcaggttgttctgtttgaaataattccactgaggacccaccctaactgcctaccttaccggtttcttcctttctcctctctcagtactgtgataccacccccatacctgctatagtggcttctctctaaaaacagaaaatagcaagtgttggtaaggatatggagaaattggaacccttttgcacttttggtacagcgaaaagtatagttgctggtaaaaagtatggtggcgccttaaaaaatgaaaaactagaattaccatttgaactaacagttcctcttctgggcatgttaccaaactgaacttcggtctgcccacccagtgcagcaaagctaaacactgacatttggattgctgcaaagagaaatggagatgtttattgcagggcaccaaacaaggagaatcggatagctcatgcttaagacctgaactctccaatggcttgcaagcaagggtttataaaggcagggggaaatttcaggaaggtagaagttataggcaaaatcataaggcaatacatggaggttatacattggtttggcctaaaagggcgggagatcttgaagtggggtttacaggttgtaggtagattttctgatttgcagttcattaaggaagagaagttttgttttaaaatctggggatcagcagaaaagaatattagttctggctcatgggtgtgacttctcccaagtccctcaggaagaactttaggacaaagatattcagtcctcagttcccccttacctgatgtgtacatgccaacagatccatttggtggggtccaggtttctgaaaaacaacccagggacatgtgtccatcaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacactgcatgttctcactcataggtgggaattgaacaatgagaacacttggacacaggaaggggaacatcacacaccagggcctgtcatggggtggggggaggggggagggatagcattaggagatatacctaatgtaaatgacgagttaatgggtgcagcacaccaacatggcacttgtatacatatgtaacaaacctgcacgttgtgcacatgtaccctagaatttaaggtataattaaaaaaaaaaaaaagatgttgcctttagtttctatagggaaccaaacatcccacgactctaacttccttggctattgttttaagctgctattaccctcttgcttatcaagttgttcatttgcttctcagggccagctaggtgcctggaacttctcttgaaggaactcaagattttcctttatttccatgctgggggcgggggaggcccataggcccctcaaggggttcctgctccatctgaggtccatgttcaaaagaattgaaagtaggtctcaaaaatatatttctacacccacattcacagctgcattattcacaataactgaaacatggaaacaacccaagtgtacgatgatgaatgaatggatgttagatgttgtgtatacatacaatattgagacatcaagcaaagattaagtatgtttaactttgttaaagaagtggagcctatatttaataaaggtttttgtgaatttttcaaaataaaaattgatatatagaatacaatttttcaaagttaagagctttagaccgtaagacccaaagtttgaggaacattgcattacaattaaatcatgtgatcacagagctaacatgtaaacatgagcacaaatgttggtgctgaaatttcatgttcatgaaaattttacatcatcataaacatttaaaagcaaaatttaaaattcatgcagaaagtcagacactcaagagtggacttaggagaaacaatgatataaaacattgaattcttaagaaacttgagaatccttgaaaaaaattctactaatatgcattgagcacctattttggtttaggccactgggatttcaatagtaaatagggcagtcaagggctagaaacaggaaagagtgagggactgtgtgtcaggaaatgcttctttaaggaagttttttgttttgttttgtatttttgagatggagtctccctctggtgcccaggctgaagtgcagtggcacagtctcggctcactgcaacctctgcctcccagttgattctcctgcctcagcctcccaagtagctggaattacaggcatgcaccacagggtccagctaatttttgtatttttagtagagacggggggtggggggggggggtctcaccatgttggctaggttggtctcgaactcctgacctccagtgatccacctgacttggcctcccaaagtgctaggattacaggtgtgagccaccgcgctggccgagaaatacttttaattagtatcagatggatgagtacctgttagctaaattgagggctagggtaaggaaaagacaatgagactaggggcaggattgggatgaaaggagagaaatataatttcatagtcaagtggaaacattgttataatattacttcaaacttacatcataagttaagttatgatgtcacctgtttctcttggagaagcctattcaccttcattggaatgggaagctttctcaagaaatgtcagaggattcaaatatattcttgctttgttagttgagtcagtaccaatagtacacttgtgattagactgtcaaacaaaatccctgaagggatttcacactgttaaatgcttggtttttatttgtttttatttgttgggtttttttttttaaacggcatagatgtaaatttgtgaattacagaaaagaagcagttttaacatgaaatggacaaaattgatttctttctctgcttacagagcttaataagaatttcagtccataagcctttcaaatgaaacaatagaaactccaacaattcagagctaatgtaaatgaaaacggttatcttccaaatcacagcataataaagtaaccttgaatcattggtgttggccctatattgttatttatttgaattaaatggcaattttcagcattatgtaacagtgatggaattaagtgatgtttctagtaaaagaattttgcaagtataatatattttagtattaaattccacttgtacatttagcaattaaaattattcctgaaatgatgatggcatttgaagggatagggagctgtcaaagaggatttgaagcttaattatctctttggtaacaaaatgcataatcttccattacaacacttattttcttatggtaattgactcatttgttctctggttatcaatttaacttcccaaccacaaacatctgctcttacaattgtgtttaattggtgtgaatactatctacagagtagttaaaatccagaaaacattttaagggcattattttataattcatgaaagggaaactaatgattaattgaacattgcttatgatgattttttctaatagtctgtgaaagtctgtttactaaaaatgcataccgaaattatctgctcccccctcctttttttttttttttttttttggaagaggcttttgctgtgttttccagagtaattatttactctgccttagggggagcctcagttcttgcagttctttagactcaaggaatatgttaatgtcttggaacatggtaccttagtagttaagagtataggctttgaaggtagaaaaaaattagtatgctatcatttataatctaaataagaggattggggacaaattgtgggtgtgggtatgtgcttataattttcataatggaataataaatcataaatttaccagtagggtaaaggaggaaataggatgagagaaacagggttagaaggtaggtaggtttgtttgaatgtaccttgtctttatagatttaaaaatttacaaagtagttcctgaaactggaaagtaaaatgaaacaggcgactccaaaggtgtatccagttggtaatacagccacacagtaagttacaattctaagtatatggaattataattccatgtaaatttaaaattgtaattggactataatgtacctagtgggatttactctaaggacacaactgcaaaaaatctttggttgttttcttttatcatattgttggtacagatgtttattctgagactatgggtgtaggataaagtaaatgagtaattatgttagtgtcattgagaacagatttttggcttgagatacagatgtaaaattaagaagattcagctaaaagctacagtcttagacttaattgaaaatatcagtaggaaatcatgatgaagtttatatttaaaaaatacaaaattgctgactttgtccacaaaaagggtctcagagcaatgaccataaactgaagtccaatagagtcatgtgaaaaaggactcaggagctttcactgtgttcaggtttcctccattggtcaaatatgggatagtttaagaatcaaaagaataataacctgagtgaattgaaacaaaccaaatatatcttaaactaaaggctcttaatacttaaatgaaaaatcctcagcaattacctttgggagaggatattagaaaaccagctcactgttttgaaaacgtaagtgaagggaaaaagtcaagcatttattctgccccttttcgaagtacggtactttaggataaccagataattgtggggttatcctaataattgaaggaatatagtaataagtaatataagggatgtttctctttacagaatgagtgatagaataagagtattactattttgcaccgcctgatgggcaatgataaccaaaggctgttaacatcaccaaaagagagatagacacacatgatgaacctcctgatagatgcacatggaactgcctatgaagtagtctcgggggaaaaaaaaaaaactagcctgactccaatcagggttctacatttaactgtgagctttcagaaagaacatgttaaataccactatggcaatgtggtcagcaaaagacagattgcaggaaaaccttatattacaaatgacttggtttcttaaacaaatttcaaacaaaagataaagaggagtctgtagatggaaaaaaaaacctaagaaacaaattaacaccagtgaatgcaccttgtttgcccaatttgaataaagtagatcatttttaagaacatagaggccaggcgtagtggctcatgcctgtaaacctagcactttgggaggctaaggtaggaggatcgcttgagcccaggagtttgagactagcctgggcaacatagtgagacctcctctgtattaaaaaatcaaaaaattagctgggtgtggtggtgcgttcctgtagtctcagctacttgagcggctgaggcaggaggattacttgagtctgggaagtcgaggctgcagtgagccatgatcatgccactgcactccagtctgtgcaacagagtgagaacattggccagttagtgaaatgtgaataccgactgggtaataggtgatattaagaaactattattattattattattattattattattattattattattacttgagacagagtcttgttctgtcgcccaggctgaagtgccgtggcacaatcctggctcactgcaacctccacctcctgggttcaagcgattctccggtctcagcctcccgagtatctgggactacaggcatgagtcaccacgcctggctaatttttgtatttttaatagagacgggtttttgccaagttggccaggctagtcttgaactcctgacctcaggtgatcacctgcctcggccccactaagtgccaggattacaggcgtgagccaccatgcccggccaataaattattttagataccagcctgatgatggtatcatggttatgtttagaaatgagagttcttggcttatagaggtactcatttatatatgaaatagtgtaatacgtggagtttgctttcaaaataatatgtgtgtagggtagaggctgggaatggaatggattaaggcatagatgaatcagtattgaccatgacttgataattgttgaatcaacgtaataggtacataggatttattctattctcttaaataaaaagttttttaaaagaatataggttttggagtcagactgcctaggttcaaaatccagatctgtcactgactaagccttgtgctatggagttacttagcgtctctgtgtattagtgtccttgcctataaaatggaaataatataatattaactgcataatagaattgttctaggaactaaatggttataagtggaaagcgcttatgaatgttagctttgatgtgttcattatcacacatcaaagatatacgttaaagttataaatcattggctaaagatcttagtgtacttaggaatagtctagttgaattccttatttagtaacccaggagtttgaaacccacatttagcaaaatgtccagtggtagaaccagaactcaactttatgtctcttgactcctagtctttacaactgcttcacagtaaatcacttcaaagaatatccaagagtcaaaagacagaatttttacaaatttagttaaatgatataatggcttttaatagtaattcatgagtcaggcagcatctcatctaaagaacagataagcactacactgggcaggcagaacagttagtttttgtagggaaacttgagcaggaacaaagaaacagtggattggttaacattagttgcttcagattactttcattgtaagggtcaaagcagaggggactttcttatgttggctaaaactgtcccatttggggatttgacacacacactctcctgatttctcagaaggtcagataaataacttaggtttagtttggtgatatgcaactttggcacgagtgactgcattttggttcagtctgtttggtttgatctgtagagtagaagctcaatccatattagtagtctcccataaattttatttaacacaagtaagcttaagtaaccttgttctaaatagaaagactcacagttgcaaacatcttcagttttcctgtatctaaaatgtattgcagttcaaatgaagactccaagttcttgtttgtctgtttgctttgagaaggaacagacaaacttaacataagatgagtctaaatttatctggggagtggaacactaaacaaacatgttagaaaaattttgaggaaataaaggaagaatatttgttccaccatatattataacatattgcatagttataataattttatggttctggcccaggaataggcagatggatgaaaccaattagtgtcctgaaataaacccccaagagtacgtagattttagtattaaatctttcaaatctgtcattctttttgggatgactgatcttgccagatatatgtaaagctggatacttagtaagtctagtttgtttcgtagaaatattagaagaaaatacaagtgaatgttgttatagtacagaagaagggaaagcctttggagtaaaaatagtgaaatacagatgctaaaatggagagaacttataaattttaccatatgcaaacgtaaaactttgttacaatagatgccttaagttaaagacagaagaggaaacaaatattggcagcatgtatagcttactgtattagtcagggcccagttaggagccagaaactatactaggcatttgaacagagcaaatttaatataaagaattattaatggccggtcgcggtggctcatgcctgtaatcccagcactttgggaggccgaggcaggtggatcacctgaggtcaggagttcgagaccagcctggccaacatggtgaaaccctgtctctactaaaaatacaaaaattagccggacgtggtggtgcacgtctgtaatcccggctacttgagaggctgaggtacaagaatcgcttgaacctgtgaggcgaagattgcagtgagccgagatcacgccattgcactccagtctgggcaatagagcgagactccatctcaaaaaaaaaaaagaattattaactattaaaatctacttactaaaaagggcaaaataggacattaaagaatacaaaaatagtaaatatagggattagctatgactacctcttgagctgagggagagaatccaaaaatcaggaagactgttgttcagaccttgttgaagaaagtgtagctgctgccaaaggacatagctatgggccaaagctggggcacaggaaatcccctgctgggaggcctcagagctggtgtgcagaaaacacctgctggggtgctgtgggctggacagatgataagccgaaaattgcccactgggatgacatgagttggagctggtgtacaggaccctatccaatgggatgcagtgtgtcagagctggtgcacagaaagccccatgctggagtaagctagagaaacttacaggagggtgatcattattgggtctttcacaatcagcctcaccataggagcaaaaagaagagcatcctccaaactgaaaattaagcccatcactctgctttgctgtgcaacaaagcaccagctgacaaaagtccatatccactactgcaaagaaggacagatttggagctgagagccttgaaataataactctcattataccaaaagctcttatatatagataagaaaattataaacactctaattggaaaaacggcagcatatttatatacataattcacaaaagaataaatacaaaaggcttgtcattgtttgaaaggatcaagtcaaatttgctattaatagatttccctgatttcatcttgttgtacagatttatgttttctggatcttccatcactgtgaatgtatgttgtttcctaagattatacatgatttccctccttgggggaggttctgcttgactggggttctatctcctttttgtactgttgttcttcatttacctaagttatgtagctagtttagatttctcttcagggcctgctctagacagtgcaataggccaaaaaagttcttttttaaaaaaggaaagggagattggaaaggcataaataaatctgtctctactcacatacaagcatgattgtctatgtagataatccccaaactgtatttacagaggctgatacagctaatgagataatttaggatggccacaggataaaaggttaatacacataaatcaatttcattcctacatactagcagagaacaactggaaattttaaaaaatttaaagtaccacttagaatagcatcaaaagtatttgaaatacctaggtatttatctaacagagcatgaatgagatttgcttactgaaatctgtaaaacatttatgaaagaaatcagacttaaatagagagataaacctgtgttcagggaaaagaagacaatatttttaagacgtcaagttgccacaaattcaacacaatcccaatcaaaatcccagcaggctgggcagatgttaggtcaactgtaaataaagctgctgtcgttgccattgttgttgttatttcatagaactagcctgcagtggagcttgctgctttgtgatgtagggagttcctgtcattcacacttttcaaatacagatcgctaagaccctttgtcaaggatgtcatataggaaattatatcattaggtaggatgctggactagatctacttcaacccttctaattaaaaatattatgatctattatttgtaagttagcaatttacagctgtggggcatgtggaaagggagctactggaatattcagactttttcaaatgtacttatcctttccccgtcaccctgtaaaaccattgcatataatgagggatcttagtaataggagtgtgttgcatgagtgagctgtttaaggactctaatgtgacgtttattttactttgttgttgttgttcttacttatcaagctgactgaaaaggaaagttttatcaatcttttccactctttgaattctaattatagctcttaaaaaatggtataaatcttagggaagtattctttaatatttatttttagacatttttaatttctccaatatagtcaacttagtaaatagttccaaataaggaaactcagaaattatctttaaaacagttagttgtaccagcaaatcattttttaaagataattgtattcctaacatgtattttttattatatatttattttatgcttttgcaaaaatatgtgaaagcttcaaataatgagtaaaaatcctgtggattttatgatttaaaaattggttgaaatatgaatagctgcctagttctattttcattaatgtcttaatttcctttttattttaaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtagtaagtatttttcaaagaagtgtgtttatttctgtaacctttagatatttttaaatgtagtcaccgagagatcagttatcttatatatactagtttgtgtactgcaaatgaaatagaagaattcacatagaatgtaataccttcattggctgatgagaaagctgagcccagaaatactttggtagcttatgtaagatcacatagcaagtcagtggcttacctaagcctagagtctagactcttacttgaacacactggcactctgaaacacagctgccaccattttctggcagatgattagcacacatgtgtgtgcgtgtatgtgtgtccccagttgtcttcacagctctctgttcaagaagcagaaatctttccacacttctccttgaagtgtggaaagatgatccttttgaaaaacataatatgtaagaatgcaactgactatacaaaacttaaccttaaatcgtataccgatgcccagacccttcaaaataaggatgacccagtgtcggacaattgtggtagcaatagttataaagattcttttttaaaaatgcatttaaaaagtgtcaagtgtatttaagaatactcagccataattgctttttactatactttatatatagtaaatgattcttagatattacctactattatcatcaatatctaacattttagtaatagaattatccagctttagtaataaagattaatgacataccttgagatctatacatgacattcataaaaatgatcagaactatagttgttaaagacataatgtctcattacaaatttgtcatacaagtaaacattcttagaaatatattttctatttttgaaatgcatgatctcctgttgcaaaaagtaatttacaagtatttaacattaaaaagcaatctgttatagttaaaatagcctcttaaaatcaatatttggaaactagaaaatttttaaatcatatttattataccaataacagtagttaaaaattttttttgttttttaagacagggtctcgctgtgtcaccctggctggagtgcagtggtttgatcatagctcaccacagcctcaaactcctgggcttaagcgatcctcctgccaacctgagtagctggaactacaggcacgcactaccatgaccagccaattttgtattttttgtagagatggggtttcactgtgttgctcagtctggtcttcagcgcctgggctcaagtgatactcctgcctcggcctcccaaagtgctggggttacaggtgtgagccactgctcctggcccagtagtaatagttgacattcatatagtactttttcatttaaggaaagctcacatggcttcatttaatttattgtagtctaatctgttagaactattgatattatagatagtcttaggaaaaataataccttaaattcacaaattggactttaactgtggtcagttggtattgcgtgccagatctttttccaggcaaaggtgtagtttgcaaacagtgagagtatgactttccatgcgttaagttcttcatcgtgaatgacagtatgtactcttctattcagttaaattggtaccttgccaatgctttagtatgaaattgagttaacaagtacttggataatatttaataattggatcataaaaactttacttgtttttttcctctccaaaaagcatatttttgagattttgatctggtatttatcaattaaattatgtaattttatttatgcttttcttcttcagaaggaacataatcttcaagttttgggtctggtgaaatcagatgaagggttctatcagtgcattgctgaaaatgatgttggaaatgcacaagctggagcccaactgataatccttgaacatggtaagaagggctgaaatagtcagatgatagaggctgtgtgcttgatgaacaagcacccatccgtccaaataactcatgattgataacccattagtaaaggccaatatgtggcatagctaagagaaaaagaatagcagtctaaatcatttctattacataaaattacctagaagcacaattttggataatgttgaaaagaaatttttactaagaaaaggaaaactgaatattatagtcttaataaattaatttttaaaagaatttagtcatcttaatctcacaaatatatttctgtcctataaagaaaaacttcttttttttccaattctatacacttttattaatacacttacaaaaaataacattcaaacactgagaaaactaaataactttggaagcagagctcattgttttctgcttacatataagtgacaattctgggctgttggcacaaaatagtcaacattcataaaaccctgactactatatatcaaacataagttaaaatcataggcagtagtttatcaaatccacgtttcttagaaaaacttagtatttattttgcattgaaatttttagtttttccagaatacaattaatttaccttttctgattaccaccaaaaaaccaagtttattatttaaaaattcagataacaatgaaaagtataaagaaaaaaatccatcctgtatctcaaattagggaacccacactgtaatttgagcagagttttaacataaggaattaacattgatattgggattggagtaacaaaggtttgactagtaagaagtaaagagaactctagacaatataagaatggcaactatcaggagcaactacaacccctaggtctgagatagagccctcaggaagaggcccctctttttacggatgagatccagaccctgttggagagggtgtaaccatggtttactggatggcagagaagttgatgtggtgttttgctctctaaacttgctcaaaatctcctttcttgagggttggggaaagctgcttacagagaggtatctcactggaggcattctgctacaaaaccacccagtggatcaggtgtaaggggaagctgctggctataggaggctgccagggtagtacactagaaccaggaaggaaactcctttcttctgtactgtatctccattgccttctattgataaagtttaatacatatgccagctggcaaaggaaaagtatataaaggacatggctctgtttttgcagcataggcaatgaaatcagaatttggagctgagaggcagtaaattgataactggtacacacttcaaatcctaccacctgggtacactgtgtatggttttataatttcctgttttgttgcaacagcatgctgtgtatatctttctgtgtcaacagttgatctgcatcaatattgtttcttattaaataatatgtatatatatatatatacactgttttatataacagattttatattggttaacatttagattgtcacctgttttttcctattacaaacaaggatgtattgaactttttatgtgattattttcttatactaaattactagaagttgaattattggataacagttctgtgttaaattgataagggtacctgttgggtgcattattcatttgttttagcaactgaaacatttttcattttgagcatttctcaaaaatacatgaaaaagatgccactttagacatctgatcttttattcaagtcaaatacaatcaggtattggtgtgcctccaggaagaatttctctgatgattgtagtttggccagggaagctaattggcaaagatggcacctactctggcttttcactaacatggcatatatgtaggatttttgtgtgctattttttgaaaaatatacttgagagtgctgttacagaaaagcataaaatattagaactgcttttttcttcttaggtttgtatataccctcccctgtttattggaaatgattttagtagaagcatgccatttttccatcttggtgaaatgcctgagtacaattactaaataaggcactagcagaattagtgaggtagataggcttatttctttttacttgtggcagtgacttttcttagtaaacctcgtagctatttggggtatatttatttacatggaactaagcaaaggcacttcattatatttgtgtttgagattactgttacaaatctaactctaacagtagaaatggttaagtatgccaggaagttcctaaactaatcctaattgggctttcctctgaaaatatttggatagtgttaaaattgtagtcatagtgtatttgcttctctctttttgagaatagcgttttatgagctgatgaaattttttagtgacgttattgggcatgtattaaagatgcatagattataagaaggagagtaagtgtcatgttattaattgtgttttctattttgctgttttaatttgcaagataaatatttatacaggaaagctaaaagaaggaatacagtaacttactagatctgagctcttcttttttagagtttacaatataataagggatgtaagagatatataaaacttgaataccagtccagatgcataaataaagcagcatacagttcagaagagaggaattctgtctgtgtgatcagggaattttttcatgtaaggtgtcccctttgtaataggccttgaattataagatttctagatgttaattcaaaggaagacctggatcaatatggaaataaaatagaagacctgttcctgtagtaaggtagcctttaacagcagaataggatcagagtgcatgattataaataataaaaacaatgccatgtgtaatgagtatgatgataaagtcaggtttagaggaagacagagtgcaagctggttgaaggaaaattgttatgaggccattgtgagatgataaatacttacactagagaaatcggtggaaaaggatcctactaaggagattgtgttagtctgttcttgcattgctataaagaaatacgtgaggctaggtaatttataaagaaaagaggtttagttggctcccagttccacaggctgtacaggaagcatggtgctggcatctgcttggctcctggggaggcctcaggaagcttccaatcatggtggaaggcaagaggggagcaggcatctcacatggcaggaccaggatcaggagagtgaggtgggggggtgccacacacttttaaacaaccagatcttgtgagaactcactatctcaaggacagcaccaagccatgagggatcttcccccatgacccaaacacctccccaggttccacctccaacactggggattaccttttcacatgagatttgggcagggacaaatatccagactatgtcagaggtgttagtgatttatctgattgagactttatcaactgattgaacattaaacattgttatagagaagccagagatacttccaaggtttacccaagttctgggtaactaggtgtattagtccattttcacactgctgttaaagacatacctgaaacagggcaatttacaaaagagatttaatgggacttgcccttccacatggctggggaggtctcacaatcatggcagaaggcaaggaggagcgagtcacatcttatatggatggcagcaggcaaagagagagcttgtgcagggaaactcccattttccaagccatcagatctcatgagactcattcactatcacgagaacagcacaggaaagacccacccctataattcaatcatctcccactgggtgattccactgggaggtggaatgggaattgtgggagttacaattcaagataagatttgggtggggacacatccaaaccatatcactagaagaatggtgacacctttacaaaaacagaaaaagagggcagatcaaagtggaaggagatttccacttctgtttaggatataaagaggtgcataaagaaaatcccattctcaccacataaagagcttagtaatctacaacgtcacaggttctcttgagcccagcagagagctgagcatgcaaagcaaatatattagttcattttcacactgctgataaagacatacctgagactgggtaatttataaagaaaaagaggtttaatggactcacagttccacatggctggggaggcctcacaatcatggcagaaggcaaaaggcacatgttacatggtggcagacaagagagaatgggagtcaagtgaaaggggaaacccctcatgaaatcatcatgtcgtgagatttactcactaccacaagaaccgtatggggagaaccacccccatgatttaattatctaccagtaggtcccttccacaacacgtgggaattatgggagctacaattcaaggtgaggtttgggtggggacacagccaaaccataacagcaaccaaataacctaaattccaaaaaggacaaccctccccacacaaccccctcaaaggcatagatcatatgcattgtttcacttttggcagaacacaagagaaagagacggctactgtaaaagtgagtaagaggaaaactcctagagttttaactaaaaggcctttaactgcaaggccaactatggcctaatttggaatgtctgggggcctcagacagaatgggagtttacactttcttgcaaacacttttccttggggctccacagagtactcccaattaagaggaggcaaaagcaggagactacagaaagccatctctgtggtgtagggatgaaggaagtgatgatctgcagctgcagagagagaatgatgcagagaggcctttgtgcctgggagacaggacaaaggccttcccatttactcagacccttctcctttaagcctcaaaccagtgggggaggggcagaaaaccttctgatttcatacgtttctgaagggagattagaagtcaaacccctgtgctgcttagaggaggaaccctcctgtccccaggatgcaggcagagactcattgatgccggggaaagggtagaagagaaaaccctttacttctgaaagaggcgcagaaatcattttaggcctcaggattctacactgataccaaggagaggtcttttactactaggggaagagtaggaaacttctacctaagaccgatacaaatacaaggcagattttgactgccacaggaagaagagccagagggcctacctaagactgaggctggaccagaacaatggagaatcctagctgcctcaaccatgaactttctactgtttgggaaaggtcaagagcacagagggatatcctgtggtattggtatgctggagtggttgaaaactcagaggaaaggaaaaaaaaagagagagaaactctctggctcctaagcacaggacaatggtagtctcccagtagaggaatttgaaacctatagtatacttaaggtaactataacaataaaatccattccaagctcaattcctgactagattaactaaactctttcacactaatgacatgacagaaaaataagcataccatttttcaggtgtaaataatacttactgttgttcagcataccgtgttcagcattcaagcaaaaattaatagactttaataagcccatctattgagagagaaactaatcattagaactaatttcagcctttgtgacttctatgcaatagaaagatgttcttagaaaatataccattcaaatttcattctttatataccttttttaaaattaattaattaattaatttttttgagacggagtttcactcttgtcgcccaggctgtagtacagtggcgcgatctcagctcactgcagcctccgcctcccgggttcaagcaattctcctgcctcagcctcccgagtagctgggattacaggtgcgtgccaccatgcctggctaacttttgtatttttagtagagacagggtttcatatatacctttatttttaaaattacttgaggtatactcctacagactacaagatgagtcaaaccaagaactcaaaaacaacacacactcttaacatctgatccagcagttgcacttctttgtatttacctgaatgagttgaaaagttatgtccacacaaaacccctcaaatgtgtttgtagcatctttattcctaattaccaagatgtccttcagtaggtgaaagaataaataaaccgttgtacatctagacagtggaatattattcattaccaaaaagaaatgacctaccaggccaggtgccgtggcttacgcctgtactcccagcactttgggaggtggaggtgggcagatcacttgagggcaggagttcgagaccagcttggccaacttggcaaaaccccgtgtctactaaaaatacaaaaattagctgggcgtagtggtgcatgcctgtaatcccagctactcaggaggatgaagcatgtgaatcacttgaacccgggaggcgaaggttgcagtgagccaagattgcaccactgcactccagcctgggtgacagagtgagactctgtctcaaaagaaaaaaagaaagaaaagaaaaagaaaaaagaaatgagctgtcaaaccataatgcacttgaggaattataaatgcaaattaccaagtgaaagaagccaatttgaaagggctaaaaaccgtgtgattccaactacatgacattctagaaaaggcaaaactatggagttagtaaaaaaattagtggttgccagggtttgggaggagagagcgatgaataagcagaacacagatgtttatggcagtgaaaccactctgtatgatactataggggaggatacgtgtcataaatttgtccaagcccatagaatttgcaacatcaagagtgaacactaatataaactatggactttgggtgataatgatgtctcaatacaggttattcaattgtaataaatgtaccactttagtgggggatgttgataatgggggaaactatgcatgtgtagggcagaggaaattttggtaccttatgctcagttttgcaatgaacctaaaactgctctacacacttattaggatagttaaaatccaaaatactgacaacaccatcaaactctcacaaggatgtagagcaacaggaactcttattcattgttgctgggaatgcaaaatggtacagccattttcgaagatagtttggcagtttcttacaaaattaaacatttttatcataaaatttagcagttgtgctccttgatgtttacccagatgagttgaaaatttatgctaacacaaaatttacacacaaatgtttagaagaattttactcattattgccaaaacttggaagcaaccaaaatatcctttggtatctgaatggataaacaaagtgtgatacatctatacaatggaacgtcattcattgaacagagcatctaagatgggacaatatcagaggctataacataagtaaattataagtaaatgggagtctcacagggaaaacagaacaaggacagggagaaacaaatgtttgaatagataatggccaagaattttaaaaaatgaattagatcaaaccacacaaccaaaaagaagctcagacaacccccaagcaaactaaataccatgatgatgataataataataataaaaagaaaatatgcctgtacacatcatagtcaaacttctggaaaccaaacatgaaaatatcttgaaggcaattggaaatttaaaaagaagaaagacacattacatacagaggaacaaagataagaattgcagcagactttttgccagaaaaaaaaaaaaatgtgagctagaagacactgagcagtagtttttagtttaaaaaaaaataattaaggggccatggtaatcttcactgtattgttccaattttagtattagtgtatgtgctgcccaagtgagcacagagcaactttttaagtccttaaaaaaaaaggcaaccaaaaaaaaggcaaccaaaactatacccagcaaaaatatctttcaaaaattaaagtgaaataaagaccttttcagaacagaaactgagaatttgttgctgacatacccatgctacaagaaatgtgaaaggagaaaaacaaagtgggctagagtgtttttaaagtaaatataaaaatatatttttaagattaattgctttaagagataattgactgtctagacaggcccacaaaatttttttcttctttttttttcactctaaatagtttatttccaccttcacaaactcatgcacctctggccattatgcaaggcaccatgaattaaatagtcatatcagtatatatttgtcttacatgattcaagataaagtgaattttaaaagcaaatgggtgccaatgatggggaggtgaggggaatagggcaggcagcaatagggtaacacgcaacaaaattttctgtaaagggctagatagtaaatattttaggcttaatgggtcagtctctgtcacagctacttaactctaccattctagcgcaaaagccaccatatagatcaaacaaccttggctgctccggtgaaactttgtttacaaaaacaagtagcaggtcctaatatgcttactctggtctaacacagaaatagttgataacatgaaatttagaagtgtgacagaatggtatatgtagtgtagtccgatgtgtagggtagaattgaaaataaactattgtaagattattactgcacacaacaatactgtgtgtcgaagatgctcagatactttcaatattatttttaaacaagactcatgaagataacaactattacaaaatatttcctttttcaataattcactccattatttttctagttaagctcagatagtgatcacagagatatgttagtaaactatctgtagtttgtagttctccctttaacagttcctttttggagtgactagggcacatttcctcctcattattcatacaccaagtctgactttcttcacttatccttatattcttcattctcctgctccctgtttgcctttttttcctcccactccttccccctttttatttaaaaaattttaagtgaaacagacatccactgatgagaaataacttagaatcacaaactatcacggctgaaagatacgtatcatgtagtacagtggttggcaaactttctgttaagggccaaagaatagatacttcaggctttacctgacatttggtctctgtttacattgctcacctctgctattataagtttgaaaaccaccacagacagaatacagacaatctgtaacaaatatgtgtagctgtgttcctgtaaaactttatatacaaaagcaggaagtacactggatttggcctgtgggcacagtttgcgaatctcaatctagtccatcttcccttgaatatccttacatcagtgtttcccaaattgtgccctttaagatgtattaatgggtctactaaaaagcaaataaaatgaacaaaaaggatgctccacagtccaacagattttgggactgctatatataaacattatattctacgttggaaattcgcaatgctaatgaacacaaatggaaagaggctcaaggtgggccagttttcatcatttctccttcaggctgcccaagcgtctgcctttctcctaccaaatccagacatatcagtgaagtctgtcagaatttgctatatttacttcttgcaagataacccaattctcctgtgaaaggaattgtttgtagactcttaacttctgtctgtcatgtttttggcagaaagtcatcaatgttatatctggtggcttttctaaattttaccactgattaaaaggtgagtttagtatttaaaaaaaaaaagactttactaattatataaaagtaatacatgattattttagaacactgagaaaaatatcactgcccaaagataaccagtgttaacattttggtatggaaatgtctaaatgtgtatatacactttttaaaattaaattcagattatttggtatatattgttttgtatcttgtttttctacttgttgttatatcctgagatcttcctgatatcattacaggggttcaaaggcatggtttttaatggccaaaaaacttttccatcataaggttgtactataattattttaactacttcctctattttgggacatttaagtcatttcctattcttctgttctttatccctgtctgtttttcctttttcaattactaatgctcatattagtagtctttgtccaaatctctgattctttccttaggaaaaattcctaaaagaacaattaatggttcgagtcagtaatttatgtaattgtcaaaatggttttagtaaatgatgtaacaatttacatttttactaagagtgaagaaaggatacaaacctaatcacacattagccaactattaaaaagtaatgttcatttaaaaatacaaaatttaggctgggtgcagtggctcacccctgtaatcccagctgggagctgaggcaagaggattacttgagcccaaaacttcaagacttgcctgggcaacatagtgagaccccatcctcacaaaaagttaaaaaaaaaaaattggccaagtgtggtggcacacacctttggtcccaggtactaaagaggctgagatgggaggattgcttgagcctgagaggtcgaggcttcaatgagctgtgattgcaccactgcactctagcctgggcaacagagcaagaccaccaccctacccatgcaaaaataaacttcattattaggcaaaaatgacatcttacccattgaattttatatctttgattgtgaagtggaatatttgtcatatgtttagaaatacagttactccttggtatacatgggagattggttccaggacccacacatatatgcccagatctgtgcatattcaagtactgtagtcacctctgtaagacctgagtacatgaaaactaggctgcctgtatagtcgggttttgcatcctgcaaataccgtattttttgttgcgtttgtttgaaaataaaaatcaccatgtaagtggaaccatgcagttcaaaaccggcttgttgaaggatccactgtagtctgtctttgctcttctgtgagttgtattcttctgttagttattgaaaaacgaaatcaatctcttgtgatggtgcttatcttcaaaaccttctttaaaaataatgttgaaagtatttgactgtgcatctttgatagttttatttctgtagggagagttttctgattcccacctgaagtgtgtggctatatatactggccataggccagctggctagtgctgggctgcaagaagctgcgttggagcgtccacagtaggcctgtggtatacttaacatgactattaggttaattatcagctttaaacattaaatgaaacttaataattatagttaaaatatataaaacatttttgcatatcactggaaaacagaatttctgagcaaattgtgaagtagaatttgacttttgttcctagcatgctttcttaatcaaaacatttaaaatacaacttttaatatttaacttcacttttatgcattttcggtaacagcagctcttgattttagaagatcttgtatcttttaaaaatatttaactgaacataaaacaggattatttttatttgctgccatttcagattaacattgcctgtcattttatgctaaaatcctttgttttttataattatctattaaattacattttcaaaaaaaagcattggcaggtacattgttattattatttaaattattactggtcaattaagagtagtaggaattaaggtaaaatgtctgtatcttttgtccattaactttttattggcctttcttcctgtcagttgaatttaaaaatagattgcgaaattatcatgtgagactggaatgtgaaaacatagaaatacactttctttttctgtcctttcataccacgtctgataattgccaaattttagttctagtaaaggaagaaggattcatgaaaagggagtaacatcaacttgtttttagtaaaggaaacttacactttaccagctccttaaatgactgctgggatgttatggccatagtagataagaatacacactgagcatcccccaccctttttttgacagaaatgtttgtaaaaaattccaaatagtatctgaggttagcattgaataatagaagttctggaataagtgactaatggcctggcatgattaaaagttggctagatagcaggaaattgttactcattagtggaatattttaatttcaaagcactaggatgtacagtagttggtgttgatgttaattaaaggataagttctaatcagttattttgcttttttgtaacggtaattataactttagggagagttttattcaaggtaactggtgtaatttgacttcttaatcatgaaattcatgtctaggaactttctaaagactgaatatgtatctgctgtcactgcttgggttctagttcatgtctgctgttaatgactggattacatattgtaattctgtgattttttattttctataaaataaaggaattaaatttaatgatctcttaggtcccatatcactccaaatactctgttaaatgcagttgttttacaaacatatgcatttaatgtaaaatgtgcttcagaacgctttttccgtataggtattgaaatagatatgttgtttgcagacagattgaggcatttccagttaatgattttatgtaacctgtcataactcgtataatgaaacaaaccttgtgctaaaagtctgacatattggattaatgtcccagtcccactgtggatgaggtgattaacctctctatgcatcagttttgttacctataactctaaacagtcatctctgcacagcacacctttgaggggcaaatggaataatatatgtaaagcattttgtaaattgttaagtactctgtaactttaggataatagtaattggaaagaacatagaaagacagagtatcgatgagaattcaatagtcagcattaaaggagattaaaagtgaagataaaagcttaactttatgaagcaaagtttgaaggttttttcaaaatagacaacagaaatctttaggataatagtaactttaggataatagtaactttaggataatagtaattggaaagaacatagaaagacagagtatcgatgagaattcaatagtcagcattaaaggagattaaaagtgaagataaaagcttaactttatgaagcaaagtttgaaggttttttcaaaatagacaacagaaatccatataatattcagttagatcatttaaatttgcaaaattagaaaatcttctttatatgaccagattgtaaggcatctgtaatgatctggttaaaactaaacttgcactaaaatattttaaagcaaatgtaacacatgttcattgtcaagaataagaatacataattgactgaaataaaagtaaatttactttttaacccttctcttaatattactttctagagataaccctcattaacaaacattctgtgtatttgtgcattcagaaataaattgttgagcaaaattctatatggcatatacaattgtgtattcattgtgctaagtggtgaggatgaaacagctaacaagcagacatgattctctgccttcatagtgcttattgtctgttagtagagacagacaataagcaagtaaatgaataattataccttttattgtctacttaaataaaagtactactctgataaagaattattggggtagagtggaagttattttaaataggttagacacagagggcctttctgaagtgatatttaagttgagacctgagggttagaaggagcctatgcgtgtgtgttttacacttacacatacatatacacatattcatgtataaactttttatttgcagaagtgaaatcatatttttctgtgacttttgaaaacagtgtcttatggacatggtagtccttatattacaggtttatctttttcattttttttaaactgatctatacttctcagactagagtatgaggaaacatagttttgagttcttgaaacattgtaaatttttttgagatgcagtttaagaataatttaaaattcacacaccctttcatcaaacaatcctatttataataatttatcttacagatatagttactaagtatttaaagattcatatgttagactagcataaatctctaagtaacctaattgatccaaccaataagggactagttaaatacagaatagagtggaatactaggaagctgttaataagatgtatggaaaaatatccaatttatattattaataaaaacaagttgcagaaaagtatgtatactctgatttcatttatggaaaagagaaggaaagatataaatgtctgtgtccttgtatgtgtaagaaagttttgcaagtctacacagaaatctattaatgatggttatagctgaggaatgggattggaaaaacctgaagatgaggaggaaggcaaaaataatacatttgaaatttttggaaagccaaataaaaacatcaattagaaattaaacttggaatatttaaatctatacctggtgatttctaccttgttcaaggtagttataaactttttgagtttttatttcttgaaacaaaatgctataggagaaaaaatagtttaataaaagtatttggcaacagtctgcaaatgttagttaatatagcatttttttcctagaagatgaatcatgtcatataaatgctgaggtggttaagtataatttattaaaattttaaaaactaatttgttttgttaaccaagtacttaatatgttgagtacatgtgctgtgtaaatagagattcacagttatctagcagataccctattatataggctattaggggagataatgtaaaattatagagtctagctagaatagaccttagagagctgagtatttaatttagctgagctggaaactcagttaagtgacttgccataaaataactagttggcatcagagtcaggactgatatcttggttttcaatttcaaaattcactgtatcactttagcaagtttaatgttttcaagacaaaaatttatgttcttttttccgcttatgttctcttaatttcaagttcagtcttttaagtcagtataaataagtgttattacttactgacaaggttggtcagatgtatcattttgctaggatgaccatacatctagtgtgcctaagacaatcccccagcataattaccaaaaagtgtctcctttcacttttagtagtatctggttgtggacaacatattccatggtcaccccaattgttgctaatttattgaatctgaaagattctacacagtgccagggtaaagattttggattatgaatctaaataattataatgcaagctgtgctgaatgccaaagcgctactctaattctaaactggaagaaataatttctgctaggtttgacaggcaagggaggctgattgaagaacgtggcatgtgagccgagcctagaaggatggatgggattatagattagtcaggttacatgaagatgggaagaggtgtatatgcaagaaggctcaaagtgcatttggagaatagccagcatctcggtttaccagtgttgagagaagtatgagtacaggaatatacatctgggaaggtgtgcagagaccagattatttaataccaagtcaaagggttggaatttgttgagcagttggaggactccagcagttttcagttatgtagcactttaagaggattaatttattagagatgtgttgagtggctttagagaggaaaatatggaatctgtcctaccatttagaaggattttgtaccaaatcagatgtgatgtttaaggccctggactagtttatggcaatggagagagagaggctttctttttattccctaatggctttgtattagttcatttgcattgctataaaagaatacctaaggatgggtaatttataaagaaaagagatttatttggctcctggttctgcaggctgtacaagaagcatggcaccatcatctgcttccaatgagggcttcaggaagatttttaatcatggcagaaggcaaaatgggagcaggcatgtcacatggtgagagaggaggaggttccaggctcttttaaacaaccagttctcaaggaaactaaccgagtaagaacctactcagtgcaagaaagacatcaggccattcctgagggttctgtccccatgacacaaacactctccactaggctgaccctccaaattggagatcaaatttcaacatgaggtttggaggggacaaacatccagacgatatcaggcttatacatggtacatatttattacatgttggatagatgtttctacaaaagaagatggcacaagatttatgatttattggatacttaggataagagagaagaaaacattagagttttacactaattaaaagtagagggattttctgtataagtgtaaggatatgatctttgttctacttagcttaaggaggtttgtctccattaattttgagttatgctataatgaatgctgtttttagatagctttgaagaggtagacatataattaaagtatgaataatttgtttgatgttgaacatcaatttcatctttgccaaaggtcatggactttaagaccagaatttctgaggtccacataataatttaatgactcaatgataatttttggtgttaaataaaagtcctgcagatgacctttctggacacaaagttgaatttagaattatcaaagagcaagcttgaatttgaatttgatgctattattttgttataaagaaagaatctattatgcagtgctaaaacaccagaaggaagatagtatgtctgaatatcttttaattggtagttatatttaaaagatgctaaattatacaataatgtcatagttggcaaaatatcatttgagtctgaaagatatcactgacaatctggctgcttatagactagctttcatatagtttccatgctgcgtctgtgtgtttttcattttaggttatagtgttgttggcaatgagaatatctcccaattgatgcatgcttaagagactaccagaaataaaaagtataatataatttgatatgcatttagagaaatgtttttctttagtattaacattttaaatgttactactgcctcataactgctgtaatagtgttttaatattttagctgtatgagtatttctcataaaaacctttatttaccaccagaattattgcctgagtttccccttatatagcatgtatctgaacattgtagaccccaaatgataaaataaattaagagactttttggctagattctggtttggtgatgattttttcctaattttagagttcctcttcattttacactcttttacaaatttgagtagttgtagtttattatagaatagttttgttaaaaatctcaattagggactacttttcaaaataatctcaggaaataaaaactgcttgaatttggacttctgcatcttaaaaaatgctaatactatttctctgtcaactacatcctagaaaattggtttatgattagatgtcatgtaaatcactaagctcattgaaagtcagtttttcttttttattggactgaatgggtaatgagcagaaatacctttctgctttttgtcttcctcctttcctctgggatgtgggaatcacattgaggagacagcatttggtttaggatgaaaggagagaaggctatcttttttctgggcccactgctgtggtaggtgcgtcattaacatctgtcacaccttttttaatgagtgcttttgatgtcaggaaaaagtcagatgacttccttaaaattaaaacatctctcttgcacgcaagaatgggaggagtattttgtgttcattttattttataacttcctccaattgtttatataagtcatttgttgaaatcagcagttcactgcaagggctgcttatcagaacctacacatatttaaaactccccagtagtgtgttcctatcagattagtacttctctgcctttgagacttggttccttagaggagaaactccagtgtctgtgagattattcacatgcactttattcccttgccagtgaaattgtttgaatactcaaaacatgtagccttggctatttttgtgagtttatgttcacattgcattttggccctaatgagtctcctagctattcatcaaccatgctcatggacatttcaggtattagagtagctttgaataatttcattttgaagtgtgttattctctcaccaccagggagactacaaaccaaattcagaagcaccaacttcagttaagctgagactgctggcaaatcctattaggtttccctagtctacttcctctcccttctctgtatgtcaatatttgaaaccttcttgcctctcaagcctataattctcttacttcggcagatgatcccacatttcccattcattggaatttaagatctttttacgatctcatgcgtggtcagtttttttggtgacagttctatgggtgttaagtttgctgcatattatagtttgtaaatatctattggattaaacttaattgtgttcttaaaattcattaaacgcttacctaatttttgtctaccttatctgtcagtttctaagaaaatatgtttctaagaggccaggcaacggtggctcacacctgtaatcccagcactttgggaggccaaagtgggcagatcgcttgagctcgggagtttgagaccagcctgggcagtatgttgaaacctcatctctataaaaatacaaaaattagccgggtgtggtagcacgttcctgtagtcccagctgctggggaggctgaggcaggggaatcacttgaacctgggaggtggagtttgcagtgagctgagattgtgccactgcattccagcctgggtgacagagcgagactccatctcaaaaagaaaaaaatatacttctaagaaagtatgattggagatttgttcaatgttttatttatattattgctttatatattcagaagctatgttgttaatgcattaggaattatgacttaccttcctggtcaattactccatttcatcaaatctaaggtaccatgcattatgagatacaacctgattgcagagatgttaaaatatggaaaaggatcaagaaaacatggtatttgttttatcagcaggaaacatttgtgttgtcctagttaattcttgttgctttcaactttgttttgtctgatactgacattattatacctacctttttttttttttttttgagacagaatctcattctgtcacccaggctggagtgcagtggcgcaatttcggctcactgcagcctcttcctcctgtgttcaagatattctcctgcctcagcctcccaagtagctaggattacaggcacccactaccatgcctggctaatttttgtatttttagtagacacagggttttacaatgttggtcaggctggtctcgaactcctgacctcaagtgacccacctgcctcagcctccctaagtactgggattacaggtgtgaacccccatgcctgtccatgcttttataatagcattgactgaaatatattttctattctttcattttcaaacttttggtgttcttttgttttagggttatcaactgtagaccactttatacttactgtccttaggagttctgccatcttgattttttctttctatttatcaaatggctgcctttaaaaattcaacgtatttagccatttttttttctagcagcactcaggattcatcatgataccttttccctcaccaaacaattaaaaagaacttcatcctttcactgccctgtttctcatatactgtacattgtcctaaactatattctctgggctataatttctactttcttggattcatcgttctttatttcacttgattatattttatgataaatttctcagagtatgtgagaagtaaatattcaaaactttgtatgtctgaaaatatattatttgcccttatatacagtttcatcatcttttagcctaatgttaggaattcagtttctcattcatttcttgattttagatgacttagtttattctctgaaagcttttggtttttttttttatttgaatttaaagaataaaaccgccagtttcatattgtccagattgagtggtttctttaaagacttgtatctgtttaggtccagaaaaatcttatgatgtatctgtttgattattgttcttgctacttattctgttagctcctcttagatttttgcttttcatgccatctgctgctcttaagtgttgtatcctgggaaagtccttagaattactttctagtccactaatttcctcttttttctttttgagttcaatgtgcttttctgtctatattgttaagaaactttatcttaggattatattagatttatagaaaaattatgaagataatacagatagttctcatatatcctacaccattttcccctatatttaacatcttaatatgataaatttgtcacaaataaccaacattgatacattttttacttacaaaagttcaaactttattcagatactgttagcttttctttttctgttccaggatcctatctaggatgccattattacatttagtcattgtgtttcattagattcttcttggctgtgacagtttctcagacttatccttgtttttgatcaacttatcagttttgaggagcattggtgaggtattttgtagaatattgctcaattagaatttgcctgatattttcttaagagtagactgggatatgggtttttgagaggaagaccacagagataaaatactgttctcatcacatcacattgagggcacatgctctcaacgtgacttatcactatagatgccatccctgatcacatagctaaggtagtgtttatcagatttctccaccataaagttacttttttttatcctttccatactctatactttggaaaaaagtcattatacactgtctacatttaaggattggagagttatgctctacctccttgtgggctaagtatttacatagactattttgtattctacacagaattgtccatccttccccatttactcatttattcaatcatttgctaatattttcttaaggattgttacaacatagatgtctgagttttctggtaatgtctttgtctggttttggtattaggataatgttggctttcttggtatatttgtgctgctataacaaaataccttagactgggtgatttataaaggacggaaatttatttctcacagttctggaggttgggagtctaagatcaaggtgccaacaggtttggtgtctggtaagagcctgtttaccacactctgtaagagtctaagtccttgtttccaagatggtgccttattgctccaccctatattggggaggaacactgtgtcttccgtggcaaaagggggaccttcaacctcaaaaccttttataggggtgctaatctgatgtatgagacagagccctcatgacctaatcacctcccaaaggccacacctcttaatactgctacactgaggattaagtttcagcatgaattttggagggaacactgtcattcagatcatagcactggctttatagaatgaggaaatgttccctctgtttctgttttctcgaaaagattgtagagcttggtattatttatccttttacggtttggtagaattcaccagtgaaactatctaggcctagtgcattcttttttttgaagatctttaattattgattaagtttgtttaatagacatagggctattcaggtattcaggttatctgtttatccttgtatgaatttttgtaatttgtgtcttttaagaaattggttggcccagagtggtcgcttacacctataatcacagcactttgggaggccgaggtgggcagatcacctgagcttaggagtttaagaccagcctgggcaacatagcaaactcctgtctctaccaaaaataaaaagaaattaagagagagagggagagggggagggggagagggagaaggagcaggaaagggaaggggaaaggaaagggaaaagggaaagggagtctctagagagagagagagagaggactgaaagggaagggaaatgggaaagggagtctctagagagagagagtggaatgaaagggaagggaaaagggaaagggagtctttttcatctaagcgggcatagagttgtttatagtattcccttatcttttttttttttttttttttttgagacagggtctcactctgtcacccaggctggagggactgaagtgcagtgtcatgatcggggctcacggcagcctcgacttcctgggctcaggtgatcctcctgcctcagcccctcaagtagctgggtccacaggtgtgtgccaccatgcccggctaatttttgtatttttggtagagacagtttcgccatgttgcccaggctggtctcaaactcctgagctcaagtgatctgctggtcttggcctcccaaaattttgggtttataggcatgaaccagcgggcctggccttcctttatccttttaatgcccatgaaatgagtagtgttagcccctctttcatatctgatattagtaatttgtggcttctctttctttttcccttggtgcctggctacaggtttaacagtctgttgatctttataaataactaacttttaatttcattttattttctctatttttctgttttcaatttcatttatttctgctctaatttttattattccccttcttctgcttgctttaggcttaattttctcttctttctctagtttcccaaggtataatctaagtttcacttattttcattcagttcaaaagattttctgtttttacatctagctccctctttggcccatgagttatttagatatatttatttccaaatatttggagttttccagctatatttttgttacttatttctaatttaacgctactgtctgaaaacatactttgtatgatttctgtttatttaaatgcgttaaagtatattttatgtcccagatgttgtctatcttggtgaatttccatgcaagcttaagaataatgtgcgttttgtcattgttggatggaatatgctataaatgtctattagatcaattgatatagatgactgttcagatcatctatatacttagtaattttttttccttcttgatttatcaattactgacagaagggtatttaaactctccagttattacagtgaattttgcctatcctcttgcagttctgtcagttttgccttatatattctggcactcttttgttgggtgcatacatgtttaggattgttatgtcttcttggaaaattgacagctttatcattatgtaataccttcctttttctctgataatcttccttgttctgaagtctgctttgtctagtattaatatagctaattaatatatcaatataacaatgtaataaaggtattccatctttcttttgattaattatagcaagctatatcattctttttttttttttttttttttttgagacggagttttgctcttgttgctgcgcagcctggagtgcaatggtgcaatctcagctcaccacaacctccaactcctgggttcaagcgattctcctgcctcagcctcccgagtagctgggattacaggcatgcgccaccacacctggctatttttgtgtttttagtagagacagggtttctccatgttggtcaggctggtctcgaactcctgacctcaggtgatccacctgcctcagcctcccaaattgctgggattacaggcatgagccactgtgcctggcctccctttactttttttgtaacttttagtcatgtggctttttaatgaaagggtatttaaactataatcactaatacatgaagatcttcaaaaaattatataatagagatcctcctattcagaattttgaagtccttgttttaatctgtaacaaagagctgttttgaactcagctgagcctccttggatggggcataagaggagcatctgttatctgctttcaatccattgcccctttgtccctttacaagttaccttacccagaattgcctgtgctcatgattctttcgttctagctatctttgttttctacctcctcctctctgacttactttcttctcctgctaatattttcccccattttaaaaaattacagtaaaatgtacatagccctaaaattaactatcttaactattgtgtgtatttccttggcattaagtgcattcattctgttgtgcagctatcactgctatccatctcaagaactcttcatcttgcaaaactgaaactctgtgcccattcaacaaagactccacatccttccctcttcccttttaccttctatttctatgatcaggactattctagccttatataagtagaaatcatacagtatttatctgtttgtgactggcttatttcacttaccataatatcctcaaggtacatccatattgtaacatatgttagcatttccttcctttttaattctgaataatattttgttacatctatataccacattttgattatctgttcatccatcattagacatttggattgtttccacatttcagatattctgaatatggatgtacaaagatctctttgagaccctgctttcaattctctagtgtatactcagagtggaattgctggatcatatgataattctattgttacttttgagaggaacttttatactgttttcacagtggctgtaccattttacatgcccaccactgatgcagaagagttccaggttttcagtatcatcaccaaaacttattactttcatttttcggggtgttttttatagtggctatcctagtgggtgtaaagtaattatccctttacttttactctgaatctttatatttaaagtgaattttcttgtagacagcacatagtttgtcttgttttttaatttactctgataatccctgtcacttaataggtatatttaggccagttacatttaaagtgattgttgctgtaaccagattaatatctaccatgtttccaactgttttctttctgttcattgcattggttattggtttcttttctccctctttttctgccttcgtcagttttgagtactttatataatcttatctcctctctcaaaattttgattatacttattttaaaaatttttagtggttgccctcagttttacagtatacgtttttaactaacctaggttcttaagacaacactatactgcttcatttgtactataggtattttataagagtattcccaattcttccctcccatcccttgtaatagtgctgtcatttatttcacttacccatatgctgtagctacccagtatattgttactactattgctttaaacaaatcattaccttttaggtcaactaagaataagaaaaataaaagattttattttacctttgctttttccttctccagcactctttctttctttgtaaatccaagtttctgacctatatcattttccttctgcttgaagaacttcttttaacatttcttgcagggcaaattatctgctgattgattctccttatttttgtttgtctgagaaagtttttatttctcattaacctttgaagtgcaattttgctggatatagaatgtaaggttggtgggtttttttttcagcactttgaatatttcactacacttaacatggcttttgacatgctctccactgtaattcttatcattattcctctggaggtagggtggttttttttattctgccgtctttcaagattttcgctttgtctttggttttctgcagtttgggtatgatgtgcttaggtgtagatttttaaaatatttattgtgcttggtatcctctcagcttcttggatctgtggttaggtgtttgtcattaattttggaaaattctcgctttattctctcttctctgatattccaattagatgtacattccactttttgataatgccccatgattttggatattctgtttttttcattcttttttctctttgcattttagtgtaggaagtttctactggctgtcctcaattgacccattctttccacacccacgttgaatctactgatgagcccatcaaaggcatgcttcattttttctttgtagaattccttttgattctttttttacagttctgtctctgtgcttactagtctcttcttgcatgttccctacttattttcattacagcccttagcattctagtcatagttatttgaaataccctggtgataattccaacatctttgtctttttctgatggttgttttgtttcttcagactggggtttttcttgtttggggcatgaaaatattataatttcttgttgaaagcttggtgtcttgtatgcagtaataagaactgagataaataggcctttagtgtgaggatttatgttaatccagctagaagttgggttgtgtgtttaatgtttgttgtagctataggttatcagagacttgaagcttctttagcgtacttgattttttgtctctactcttgacttcggaacttccctaagtattactcctcagagggagcctttttcttgcagttctttcagctaatagttgtttccgctattattcttgagcactgtttgtataatgttaagatgtgagggagaaggacatgctatgatctttgattaagtctcaggttttcagggggcttgtcttatggttgtgaccttcacaagtgtttctccagtagtacagctttcttccccctgttccctattccctttcccatctgtagtgttcccaatctatttcctgaagcccctgtcctctcttgactatgggttgtcgtattctcttctaacccccacttaggtcaaacaggaaagctgaagaaaattggaggaacaaggaatttctttcctctagctgggataagctttcacaattaattctctggaacaggttctgggcatgtttcatgatggttactcttcctctccccctgccagagacaggagggaatcttttggaatcctcgtgatgacaacctggtaaaattcctggagggaatgtccacagaaatgtagtcacccctaagactgtggcccccaggattttttcattctcacaatagtccacactcaacctctagcaatttgtaagattaccttttaagtgttcctaccagtttatgtctcccatggcttctgcttcatgtaagcaaatcttggttgctgtatgtctctgaatgcacctgtctctacagtttggggtggggatttgccctgcaatctcatttctctagtgagtccaggaaagtcattcattttcaattttccagctttttcttgtaagaatgaaaatgatgactttcaagctatttacatgccaccattgaaactggacatctctcctggctatatttttaattttcaacatctgtaattttttttttgtttttttttgagtcagagccttactctgtagcccaagctggagtgcagtggtgcgatctcggctcactgcaacccctgcctcccaggctcaagtgattctcatgcctcagcctcttgagtagctgggctacaggcatgtgccactacgtccagctaattttttgtattttagtagagatgaggtttcaccatgttgcccagggtggtcttgaactcctgagctcaagcaatctgcccaccccagcctcccaaagtgctgggattacaggcatgagccaccacacctggcctgtaaacttttttttataacagcttattcttgttttatggtattctaatattgatatctcttgaagttttctcctgtttccttatttgctgtttcctttattatttctcttgttgaattttatgcctctctttcattgtgttaattgttaattctagattgtttagctttctatacatatttgcctttgattatccctatattaggttgttgataggttgttgacctatcacaagtttattcataaaagtttgtcataagcactctttttggggaaggaggtttaaggttttgtcccaagaaaaaaagctagggtagcgtgtggctcaataggagcagaagcagcagtatttctggctcagactatccaaaaatagtttgtttttgttgttgttgttgttttgttttgtttttttaattactcatgtattttctcatgtcctttactctatggaatatctctggtcttgcttatctgctcatttgaaaacttttttcctctgccagatttagctgtagattttctctatttttttgttttcaccaaaccactttctatcgtttaagaattcttcaacattttaattttaagaatggcattttcttttttctttttcgtgtgtgtgtgtatgtgtgtgtgtgcgtgtgtgtgtgtgtgtgtttagagagacagggtttcactttgttgcccagactggagtgtggtgaagtgatcatagctcattgcagctttgaactcctgggctcaagcaacaatccccccatctcagcttcctgagcaggtgggactacaggtgcacaccaccacacccagtgacatcccttgttatacaagtagttgtttctgtaattttaagagattttggttggaaaggaaggtagacaagtatggctcaatccagcttgatccaatcacattcactttcaattaatgaatagatttgttactattagtagtggtaagttaatattaattgagcatttagtttatgccaggaaacatgataaatcctttaactatattttaatcattacttaaacacagtaaagtagatattgttactatttgtatatatgtttaagaaaatggaaacttaaaaacattaaataatctacacagcaccacacagctaatatatctgttggagctaggatatgaacccaaattctatcccagcaaactcaattaacctcagttcctcactcacctgaaacttcctccctcaagttgatttgctaataagatgcctcccttctaccaggccaaatcctgtgtatcattcaaggcccagctttaaatgccacctcagcagcagtgctctgggcaatattccagcagaaagaaaactcttaacttttaatttaactttacatttatttgacctcttgtctagcactttctactttatatgtaatacagtcatttgatgcatagtttcgtccctactgcacaatgagatcactaggaaaagtgtcaatgtccttgtgtcacttatttttacaattcccagcattccccagcatgtaccattttaataaatattattaataagtaattatatttattcagtttaacttctttaatttataaatgcatccttattggctcattataaatatttgcatggattttatttaaatatgattaaaggatcttgagcatatttgttttaaacctgtctttgggattaatatttatgaatatccaggaaatggcaaatagttttagaactaattagatagaggcttctcattatacttacgtcaataaagatatctgaatatgtatgaaaatttcaaggagattcaggatatttgggagccatttgcatactaactaaacattttgatttttccttctggaagttaaataaaatggattacaatatggaaggtgattcccaaattaaaagtaggcatcaaataaatcattgcttttgtcacataaaccttgaaggaaaatagcatatctgtcaagtcttaaaattcatgtcagaatttcacaaagcaattgattataagctatctttcttttaaatagtacgtagcaaagaagtttgtgccatttcaaataagtgacatgtcagacatggagtccctgagatttattagcaagaccattttgttctgtttcagaaaattacagaattttggaattacaaattttacctgtacagtggttatctttacagtaatccttaccattttctagtgatagggtattctttctcacaagacatcccattctagtgtttagtagaactttattttttttaaaaactgttccttattttaaactaaaatctgcctgttttctaaagcttcttttttacctatactttgaacttacagaatctataaaaatcttaagattggctaggtgtgatgactcatgcctgtaatcccagcactttgggaggcaggggcacatggatcacttgagcccaggagttcgagaccaacctgggcaatatggtgaaatgccgtctctacaaaaaacacaaaaattagtgggacatcgtggcacgcgcctgtagtcccagctgctcaggaggctgaggtgggaggatcacccgagcccaggaggtcaaggctgcagtgagctgtgattgcaccactgcactccagcctgggtgaaagagtgagaccctgtctcaaaattaaaataaaataaaataaaaataaaaacaaaaaaccttaagattttcatgctaactcccatgacagcagttgtcaagcataatgggatagggcatagggagtggggatatagttctttctctgagtctcctgagagcagatgtttataaactagattgtgacaggataagtggatgctaattctgaatcatcaccaatgtgtagtattattcctctgctttagttttcttttattcattatcattatattttaaatttggaaaaagttatgaattgtattagcttgggaagggaagaataaatatgtcttttcttatacttctcatttatgagcttcatgaaatatgactaatctgttgagagacaccattgggaacaacctgtgtacagcctgaactcattgtatctgccatgtatttttcagtggctcctttacatgacagattactctcaggagcaaataatatgcagctcttctcacattttgttagtgtttttatttttaataaagtgctatgattaatagcctagtgttattgttgtttccccattgagtgtaaatgcttcatttgaatgtctttaatctgaaggaacagttgttttattggactcttgttatttttctgtgcttctcaaggttttttgattgctttctttgagctctttgcaatggaggaaatgaactctatcagaatcatggagtaggactccgtagagaaattttgaggatgaatactgagatacttgaacattcatacatacatttttatgataatttcagaatggtagacacaccattagcaattctgattgactctccagtggcaattataaaagtagcttggccgggcacggtggctcacgcctgtaattccagcactttgggaggccgaggcaggtggatcatctgaggtcaggagttcaagaccagcctggccaacatggtgaaatcctgtttctactaaaaaacaaacaaaaaaaagcacaaaaattagctgggcgtgggtggcaggcgcctcccagctactcaggaggctgaggcaggaaaatcacatgaacccaggaggcggaggttgcagggagccgagatcgcaccattgcactccagcctgggcaacaagagcgaaactctgtctaaaaaaacgaaaaaaagtagcctatgtctggcctactggtattgtgatgacattgccatatagatcctatctgaagtgccatgtgctttcaataagtctttctgttgttgttgttgtttgcaaatcagagttaaagtataagacaagacaagaggtggacacaaaaggactattgaaaagttgagaaattgtgaactgagcttttacaagaatatggtgcccacttaccaagaggacagctcttcttgttatttttgcccttgaagtggtgataccctttagcctagtcatttctgcatttactcccaggagcctggctgtgattagaagtgtttcctgtagccatagaccaattttccttttgttcaagaatccagaaggcaagttgggcctcattggcaccaaccatcaaggacttcattagccctaaccaggggccaactaaattgtcaaattggaaatgaaggactttacatgaattcaaagccactgataagagagcttgaaggcttatcttgtgaaactgagtgttgaatgcataacttttatttgagaaagcaaataacttgggtggaacttctacaaattagagcaaaataatttaggatttatttggaggtttaatagcttgttaggtgtagccttgaatatgtagcataacatatgcatttatattatatacttagaaacattctggtctttttggttaataagagtattacttttactggctcttagattgtttcagaggaattagagctgtctagttttgtataatcaagtctttattttcatgtaaactaagtaagttctgtttagaaagtcagccccagaaggtttatttacgcactatataagctcatgttttaagattctccatatccccaaaattaacatttttgtttgtaagtgttctgttagtttttagtcattgaagaagcatttattgaatgtatagtaatattactttctacaaagaaaacgaatgtcataacataaaaatacataaacattttttacaatgaccagagcttagaaatactttaaatacagcattttttaaaattacagtggtacttctttgaaagaggttgtctgataattattgtaatatcttaaaagcacttggaccttacttctggccatgaccgaataactagtactggactaggcctcttgctgtaaacagctagaaaattagacaaaatatatggaatacatgtttgtagacatttgaaaacatgcagaaccatgatccctaagactaaggaaaacaaatgggatgagccccataattgccctcccagctttccgcttggagccacttttctgtagcataagatgccccatttatgaacaggcagaagggagcagacagcccagcagtctcagtgagactgagatcagagtttaggtgtagaaaagtaggtggggccgggcgtgttggctcacgcctgtaatcccagcactttgggaggccgaggcgggcggatcaggaggtcaagagatcaagaccatcctggccaacatggtgaaaccccgtctctactaaaaatacaaaaattagccaggcgtggtggcacatgcgtgtattcccagctactcgggaggctgaggcaggagaatcacttgaaccagggagtcagaggttgcagtgagccgagatcgcgccactgcactccagcctagcgacagagcaagactccatctcaaaagaaaaagacaataaaagtaggtggaatttgtgcagcaggctactggagagaagagaaatatgcagagaagaagcccaaggaagctatatagggttccccttgagtcttttgggtctcacattacatttagtctccttcagtttgtgatagttcttcagtctttccttctctgccatacccttgacacttttgaaaagtattggtcaggtattttgtccagtgttctcagtatggatttgtctgatacttttttgtgattacattgaggttatggattttttttggaggaataccacagaagtgatgtacccttttcaatacattcgtatcggggtacatgatatcagcatgtcctgttatttggtaacgttaacactgatcatgtggttaaggtggtttttgccagtcttcttgcagtcatctctgagcccagagcctctctgatttatttagtttctcctgagtgtaaatctcctattgccaagggtgagggatttggagatttaaagctcttcttacaggagctttcaaataattcctccatcccccatatcatcctttcctcctgaagtgctgctgattcctgaaggtcagttggcttgaggctcacctgtctgtccctttggaggtacttagattgactctttcccgtgaaataatttacttttcttctatccaccttcttctttcatatattatagattaggattacaatccaaaatatctctcagttttatcagaaatggagtttgtgttcctatttcttgtcctgtttgttgtttgggtgtatttatgaagtggtggacccagaaatgtattcgaccttccatgctaaaactgaagctaaaaatagctttttcagaagacagtatttggcatcatttctcaggcattcaaatacaaacttttgactcagcatttccacttctagcaatttgtcttacagaaatatttacacatggacccaaagataacatgtataggaaagtttatagaagcattgctgatagtagcaaaaaaaaagtaatggaaacagcccaaaaaaaaaggaaaaacaagggaatgattaaataaatggtggtatatctatattgtagaatactattcagcaattagaaataatgaggtttgtctttatgtactgttatgggaacctcctaaagacattacatcatatagcagtttgtaaagcaacatgtttggtatcatttcattcccatatttatgtgtatataaaagtgtgtcattgaaatgaaaaatatttgaaagaatatgcgccaaactattaatagcagtgttttggaggtcatcaaaagggaaccataatctttgtatacttcttaaactttgtatacttctgtaccatatgtattatttttataacaagcatattgcattttgatttttcaataaaaagatgaaatagactacctacagcagtagttgagcaaccactggaggttttcaggcatgggctctttttgttgttgttgttgttggttgaatttgaatgtcattcctgcattggtcatttattggatttctctgtagcatttatttattttcatttttccgtaagttattagggtacaggtggtatttggttacataagttctttagtggtgatctgtgagattttggttcacccatcacctgaacagtatacaatgcaccatatttgtagtcttttgtccctcgcctccctcccaccattctccccaagtccccaaagtccatatcattcttaatgcctttgcgtcctcatagcttagctcccacatgtcggtgagaacatttgatgtttggttttccattcctgagttacttcactttgaataatagcctccagtctcatccaggtcactgcaaatgctgttaatgcattcctttctgtggctgagtagtattccatcgtataaatataccacagtttctttatccactcattgagtaatgggcatttgggttggttccacgattttacagttgcgaattgtgctgctataaacgtgcacatgaaagtatctttttcatataatgacttattttcctctgggtagatacccagtagtgggattgctggatcaaatggtagttctacttttaattcttcaagaaatctccatactgttttccatagtggttgtattagtttacattcccatcagcagtatagaagtgttccctgttcaccgcatccatgacaacatctactgttttttgattttttgattatggccattcttgcaggagtaaggtggtagcgcattgtggttttgatttgcatttccctgatcattagtgatgttgagcattttttcgtatgttggccatttgtgtatcttcatttgagaattgtctgttcatatccttagcccactttttgatgggattttgttttcttactgttttgtttaaattttttgtcgattctggatgttagtcctttgtcagcttgttagtcctttgtcagattgtgaagcttttctcccactctgtgggttgtctgtttactctgctgactgttacttttgctgtgtaaaagctctttagtttaattaagtcccaactatttatttttgtttttattgcatttgcatttgggttcttggtcatgaaatccttgcctaagccaatgtctagaagggtttttccatgttatcttctagaatttttatagtgtcaggtcttagatttaagtccttaatccattttgagttgattttcatataaggtgagagttgaggatccagtttcattctcctacatgtggctagccaattatcccagcaccatttgttgaaaagggtgtcctttccccacttcacgtttttgtttgctttgtcaaagatcagttggctgttaagtatttgggtttgtttccaggttctctattctgttccattggtctgtgtgcctatttttttagcagtaccatgctgttttggtgactatggccttatagtatagtttgaaatcaggtagtgtgatgcctccagatttgttctttttgcttagtcttgctttggctatgtgggcttttttgtttgtttgtttcatatgaattttagaattgttttttctaatttcgtaaagaatgatggtggcattttgaatggggattgcattgaatttgtagattgcttttggcactatgatcattttcacaatattgattctatgcatccatgagcatgggatgcatttccatttgtttgtgttgtctgtgatttctttcagcagtgttttgcagttttccttgtagaggtctttcacctccctgattaggtaaattccaaagtattttgagttttgcagctattataaaaggggttgagttcttgatttgattctctgcttggttgctgttgatgtatagaagagctattgatttatgtacattaatcttgtatccagaaactttgctgaattcttttatcagttctaggagctttctggaggagtctttagggttttcagcgtaaactatcatatcatcagcaaacagtgacagtttgacttcctctttaccgatttggatgccctttatttctttctcttgtctgatttctctggctaggactttccagtactgtgttgaaaagaagtggtgagagtgggcattcttgtcgtgttcctattttcagagggaatgctttcaacttttccccattcagtattatattggctgtgggttagtcacagatggcttttattacattgaagtatgtcccttgtatgctgatttgctgctaacaattttaatcataaagggatactggattttgtcaaatgctttctctgcatctattgagaagatcacatgatttttgtttttaattctgtttatgtggtttatcacatttaattcacttgcgtatgttaaaccatctctgcatccctagtatgaaacacacttgatcatggtggattatctttttgataaattgttggatttggttagctagtattttgttacggattttagcatctatgctaatcaaggatattggtctgtagttttcttttttggttatgtcctttcctggctttggtattaggctgatgctggcttcatagaatgaattagggagggttccctttttctcaatattgtggaatagtgtcaaaaggattggtaccaattcttctttgaatgtctgatagaattctactgtgaaatctgtcttgtcctggacattttttttgttggtaatttttttttaattatactttaagttttagggtacatgtgtacaatgtgcaggctagttacatatgtatacatgtgccatactggtgcactgtacccactaactcgtcatctagcattaggtatatctcccagtgctatccctcccccctccccacaccccacaacagtccccagagtgtgatgttccccttcctgtgtccatgtgttctcattgttcaattcccacctatgagtgagaatatgcagtgtttggttttttgttcttgtgatagtttactgagaatgatgatttctaatttcatccgtgtccctacaaaagacatgaactcatcattttttatggctgcatagtattccatggtgtatatgtgccacattttcttaatccagtctatcattgttggacatttgggttggttccaagtctttgctattgtgaatagtgccgcaataaacatacatgtgcatgtgtctttatagcggcatgatttatactcctttgggtatatacccagtaatgggatggctgggtcaaatggtatttctagatctagatccctgaggaatagccacactgacttccacaatggttgaactagattacagtcccaccaacagtgtaaaagtcttcccctttctccacatcctctccagcacctgttgtttcctgactttttaatgattgccattctaactggtgtgagatgatatctcattgtggttttgatttgcattgctctgatggccagtgatggtgagcattttttcatgtgttttttggctgcataaatgtcttcttttgagaagtgtctgttcatgtccttcgcccactttttgatggggttgtttttttcttgtaaatttgtttgaattcattgtagattctggatattagccctttgtcagatgagtagattgagaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtaatgcctaggttttcttctagggtttttatggtttcaggtctaacatttaagtctttaatccatcttgaactgatttttgtataaggtgtaaggaagggatccagtttcagctttctacatatggctagccagttttcccagcactatttattaaatagggaatcctttccccattgcttgtttttctcaggtttgtcaaagatcagatagttgtagatatgcagtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattgccttgggcagtatggccattttcacgatattgattcttcctatccatgagcatggaatgttcttccatttgtttgtatcctcttctatttcattgagcagtggtttgtagttctccttgaagaggtccttcacgtcccttgtaagttggattcctaagtattttattctctttgaagcaattgtgaatgggagttcactcatgatttggctctctgtttgttattggtgtataagaatgcttgtgatttttgtacattgattttgtatcctgagactttgctgaagttgcttatcagcttaaggagattttgggttgagacaatggggttttctagatatacaatcatgtcatctgcaaacagggacaaattgacttcctcttttcctgattgaataccctttatttccttctcctgcctaattgccctggccagaacttccaacactatgttgaataggagtggtgagagagggcatccctgtcttgtgccagttttcaaagggaatgcttccagtttttgcccattcagtatgatagtggctgtgggtttgtcatagatagcttttattattttagatacgtcccatcaatacctaatttattgagagtttttagcatgaacggctgttgaattttgtcaaaggccttttctgcatctgttgaggtaatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcaggatgatgctggcctcataaaatgagttagggaggattccctctttttgtattgattggaatagtttcagaaggaatggtaccagttcctccttgtacctctggtagaattcggctgtgattccatctggtcctggactctttttggttggtaagctattgattattgccacaatttcagctcctgttattggtctattcagagattcaacttcttcctggtttagtcttgggagagtgtatgtgtcgaggaatttatccatttcttgtagattttctagtttatttgcatagaggtgattgtagtattccctgatggtagtttgtatttctgtgggatcggtggtgatatcccctttatcattttttattgtgtctatttgattcttctctctttttttattagtcttgctagcagtctatcaattttgttgatcctttcaaaaaaccagctcctggattcattaattttttgaagggttttttgtatctctatctccttcagttctgctctgattttagttatttcttgccttctgctagcttttgaatgtgtttgctcttgcttctctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagcagtcattcaagagcaggttgttcagtttccatgtagttgagcggctttgagtgagattcttaatcctgagttctagtttgattgcactgtggtctgagagatagtttgttataatttctgttcttttacatttgctgaggagagctttacttcccagtatgtggtcaattttgtaataggtgtggtgtggtgctgaaaaaaatgtatattctgttgatttggggtggagagttctgtagatgtctattaggtctgcttggtgcagagctgagttcaattcctgggtatgcttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatctctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttgtaattggagcatttagtccatttacatttaaagttaatattgttatgtgtgaatttgatcctgtcagtatgaggttagctggttattttgctcgttagttgatgcagtttcttcctagtctcgatggtctttacattttggcatggttttgcagcagctggtaccggttgttcctttccatgtttagtgcttccttcaggagctcttttagggcaggccttgtggtgacaaaatctctcagcatttgcttgtctgtaaaggattttatttctccttcacttatgaagtttagtttggctggatatgaaattctgggttgaaaattcttttctttaagaatgttgaatattggcccccactctcttctggcttgtatgtagagtttctgccgagagatccactgttagtctgatgggcttccttttatgggtaacctgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccctgtcattttcaggtacaccaatcagacgtagatttggtcttttcacatagtcccatatttcttggaggatttgttcgtttctttttattcttttttctctaaacttcccttctcgcttcatttccttcatttcatcttcatcgctgataccctttcttccagttgattgcatcagctcctgaggcttctgcattcttcacgtagttctcgagccttgctttcagctccatcagctcctttaagcacttctctgtattggttattatagttatacattcgtctaaatttttttcaaagttttcaacttctttgcctttggtttgaatttcctcctgtagcttggagtagtttgatcgtctgaagccttcttctctcaactcatcaaagtcattctctatccagctttgttccattgctggtgaggaactgggttcctttggaggaggagaggcgctctgctttttagagtttccagtttttctgctctgttttttccccatctttgtggttttatctacttttggtctttgatgatggtgatgtacagatggatttttggtgtggatgtcctttctgtttgttagttttccttctaacagacaggaccctcagctgcaggtctgttggagtttgctagaggtccactccagaccctgtttgcctgggtatcagcagcagtgtctgcagaacagcggtttttcgtgaaccacgaatgctgctgtctgattgttcctctggaagttttgtctcagaggagtacccggccgtgtgaagtgtcagtctgcccctactggagggtgcctcccagttaggctgctcaggggtcaggggtcagggacccacttgaggaggcagtctgcccgttctcagatctccagctgcgtgctgggagaaccactgctctctgcaaagctgtcagacagggacatttaagtctgcagaggttactgctgtctttttgtttgtctgtgccctgcccccagaggtggagcctacagaggcagacaggcctccttgagctgtggtgggctccacccagttcaagcttccgggctgctttgtttacctaagcaagcctgggcaatggctggcgcccctccccaagccttgctgctgccttgcagtttggtctcagactgctgtgctagcaaacggcgagactctgtgggcgtgggaccctctgagccaggtgcgggatataatctcctggtgcgccgttttttaagcccgtcagaaaagcgcagtattcaggtgggagtgacccaattttccaggtgccgtctgtcacccctttctttgactaggaaagggaactccctgaccccttgcgcttcctgagtgaggcaatgcctcaccctgcttcggctcgcgcacggtgcgctgcacccactgacctgcgcccactgtctggcactccctagtgagatgaacccggtacctcagatggaaatgcagaaatcacccatcttctgcgtcgctcacgctggaagctgtagaccggagctgttcctattcggccatcttcactcctccccctgttggtaatttttttttttttttttttttttttttttttgagacagagtcttgctctgtctcccaggctggagtgcagtggcgcaatcttggctcactgcaagctccatctcctgggttcatgccattctcctgcctcagcctcccgaatagctgggactacaggcacccaccatcacacccagctaattttttgtatttttagtagagacggggtttcaccgtgttagccaggatggtctcaatctcctgacctcgtgatccgcccgcctcagcctcccaaagtcctgggattacaggtgtgagccaccgtgcctggcggtaatttttaaattaccatttcaatctcgctgcttgttattgatctatttagagtatctaattcctgattaaagctaggagggttgtacttttccaggaatttatccatcccttctaggttttctagtttatgtgcataaaggtgttcatagtagtcttgaatgatcttttgtatttcagtggtgtcagttttaattattcctgtttcatttcttaatgagattttttggattttctcttttcttggttaattttgcttatggtctgttggttttatttatcttttcgaagaaccataaataaattgttctttgatgtaaaccaaaataaattttaatttatcttttgtatttttttgtttgtttcagtttcatttagttctgctctgatcttggtactttccttgcttccaccgggtttgggtttggtttgtccttatttctctagttccttgaggtgtgaccttagaatgtcagtttgtgctctttcagtctctgatgtaggcgtttagggctatgaactttccttttagcactccctttgctgtatcccagaggtcttgttagattgtgtcattattgtcattcagtttgaagaattttaaaatttccatcttgatttcgcttttgaaccaaagcaggttttgaacctgctctttcaggagcaggttatttaatttccatgtatttgcatggctttgaaggttccttttgaagttgatttccagttttattccactgtggtctgagagagtgcttgatataatttcagttttcttagatttattgaggctcactttatggcctatcatggagaaagttccatgccctgttgaatagaatgtgtattctgtggttgttggatgaaatgttctgtatatatctgttaagtccatttgttccaaggtatagtttaaatctattgtttctttgttgactttctgtcttgatgacccatctagtgctgtcagtggagtattgaagtcccccactattattttgttgctgtctatcacatttcttaggtctgttagtaattgttttataaatttgggagctccagtgttaggtgcatatatgtttaggattgtgatattttcctgttagacaaggccttttaccattatataatgtccctctttgtctcttttaactgctgttgctttaaagtttgttttgtctgatataagaatagctacccctgctcgcttttggtgtccatttgcatgcaatgcctttttccacccctttaagttcatatgagtccttatgtgtcaggtgagtctcctgaaggcagcagattgttggttggtgagttcttatccattccgcagttgtgtatcttttaagtggagcatttaggccatttacattcagtgttcatattgagatgtgaggtaccattacatgcatcgtgctatttgttgccagtgtaccttggttttttgttttttgtttttgctttttaacttgtacttttgttttatagatcttgtgtgatttatgctttaaagacgttctgctttgatgtgtttccaggatttgattcaagatgtagagctccttttagcggtctcgtagaggtggcttgggtagtggtgagttctttcagcatttgcttgtctggaaaagactgtatctttccttcatatgtgatgcttagtttcactggatacaaaattcttggctgataattgttatgtttgaggaggctgaagatagggccccaatcccttctagcttctagggtttctgctgagaaatcttctgttaatctgataggttttcctttgtaggttacctggtgcttctgtctcacagctcttaagattctttccttagtcttaactgtagataagttaagcacactgatgacagtgtgcttaggtgatgatctttttgcaatgaatttcccaggtgttttttgtgcttcttgtatttggatgtctaggtctctagtaaggccaaagaagtttccctcgaacattttccaaatatgttttccaaactttcagatttctcttcttcctcaggaacaccaattattcttaggtttggttgtttaacataatcccagacttcctggaggctttgttcatattttcttattcttttttctttgtctttgttggattgggttaattggaagaccttgtctttgagctctcaatttctttcttctacttgttcgattctattgctgagactttccagagcattttgcatttctataagtgtgtccaatgtttccagaattttttgttttttctttatgctatctccttgaatatttctctcttcacttcttgtatcattttttggatttccttgcattgagcttcacctttctctggtgcctccctgattaacttaattaacctcctgcattctttttcaggtaaatagggatttcttcttggtttggatccactgctggtgaactagtatgattttttggggggggtgttaaagagcctagttttgtcgtattaccagagttggttttctggttccatctcatttgggtaggttctgtcagagggaacatctagagctgaaggttgttgttcaggtactttggtcccatggggtgttcccttgatgtagtctctcccccttttcctatggatgtggcttcctgagagccaggctgcagtgattgttacctcttttctgggtctagccacccagcaagtctatccagctccaggctggtactgggggttgtctgcacagagtcctgtgatgtgaaccgtctatgggtttctcagctgcggataccagcacctgttccagtggaggtggcaggggggtgaaatggactctgtgagagttcttagctttggtggtttaatgctctatttttgtgctggttgccctcctgccgggagtttgtactttccagagagcatcagctgtggtagtatagagaggaaccagaggtgcgcggggtcctagaacttccaagattatatacccttgtcttcagctaccagagtgagtaggaaaggaccatcaggagggggcggggctagatggtgtctgagctcagactctccttgggcgcgtctccctgcggctgctgtggaggatgggggtgagttaatggagttgtgtacctaggagcattatggctgcctctgctgagtcatgcaggttgtcagggaagtggtggaaagccgcagtcacaggcctcacccagctcccacgcaaaccaaagggccagtctcattctcactgtgccccatctaacagccccgagtctgccagcagttggggagccaggcttgagaacttgccccaggctgcctgcctcccagctgtgaaagaaaagggcttgattcttccccagcctgtggagtctgcacacctgattcgcaccctttcccgagttctggccaggagggttctccccagcttcaaattgttacaaagttcagctggagatttccttctccctgtggtgtttttccccacactcctccggttgccctcccaaaggatccctgtggtgccagttaggaatggcctgcctggggacctagtgagctcccggggcctttctcgctgcttcctctacccctgtattttgcttggctcgctaaattgactcagctccaggtaaggtcggaaacttctccctcaaacaaccttcagtttctccagtggggatgtgtgttcaggagaggagaatctccctttcccacttccacagttggggcacttggggcactcacagtatttggggtgtctcccaggtcctgcatgagcaatccactgccttcagaatccacttcctgtgggtcctctcgggatttctggtttgttcttgcagtcaatctggagcttaaattcacagtgcgagcctccgcacactgctctgtccgtccaagtcggagctgcagtctagtcctgcctctcccgtctgccatggtgatccaaagaatgcctgcatgggctcttttaaagcggctctctgctagacagtatctcaggaagcatttaattcagggatggatccccagactggattactgtttggggaaatagggatttcatgatcaaataagaatgagaaatgctaggttaacaaacagaagaggtgctaggagtcattaacatactaatatgcatggcaaatctctacaatctcccaaatttgattgttgttctcttttttattttacggtatatgtgttaacatttcccaaaagtaatattctgtggaagtatacttttgttcacactgttactatgtttggagtaataagcaccatgtaaatctgactccgttctgaataatgaattctgaataatgttagagtgaacattcctgggaaataacaatttagtagattcctaatgaagggccagagagaaagaatatttcccatgatactttcctacctttcaaatgagcttagaaatttttaaagaaatttcaaaactattttcaaagaaaggttatgaaaaaggaacaaaatttggattccaaaaagaaaatgtaaatgtacctactcacagctgtagttggtgtgagtgggcgtcaaattaggataactggggatctgcttaaccaagggtgcaacatgcctagtgcagaatttaatgatctccaccttcagaaactttcaaatacatgtattggttaaactaataattatagactgttactaagtgacactttatcagtcacaaatctaatgtattgaaactggaaccgtcaaccacagcatagctagattttgaaagttaattctcagaaatattaggagcagctctgatgacttactcaatataaagccgggtcaggccgggcgcagtggctcatacctgtaatcccagcactttgggaggccaagacaggcacatcacttgaggtcaggagttcgagaccagcctgaccaacatggtgaaaccccgtctctgctaaaaatacaaaaattagccgggtatggtggcgcatgcctataatcccagctacccgggaggctgacgcaggagaattgcttgaacccaggaggcagaggctgcagtgagccgagatcacaccactgcactccagcctgggcaacagactccatctcaaaaacaaacaaacaaaaaagccagatcaggagaaacgtcatcattctttaggaacttccacggaacaattcaatttctgctacttacaaccctgtgcaggcccttaggtttcagcgactgggccagtgtgaagctgctgccaagcatttgagcagcaggtcagagcggacagcaatgctcacatttgaaaatgtaataccttttctcaaatagatttcccagtggcctttggcttgattcagatttacatggtgtttacatactgttctaaacatagtagcagtatgaacaaaggtataaaagctgtaaagttccttcttgttaagtaaccaagcaaatcaagagcacatcctgtttaggaaataagcctagaaagcgaggatgggaccagtctggaggactttgaacactgtcctgagatgtttagacttattctggaggctgtttggtacagttacaatgggtgaactttatggtatgtaaatcatacttcagtaaagctgttgaaagaaagactggatagttgaaactattaaacatccttttttttcctagtgtaaaacagcaatagttacacagtcctaggacatttcttttgctcaaaacacctgagcttaaaatctgtctgaagtcttcataaaattaaagtgtccagaaattatcaaagacttttataaatgccaaccagtcatcaagggcccaaagcaaacatgaaaaatacagatctgtaggccacatgtagtaaaaacctttgtttcttagagtcaggctggttgctttcccttctgccaccagagtagttatctcattgcgctcttaatttacatttccctaatgactaatgatgtcattttcatgtgcttattctatgttttctttgatgaaatgactattcaaagctattgcctttttttttttaactttggttgttttcttaatgagttgtaagagttcattatgtattttgggtataagttttttttttttttatcagatacatgatttggaaatattgtctgccagtctgttgcttttcatttacttagttttgggttgttttttgttgttgttgttgtttttgttttgtttttttctgggttttttttagtgcagaagtatttgtttttaatagaatccaatttatcagggcatactttcttttatgtcttgtgcgtttgatgtaacgtataaaaattctttgctaactcaagacatgaagtcttctagaagtttagttcttagattaagactatgagatattttgttaatttttatatatgatgtgagttcattactttgcatgtggatatattgttgtcccagcaccagttgttgaaaagactgttcttcccacattgaaatttcttgacaccttggccaaaaatcaattgaccacaaatataagggtttatttctggacactgaattatctcattgatcgatgtgcctattcatatgtcttgattactgtagctttacagtaaattttgaaattagtaaattttgaagtacagtaaattttgaaatcctccaactttttttgttctttttgataattgatttggctattctaggtcttttgcatttcttctagcattttgcatttcttctagcatgttaatagttgccttattaacaactttgagttgttcaattcatgaacatggactatctatttatttagatcttctttaatttctctctgcaatgtgttgtaattttttctttgtaccagtcttacacttcttttaggtttattcctgagtatcttaaaatttatccctagatatttttgttaaatttatttctaagtattttaattctttttgatgctattgtgagtggaatttgtgaatggaattgatttcttaatttcatttttggattgttcctaaaatatagaactacagttggttttcatatcctccgaccttgctagccttatttattagttttagttgtttttttttttttcagtagattcatgagggttttctgcatagataattatgtcattcacacatgaaaatagtgttatttcttcctttcccatcagtatttcctttttctctttttcttgccattttgcacttgctaggacttttagtactaaggaatgagaaactaatatccttgtcttgtttctaatcttagggaaaaagcatttaatctttcaccattacatacagtgctcactgtaggcttttcaggttgaggaattttacttcttttcctagtttgttgagagtttttatcatgaatgggtgtttcattttgtcaaatgctttttctgtgtctagtgagataactagtggtttttcttttttctcttaatgtgatgtgtttaattgattttggaacattaaactgtcttgaattcctatgataaattctacttggtcatggcatataattttttaatgtgttaccaaatgtggcttgctaacattttggtaaggagttttatactatgatcataagggatactggtctgttgctttcttttcatgtgtcgtgtttctttcttttctttgtcgggctttgataacagagtaatactgaacgcacaggaatgagttgggacatgtttctccttctctatttcctgaaaaagtttgtgaaggattagtattatttctcttttcaaatatttgataacatccagcagtaaagccatttggacttagaattttctttgtataggaagatttttacttactaattcagtttctctattataggtcgttcagacttcatgttttttcttgatagatttggcagtttatgttcttctaagaatttttccccttcctctaatatgtctgattggttggcaattttttttcccaaaatattccattaaagcttttttagttatctgtagggttggtagtattgtactattgtcccttcttgtattcttgatttgagtaacttgtgtcttctcttagtttcctagtcttctacctgagatagaagcttaggtaattcatttgagacctctcttctttctgatgtaggtaaagcactacatttcccttaaagcaccactctagctgcatcctgtaatttttaatacattgtgtttttatttttatagtgttaaaaaattgtgtttttgaggcagagtctcacaatcacccaggctggactgcagtggtacaattatgacccactgcagcctcaacctcctgcattcaagtgatcctcctgcctcagcttctcaagtagctgggactacaggtgcacaccagcatgcctggataattctttgtattttttgtagagatggggtctcactatgttgcccaggctggtcttaaatttctgggctcaagtgatccaccacttcagcctcccaaagtgctgggtttatataggcataagccaccatgcctggcctgttaaaaaaatttttttaaatttttcttatgatttcttctttgaccctaggattgtttaagagcatgtttaattttcaaatatttggggttttctcagatttctttttaattctgtcattttttgctttcatattttggggcttttttgttagatatgtatgcatttataattattatattcaaagaagaaataacataattcaataataattgcagatttcaatattctgtcaaaaactgctaaaactattagacaaagttaggaaggatataaaatagttaaataacgctgtcaaccagcttgacctaactgacattatgaatcttcataatcttctttataagaatctgcagatacagatttttttcaggcacacatggaacaacctccaggatagaccacatgctaggacacaaaacaagtctcaatacattttaaaagaccaaaataatatatagtgtgttctctgaccacaacagaattaaattagatatccacagtaagcctgctgtttgtctggggcctgcttcctcttgctataaaagtagtaaacaggtcacatgtggtggctcctgcctgtaatcccagcacttttgagaggccgaagtgggtggattgcatgagctcaggagttcaagaccagcctgggcaacatggtgaaaccccatctctactaaaagtacaaaaaattagccaggcgtggatgtgcatgcctgtggtcctagctgctcagggaggctgaggtgagcctgagaggcggaggctgcagtgagccatgattgtgccactgcactccagcctgggtgatagagcaagaccctgaatatgcaggcatccatcctggcccctccgtattgccttcatgggactttgggggcatgggaaactgaccaaaacaaacgagaaactctagctgcctccactgccatgagtaataaagttctttgtctctgatgcagcacttgtaccatctgccagcacccatgaatcagtaataagctaacttgttagcttatcaataaggtaaactctcagatcctgcttagttcctgacagtttctttagttcttagaatatatttaaatagccactttgaagtctttgttaaatccagtatctgaggacattccaagaaagacattttgtaatgactgcctttgtaatgactgccttttttaccccttgattatgagtcacactttatttctttgcatgtctcttcacttttgttgaatattggatattttggataataaattgtagcaactgtggattctgactcttcctcccaccccctagcagtttttcttgttttgtttgtttaataacttgcctgtactaaatctgtgatttctgcctctcccagggtgtgcaaccacagatgtttttgttgagtatttagttttgattatctttttatttgcattttctaaaagtctctgtttagattttgccctgtgtctgtatagattagtgctgaaccaaagattagtcagcagttatgctcaaatacctcaagccaataagcctaccactttgagctgatgggtctttgtgtggtttggggagtgcattcaaaatctggattattttttagtttgcccagcctttgctttctaccgggctctctcagttgtcttgtgaacacacacacacaggtttcatctgccgggggtgtgtgagtggcttgggcctgctgcagtccctagggtacatacacatggccttcagtcaacctaggatatgtgcagaggttaccaagccttctcaccactttctcacctcatggaataccttgttccatggctagtctaccatccattgcttgcctcaatgagatacaacctcaggccagcagagcactggcccttcctattcacttgccaccaggattgctcctctaattgacaacactccatatcaaatgagctcttctggcaacagcagcaaagccactggtttgtagggcctgcgctagcctggttgaacaatcactctagcagagctagagggggatgcctcagacactgtttgtgtgtgaagtctggtaattttcatgaacagatgcttctcagcttgttatatgtctttggtcagtttccagtttttgacagtttttttccgctttatagttgctttgggggaagaggatttgtcagtctcaaaccatcatgccaggagtctaaagtcccaatctacatcatcttgccattgatgctagtgtaacttaactgcctgtttgatactctgtgataacataagttgctttctcttacctgctcagctaggatatggaacagcagcaatagaatcaacctggggaaagctgatagagaacactggggccacagtgggcatggatttttcccatggttaattaggaatgatttacaatgatcaggcattttttatacttttattccctgtataactaataaaacatttgctttacaaatggtatatcattatataaatgttatttatatacactttgtgtcaaccaaagagattaaaatattgccttttgtaatgagattctagaaacattgtcttcatcgtactcatgttctccctgaatttccttccatttattaattcaataaatgtacacttggttatctaaagtatacagaggcatgttgagtgattcccagatgaaattgatacatattttgtccttaaggagcttatagattcgtggaagtaatacaatgtaaacatgaaaaatggaaatagggtgtgctggatgccgttaaagagttatagatctgtgctatggaagttcagtagggtaactgagttttccctatctaagtgattctgttatcactcattactcccatcacctcgtcctccctgcttgcattccctccccagctgctttcctactgaaatccttatgttgttactcattcaagctagtcatagtaaataacatgtacgcagagcttccacatgcacttttcttgtttggtatttgtctggttcatatcagcttggggtttaggtagggagcattattattcctaatttacagataaggaaactgacatcagagtgatttacccaacctcgcatattagaagagtcaagttttgaacataagtctttgtactcgaagtcctgggctctttccggtatgctctgctgcctctcacacagcaaactttctctcctctctagccagtagatagttgggaagaattaagtttggtgagttgggtcagaattggaggcagcttagtgtgtttctagatggacatgcaaatgaggctgcaaagcaagactgttcaggctactttttgaatcatttcccaataagggtttttaatgacttttaattttacaataatcggagatccatattttcatttgcatctcatttattccataggtgttgaattgtgactttaaacacagcatattcaaaaccaaattcataatctccccctcaatctgttgtcttctctgttaatgacacctcaggctccacagtctcctaagctagtaacttggaagtctttgactccttcctaacctttatctcagcatctaatcctatcgtttccagcctacctcatagggttattgtgtgagtaaactgacaaaatatataaagacaaactctgaaagctgtgaatgagaggtatttatttcctctaaggcagtgcatctgttgatgtgtacagtactacaaggcctcagcaaccattcagagttaatgttttgtagtgttgacacttgctttagtgaagcatgtacttaacgtcggggctaaaactgcattatcttacattcttataacaatctgcactcttaaaagcactaccaagggaggagaaaaaaaaagggagcatgagagagaacaaggctctcttttgtgatttgcacaagaactggaagtcaagttttcagactctgcttggctatatccagaggtcttttaaactgaaaaccaaagttgattttattaataccactccaccactcattctctgtgacctagggcaagtgatttagcaatgtcagtctctacatataagttagagataatgattgtacctattttatagagctgctgtaaggattgaatgatctatatagagagccagagtgccatatgtaaggtattcaagaagtggtagctattggattactcttctccctttccacctatctagagattttaggttggtcctcctttgccatttccctgagatagataatttatttcacgtggcgtatttatttagactgcatcacattacactctcgcagttcacagacatttccaggaggttgttgctccaccacttcattcaaaactaggttcacggttttcatgttttcctctctacatctctcctactaatttcccttttaatgttcgaacatgattctgatgaagtctttcagttaaaaattgtgagattaaacttgtactctctaactccgaagtgaaagagattttaggttcaatattaggaataaaattctactatcaggactgttgtttttgtttttcatcagtagcatgggctgccttggaagttatgaagttacccatggctaccgctatacaaaagtggcttttgactagcagctttgcctcgccactgcttcctttctcccatccagtccttgaggtctgcaagctgtttcagtatacatcgcagtgaagagtgtaacaaacagattagctacctgacttgcaattttttggctttggaatttttggttcaggattttatactgtcctagctaaatgaattgacaaaacagcaaggtataacttacaatgaagaagtttatcaaccttcccccgcaggattaccaaatacagaggtgcagggtttaatattagactaaagttgaagatgtggccctcaattctcctgcaaaggagctctgcagtgaagtcacaatagccatgagcctctcagtgtaactagggtcatccatactattccatatgttaaagtagaagaaaatagtgaagtcttgtcatttgcaagacttttatgcaaagtttgacagatgttgcatgctgctttcaggattaagaaaattacatgggcactgctgtgccttctgtgagaagttttattctcagctgtcaccctccttgtcccttgcccataaccattatagtggccagaaagtctgcttgctctacagtgatgtgttttgaatagtgcccattagttttcagtagttaccctggcctgcatgttagccttcagtttaatggccttttttatgttcattcattttattttatttcccatcgtggttttgtttatttcttttttgttttttgttttttctgttctcttttttaaaaccgtcgtggtttgcccttcatattccccaatgtttgcacatgacaagatgttgccatcccaacattacctcccacttcactgaccagtgccactactgaccatctagcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctaggtaagtgcctgtgtgtctgcagccagttggctgcctcttggtcacggcagccttgtcatgctcaccctggctcttggtatctgtaccaatttttagtccagaaaataagatcactgagatgcaccttccctaattttaggtcattaaataaactcccaaacagactaaagtcctggtagtctctccttttctgggatgacttagggagagggtagatacagctattgaggtggacgtatttaaatgtaagaaggagtgcccttttttcataagattcagtcagtataaattctagagattaaggtagacttaatttattaaagtaaacttaaatgaatatttgccacacccttatgtggtgtgggctgcggagctccaggggttctccttgatggaataagagtagttagtgatgacttttcctaaaatagcattttcattacattcctcttcatttccaccccctcaggagctcacattgctcataggggaagatctataatgtccaggctgctttgtgccacaggctggcttcactttatctgtccaacttgcttttcctttttccccaatgtaactgactttctagtgaaaccagtctaatcactatagcctttttttccagtgtgtcctcttcagtcacttcttgcccctttctcagctgaaggtaaattcagttaatccttcttggcccaggttaagccccatgaagctctcaaagatctttacccaccttttcagcacatagagcatttcccttgtacgtgtatttgtatccctaatattggcacttgattatggtaatatgtgatattttactaccttaagctgttattcttcaattatgttctatgtatttgtgctgttttcccaaccagattataaactctttggaaggaaccatgccacatgctgactgttcacacattgccgagtagtaaattccttcactgtgctcttccaaccagaataagaaagctaagatacgtgttttagtaggagccctaatacatcagctaaagcttgtatttccattagcatgcttatagttgatgtacattgtagttaataccagactggcaagtttagcaagtgcaggaccctttctttaatactctcaagaagtctaagtggcataatttaacaccaacagatgggagttacctgaatgctatactgtgtgttttgagttttacaagggtagagaaacatagttctatacataaaaaaaggtaagacattcctaccaaacagcaagtttcaatatcaccattaaaatatcttcaatagactttgaaatctcattgaaaatctcataagctttcacagaaggaagaaaccatttagtaattctgcgtaataagctttatttctgcagtaggttttttgctcttattgtgcgttctaccagaaatgcattttcctcacatgagttacatctggcttcttatctatcatctttagatgacatctcctcaggccttccctgaataccaacccaaacttagcccctcggtgactgtcacacagtggggtatcagagccagcctgttcccaagctaattgttaaatgctcgggaaattttgcaaacctaatgacatgacttggcagcttgaaattgggcatggtgggagtgtttacagtgacaaatgctgcaaaccagagccaattgttaaacattcaccagaacaccactgctgtcacatcaccctattttttggtatgtgtgtggtatttttttgtttgtttcgcttttagtttgggtttttttttttttttttttttttttttttgagagcacttactactctctgaaattttctcttttattagcttatttattctgtctgtcttgttcaataaaattctccagcacctggaacagagcctggcatttagtaacactcagtaaatatttattaagttaatacattaatttcaattcgtggagaaataatagataattcaagtaatcatgttgagattgattatccatttggtgggaaaaataaaagttatgtctctgtcttaaattatagatggattaagagataaatatttttaaaatctataaatatattagaagaaaatatagaaatgatttttatcatttggagaacaggaaagggcttttaaagggagatagcaaatccagaagccataacaggaaagagtaacaaagttacaaattataaataaaagatatcccaagagacaaataatacaagcagatgattcatagtactggaaagcccattagagttaaaaaaaggttttcaccatctcaggcgatcttggaagcaaaatgatgggggtttttttgtttgtttttattttgttttgttttgttttgttttggagacaaaggtctcgctgggtcacccaggctggagtgcagtggcactatattggctcactgcagcctccgcttcccaggttccagcgattctcctgcctcagcctcccaagtagctggaattacaggtgcctgccaccatgcctgggtaatttttgtatttttagtagagatggggtttcaccgtgttagccaggctggtatcggactcctgacctcaggcgatccacttcagcctcccaaagtgctggaattacaggcatgagccactgtgcctggccaagttatcatttttcatctataaagctggcaaaaattttaagttgataatatccagtgttcaatgagttgacagctaggaggaaaaccactctaggttattggtggcagtataaattagaatagtctagggaaggtgatttggcagaattttaaaatattttaaatatacatagccttccatcacacttctaggtaactgtcctatagacatacagatatatgtatgcattgggccctcatacaaacacgtttatttatagcattgtttgcaagattataaaaggagactatgtaaatatccactgatagaagaatgggcacctaatatacaatcgtgcatcacataacaacgcttcagtcagacagactgcgtatacaatggtgatcccataagattataccactgtctttttactgtaccttttctgtgtttagacacatagacacttgccattgtgttcgcattgcctacagcgttcagtacagtaacatgctgtgcaggttcgtagcctagaagcaataggctatcccatacagcctaggtgtgtgggatatacacctagctataccatcgaggtttgcataagtgcattctgtgatgttcacacgatgaaatcacgtgatgcatttgtcagaacatatccctgttgttaagcagtgcatgactgtatgtatacccgtaagtatggtggcagcagttttttttaaatgacctgtctgtatattttgatgtgtatgtaaatgcctaaagcagtgatcctcaaccagggacagttttgccccctcatccctcgggatatttggcaatgcctggtacagcgtcagtaagtaccagtagaggtacttactgacatctagtggatagaggccagggatgctgatgaacatcctgccatgcacaggacagtcccacaacaaagaattatcctgcccaatgtctcagtagtgccaaggttgagaaaccctggcatggagactgtctggtgagatatgcgtcaatatgtgccacagtcagctctcagggcaggacaggttttgacaaaagagaattgagacttatttttttttaactgtgtgtacttttatatttaaatgttttcaatgagacacacttatttaaattttatgatagattgtgggttggagtaagcaggaatgattagtaaattaatttgtagttggaagagatacagaagttgagttggcaggggcaggtgggcatgactagtgtatgtaaaggaagaggaagtgcaaggtaaggccatctgtgtgtatgctgtgagaaggatgcaaaggcaagaaagctggccaaactggcccagagcttttggcagaaattagtaagagattagaataaagtggacgtttggagccagatgctggaatgccagtgagaatttggacataatcagataagaagggaccatttttgactgttaagaaagttgtacactgtgattttattaaacagtactttgggaacactacccaagattaaaggagagaaaaaatagagtcagggagacaaaattgggtagtaattatgttagcctagatacgtgctagtcgtcggcttggatgaagatgaaagcagcgacttgaagtggataggacaaatttgggaaatatttaaaaggaagattttgggagaccataatagttttttgttgcttcattactttatgatttctgaatagaggcaatgaaggagaagttaatttttttaagtcgtaagactatatcctggctaattgttacataaacaaaactttcttattaatcttatcggcttaaattttctcatctaaaaaacaaaagtaatatatttacttcacagacgtgtggtaagaattcaatgtgagaatgtatgccactacctgcatttacaaattcacccacttcctgcatttgaaaattcagccaccaggtggcaccatatgccttggtcatgagctgtaattcttatgggtacctgagttgccagagatttcagagggtccttcctctctgccttttcagctatgaaaatttcatctttcttaaaaaagcagtacttttctatattaaccattaagtgggaagtggaaagtaaggtatttctgctattcatagcactttaaagttggattgaagccttagagatctgttagtctagtcaaggggttagcaaaccatggaccctgtgccaaattggagcaattatttatttttatggccccggagctaagaatagtttttacatttttaaatagttacatttgaaatgttacataggtaactatataatatcctccattttgcctcttggcctataaatatttactaccaggccctttaagaaaaagtttgcccaccctgtctcattttttcgtttaatacataaagaaagtgaggcccagaaagcattagtgacttttcctcacaagctagtagcattgccagaactagaattgcatctcctaacttccagcccagtgctttctttctataaagtgtgcccttttctttcccttttgattcttagctttcacattctaacctgagtcccactgtaaccccacacacttaagagaattgttgtttcaaatgctccttgaatcttatcccaaaaccaagggtggtttttctgcacagtaacttgtttctgggacctcagaccaatagtgtcagatcacctatgactgattttttttaatggtaatgcttctatagaaatttgatgtgggtattagtaaccttcacttatttctcccattttttccctttcacatagaagcaaacaaaaaatatatatatgatattagtatacaagatttacatatcagaaggcagattttcgtttattcattcaatgtatgtttgggatgcagcttccctgtatgagcattctgctacgtgcttctgtcgtacacgaacatgaatgagacagtcttttacttcagtttgaagtaaaatagtccccctcctgtgtctttctagaagaaaacttgtttcaactttcctgtgtggggtgaacaaaagagacctgatctgtactctctcagagagcctttagtttagtgtaaaatacaatacagttgactccccagaacttaaccactagtagcctactgttgactggaagccttgccaataacatcaacagtctgttagtacatatttttatgttatatgtattatatacggtattcttgcagtaaagtaagctagagaaaaaatgttattaaaaaaatcataagggaccaggtgtggtggttcatgcctatagtctcagcactttgggaggctgaggcgggtggatcgcctgaggccaggagtttgagaccagcctggccaacatggcaaaactttgtctctactaaaaatacaaaaattagccgggcgtggtggtgtgcacctgtagtcccagctacgtactggaggccagggcacaagaatcccttggacccaggaggtggaggcttcagtgagccaagatcacaccagagcactccagcctgggtgacagagtgagaccctgtctcaaaacaaacaaacaaaaaaatcttaagagaaactatttattgtacattaagtgaaagtagatgatcctaaaggtcttcaccttcaggttgagtagactgaaaaggaggaagaagaagaaaaggggttggtcttattgtctcaggagtagcagaggcagaagaggtggaggaaatggaagcagggcaggaaaggcaggcgcactcggtgtaacttctgttgaaaaatatccgcttatacgtggacctacacagttcaaacctgtcttgttcaagcatcagctgtacttccctttaagacagggatcatccatgatcagaccaagtgtcagaaaccttaaattgtaagaaatcagttgatccttccttataaatcctgtgattgagagatttagccgaagagaaaatagtattaggtatctcaagtatctctgaaaaataatttttgttactacagtattcttttccaggggacctagctgattatagagaaaaaatcctctgtaaatattgtgtgggtactattgttggattttttaattaaaataaagtaacttaaaagaactatagaaaattaccaaaaagcacttctctgcagtgcaaatgctcacaatcagacaaattggcatatggtcatgtagacctacacaaattttaatctgcaatttgaaggcaaattatcagtattttaaagtaagaattttaattcaataaattagaataatttcttcaatggagtagtttgaggctctttaattactttctcaagacaggtatagctgtttcctcacatgaatgacagttcctaaaagccaactgtttgtctaaaacaaattccttcacaatatttgttgaaaactcttgattatgcagtctggttttcattctagtgagtacagtagactgagcatgtttgtggacctgtgttggtcacacagaccccaagacagaacctggaagccacctttagtaaagaacctagataactggttttaagctttcatctcatgatattaaatactagaccgctggatttgagttgtttgtgataaagtttgtcaaacatttcatatcatttcatatcagcttcaaaatcaatgaagtgttaattttaagaaattataaaaatcagtattgtaatcagtttattttatagactgggttacacttaggatttatttaaatgttttatgtttttatttccaattttaaaagatgataacctctagcattctttttattgagagtctcttagccaaaatatacacagcattctttgatattttctgtgaaatatcattaggtcataccaatatccaccttccatcaatttccctaaaactcagtgatttctaaagcctagaaagttgatgactagctgccccatttgaaatggcattgagaagagccctgtgtcttctctgaaaggaagttgtgattatggtcagcgatatcagtaacatttcagcaagaacatcactgatttgtcagatacgtatgcccttgctcttttgccagtccccatcttctttgcactgtcctacccccaaaagcttcattgtttgagagctaatttgacttacactgatagatttttatgtggagtggaaaatgaaactgtacattctggaagtattcctaattaatgctatctctctccaaatcctttgtctaaagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgagggtaagtcttccacctgtctgtcagcaccccctagaggtagacctctctgaagttctacctttgtttagccttgcacaccataggggagcagaagataacagttccttactttcggggtccttatcaattaggggaggcaaaattaatttacatcaaaaaacagcaagtagggctgggtgtagtggctcatgcctgtaatccaagcactttgggaggccgaggcaagcagatcacctgaggtcaggttttttagaccagcctggccaacatggtgaaaccccatctctactaaaaatacaaaaattagccgggtatggtagtgggtgcctgtaatcccagctactcgggagaatagctgaggcaggagaatcacctgaacccaagaggtggaggttgcagtgagctgagattgcaccactgtactccagtctgggtgacagagtgagactctgtctcaaaaaaaaaaaaaaaaaaaaaaaaaaaaacaacagcaaatagtataagacaatatacttctgttggtgcttttctacgtgttcatattttactgaccctttaagacttagctcagatgccttctagaatctttcctctgattctaatattgttatctccacagtctaagatatttatcacgtttttccttcagttatgattatgaacttaccttgctgattttgtagcaaagacagagcctttgtcatccttacatttcccacagtgtctaatgtaatgccttgcacatgaagaaggtatttaataattgttcttaactggattgtctgtctttaggcataccatgctctttagaatctccttgaggctttattttggacctgtggtctttcgtgctaaatagggttacttctaattacatttctaagattttcagtgacgtgagtgtcaatcaggtttatttatattataaatgtgttgtatatcttaagtttggattgtaaactaactataggaccgaaattacaagcagccagatcttaataaatgcttttcctacttgaggcttttgtctagacttttgctttcttttaacacaaattactgtttttcctcagtgtattcttttttttttttttgaggcggagtctcgctctgtcgcccaggctggagtgcagtggcacagtctctgctcactgcaagctctgcctcctgggttcacgccattctcttgcctcagcctcctgagtagctgggactacaggtgcctgccaccatgcctagctaatttttttttttttgtatttttagtagagacggggtttcactgtgttagctaggatggtctcaatctcctgacctcgtgatccgcccgcctcggcctcgcaaagtgctgggattacaagcatgagccatcgcacccggccacctcagtgtattcttcagtctaattttattattaacagcattagtttttctgtattaaaaacctccagtaataataaaatattttactttgggtagagagtattttagatatatttgtagaggctactgaccaggcagctgaacagaataaatgactttaccagtggaactatagaaataatttaagaactttacctgacgggtagaataagtgaagaagctgtagaacttcactttctaatgctatggcatatcattcacctgtcaaatatttattgagtatcccctatactgggtaatgtgcaagatactggagatgcaaggatgaacaagcttggtcttcttcccttaaagaaggagcaggcaaggtaggagacctttcatcatttcagtgacagagattgaagataagaatcaaacccaggcaagaacaagagggccatcacagagtcagggggttgatttaagggaagagtgtgttctcattacaggcagaatgttgaattttacagttacctatgttcagacaagagcaggaatactctattaggtttcaagctcagttacccttcatcagctttcatatagaggcatcattcatgagagatactaggatacagaatagagaaaacttactgtaaaagatagaaaagtcaaggcaggatcctagggaaagatgagacctgaggctggccttgaggcatttgacttagagcaagcattttgtgggaaggaatttgcatgacccaaatcccagaaatagaatctaacagtgcacatgcaaggtaagtcatgacaaaaatgaaggaaatgcaagggtcctatcctgaggctgtgaaccttctgaaactgcatgaaaataaatatttgtgtctgtacatattcacatttcccttggaaaggatctgtagttttcattgtcatttcagagctcatacatcagattgttgagaaccactgcgagggtcattgtcaaatttagagatgaaagaaaaggggtgaagaagagtggatttattgagtgcccaccatgtgtcagccactgtgttaggcagtcaggatgtaaagatgagtaagacttgacttctgtccacaaggagcttacggtctggtaccatagacaacagtgtgatgtgttatcaccttaaggaaaataggcagcataaccatttattcaaggagtttggctaaaagaaaatagttgtaagaatgtaggtagaaaaggcaacaggttctggtgagggtattttagggatggagaagagactataacatgttttggcaaaagagaagcagtttctgaagagagatttggatttcatctggaggtgttcagcttgtgtgggggaggcataaatgttggaaccagcccttggaaaatattttacatatttagtttcacaaaccaacttaacattttttccatttattatgccactgtacagctgaaatgaaagaattcattagcaccttttttaggatcatatttgcctacacttggccaatgaatatattgaaaatgatttcaagagaatttagggactgttttgtttttcttctcctttaataagttagaggaaagttttccatagcagcagaagtgtgacaaatcccacctgtcaggctgcacaaaatatgcccttaactgaagtgaataacgtgattcataactaaagcaaacaactgttagagtaaccatattcagatttctctactttgatagcaaaattaatcttaagctgtggtgctgttattcaggaaagccagtgtgttttacattttgttagctttttttcccttcccagtttttaaatctaatgaatgtctattacagaaacactagtgccagagaaattgttttcaaatatagaatgtctaccaaagtgtaggcatagacagccacacaggatttgtgtataaattggaactggaacctgtcagtcagacaaaaataatacagtaaaagggtaggtgtgtgagccattgtaggagatagagccagctagacacttaagcagtcagccagtgatccagtcttccagtcacatacatcctatcgtgggtattgtagtaatctccttacgggtcttcttgagcccacgttttagaatcagcaagtactcgactcctgggtccaccgctagctaactttcccatcacttgggaaagattgttaacttcataacctcacctgtaaatgagggtgataatattcatctcacttggtttagtgcaaagattatatgagaaaatacatgtcaagtatttagtgcttgactgactgtaaccattcaataaatggtagctgttttacaattattattattttatctagtcttgttcttttactgtttttcttccatgcatgtgttcacatgtcctttctaaacacagatctgatcatatcatgctcctgctcataatttttcagtagtcacctaacacctactagagaaaatgtgagcttcaatagcaggacattagagggttcttcactatctgactagtcattgttttcaacattctctctcccatatccactctgtttcaaccaagctgaaccacttaacactgtctttttgtatattctccctattgaccccattgactggaatgattttccccttggtatctgaggaaagtgttcattttgcttgactccaagaattcttcatcaaaggggtttccctcccaaacccctcccaaagcagaattgtgtgctctcatctttctgtttttgttataaccgttacctaaatctgttagcacttacgacattttttgtaactgtttatatgtctgactttcctgctagactgggagttctttgtgggcaggattctattcatcactgtatccctagtggctaccacaatgcccggcaaaagaaggatctctttctgtggtggttgccttttatgtcttgtgtaggcccactgcaaaactgggattttataaatcacaaggaaagtttttcagtgtaatttctggttttgatttgaatcataaaaaggaaaatgtgtttatatattattctaaaaccacttcaatcaaatccattgttttcttagcttctattattttaaaaacgtggccaatatgacagtattgccaagaatggttattgaggagtgtagcatttcatttatatcttgctttctcgaacttttctttctagttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggtatgaagtgaagcaacttttcaaaccattgattggaatagtagagttgaaatatatttccaaaactcagtagttgcttgactggaaatgtgagggggaaaaagaaacataggaaatgaaaagttgacagattctatttctttgtaccaagatttattgtgtagtttttaccagcagtggtcagtgaacatcaagcagtatttctaagtaaattgtcaatttatgattcatctgctttgactattgaagaaccttatgtagaagggataaaatctgtttcatgtagaatatagaatttgtgtagctaattctttaattttcaacttttcttttggcttgagtgcatatgtataaagtgttttattttattcaaggatgttgatgtttcaagtcactcttacaccattaatgggttgaaaaaatatacagagtatagtttccgagtggtggcctacaataaacatggtcctggagtttccacaccagatgttgctgttcgaacattgtcagatggtgagtctttcttcctctggaacgatataccacacttggtgcccctagtggtttagttgtaagatcatgagctttgatgtctagaagattcagttcaaatcccaattttacctctttctggtaatatgactttagtcaagtctgaacatcttttttcacgtgtaaaatgtagataataccaacttcattgagttgctgtaaagattcagtgagaaagcatagagcataaagtgcctcttactggataggctctcagcgtttgtgtttttagcagaagcttttgtgtaagtaaatactattgcttgttcataacacagaccattccagggcttttggaagactagccttattctacttagcaatgatatttgcatgccaaattagtctttctagttcctccgtatttgtgactgttttatctctcacctgtgactgaatttctaaattaagttatatatatatatacacccatatatatgtatatacacccatgacctagagcagtgtttttcgaactacagcttgccaaagagattaagtaggtcaaaaccagcatttaaaaaaaatatatttttagaatagaacagaaaagattagagttcattgcacttagtaagggtatatgttgtttcatgaaactcagctaaatcttatgttttagaaaaatgtctttttaaaaaaacgtatttatgtgtataccgctcttacgtaaacacacatgctttagaaggtaaagtttgactcccttaagaaaagagtcaaacttaacatcaccaataaaagaacagactgacatcacgtgcccccttatgtgatacatggaggaagacacaatattacttctgttatatcagtaccaaaaatatttaacttgaatctgatcatgatgaaacaatcagacaaatccaaattgagggaagctctgcaaaaaaaatttttattttaactgacttggattcttaaaatatattagttttgtgaaagaaaaaaaaggttgaggaatcattctagaatctagattaaagaagagtaaagacacatgaaataaaatatgtatgatctttggatcctgcatctggagataaaaaaacagccataaaggacactattggtataattacttaatattagatacatatggtattaggcaatagtaaatattagatatgttattagctatattagataatatttttgtgttaaaatttctgaatgtgattgttgtattgtgtactttgttggagaatgtccttgttcataggagatacatggcgatatacactgaagaattttggagtgaagtatgatgactgcagtcatctctcagatgattcagaaacaatatgtagatagataaatctgtatacatatacataatagtaagataaataaaacagttgttgcagaatattagtaattgtgaatttgaaaagaacagccattcattgtactattcttgccactgttttccatgggcttgacagttttcaggattaaaaagttgggaggcttggtgcagtggctcatgcctgtaatcccagcactttgggaggccaagtcgggcaacttacttgagcccaagagttcaagaccagcctggacaacatgacaaaacgccatctctacttaaaaaataataataatagctgggcattagtggcacacacctttaatcctagtactcaggaggctgaggtgggagggtcacctgagcccggggaggtcaaggcttcagtgagctgtgattacaccactgcactccagcctggatgacagagtgagaagctgtctcaaaaaaaaaaaaaaaaaaaagttgggaaaaagaaacaaataaattacaggcggttataccttagctagtgaactacataagccagttaggcaagatactggggaaaagttaagggaaaaaaatgtttactgtaggctgttaaatctacacacgagccaaattttaactgcattaagtgtgttggcatgttgactacagtacctgtgggaactgaacacatctcagcatggtggctaggggcagcactttggaataacgcaaatcttggttccgatgccaggtgaaacaaatatcttggacaagttaacttccctgaacctcttctatagttttctgatctacaaaataggaatgagaatagaaactccgtcctgagattattataaggaataagtgtctgccatgtaatgaccatgcagcaaatctttgctatgatgttgataatgaagacaatgatgacagatatgttggatacctctgcaacctcagtcacttcttaacatggagatgactggaatcattaatgtaattttttcaaaacacatgtgcctgggtcctactccagactacctgaatctctgagtttaggcttgaggcactttgctaggcacaagttacagaaaggagcaagacacattctcttgtcttccagaagctatagcacagtgggcacttagttgtatacctggtcaccaaatgttagagacagaaaaagagaagtttccacgggtggattaggagagaagggctaaagtcagcaatttgtaagtgcagagaaaacaaatccggtttactttgcttgctctcaccaatatgaagggagatactagagaatgtgtgggccacacactgagataactctggattatgttctaaagtgaggaactaaagttacgtggctgtttaaccaacagtcccaaacttctcacatctaaatgagtattttctggtatctggttgcctcaggaaaccagatggttcactttaccagttgtcattgcttaaatatctttgctgtacttgggaactgccttcaaaaccagcttagaaactccacaagaaagccaggcttactgatgtatgtacatctcattttgatccatcatgtcattacccagttcagtcacttgccatattccttagacctggttccagaaaaacctatggttgtctgccaagataaagatagaccagggccaggcacggtggctcatgcctgtaatcccagcactttgagaggccgaggcagatggatcacctgaggtcaggagttcaagaccagcctggccaacatggtgaaaccccgtctctactaaaaatacaaaaattagccgggcgtggtagcaggcttctgtaatcctggctactcaggaggctgaggcaggagaatcgcttgaacccaggaggcagaggttgctgtgagccgacatcacgccattgtgctccagcctgggcaacaagggtgaaacttagtctcaaaacaaaacaaaacaaaacaaaaagataaaccatcaccaataatactcaaaagaatacatttaaggttctgagtacatatggggtctagaaaagttgagagtctttagaagagttcagagctactgtacatccttgaaataaatatctgacttcccaaaggtacagcctggcttgggtgtaggtgctttcccatatgaaagtgtcttatgttaaaaattgaaccaggcatggctatatgtcatccacatagtattgtcaacatgagggcattggcagctagtttagatctggtcacgtaatcagtgtttgagatgtgcatttgtttaaagtccagccaagatgatcacatgatgggtgatgtatgggtgattaaaaaaaaaattttttttttttttttgtttctctagttcccagtgctgctcctcagaatctgtccttggaagtgagaaattcaaaggtaaaactgtatgatgctgctgttcatttttactggtatactgttgcgcctcagaggggcttatagaaagggagattctgtaggaaagcatcaaaataaatgaatggcgatgtggtaataatctgcatttaaaaataccaaacctataaattagaacgtaagtgaaaaaaatcacaagcaaagaagtaaaaagacatagatattacacttgcattaaagctgggcttaaaaacccactcatttattctccttaattttgcttccttcctctgacaccaaaactgctttaacatttctgcaattaaattgctctttttctgtaaaacattacattctagatgttaactgttcagaaccttagtggtacggcagaaggaaataagttgtttataacatggttccttagtgctgtgagatgagccatgtgaatcaaaggcagacctctgtcagattggttgtatctcctcaaactgtccttcctatagccaagtttgctgtgttcttaggggccatgtttgcctctcagaggcccagagcccttctggactacgcagacaactaagataatcagtcctttcaggaagtactgtagagagccaaatgcagtggctcacgcctgtagtcccagctgctcggaggctgaggtgagaggatcacttaagcccgggagttgaaggttgcagtgagccatgattatgctactacactatagcctgggtgacagagtgagaccccgactctaaaaaaacaagaaagtactatagggctcctttttttttttaagaggcaaccagctgttaattagttgtcccctttttaaagagttttatatggaaattgtctaatttcagctcttctgcactggacacgggaaagaatctttatacctaataatagttagttccctaatccatgtgcttctggccttcttatactttccttctgaaaacttttctgagacttttatccaacatcatctttctggcaaaacaaccaggagatcaggggtccagagtgtactactcgaatatataatcttcccatttgatcattgagggttttagaatttaaaggtatttttgagtgattattaaataactttgtaaaactctgagtaccttgctgcctctatgttttttctctttaaacagtaaaatcaggataaaaatatttaaaacaggaccaagcttttgatatattcagccttttttctataattctgtcttgtgcagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtaagctaccgtgcacaaaggcaaaaggtacactgtgtctttctcagatattgaattatgctagtctaatgactgctctgaactgtcgacttatacaaacaaatttaaaatggttcagaaaatttttaatggttcaatccacttctgacttgatagagattaatggaaaacactcttaaaggttctgctatttctgagtggtgagatcgagtttgatttttcctttcttgtgttttctgcattctccatgttttcatttttgagtgtatttattgcttttttgtaatcttaaaaatgattaaagaaagttatataagcatagaaattaccccactcagtatagttggtaactgaggtctacaaagtggtttttgtaacaccgaccaccactcgtgtgtacgtggcctgaaacagtatttgtgaatagctgcatcattgcaataatcatacatgcgactatggacacgataaagttttagaaaatactatcaggcaaagctccttctatatagttttcccttcatatgcaacagaataagtggcatacctggtaaaaatggatccacatgtgtatctaatatggtttcaccctggagatcacagagaatcctcccgtcttcctcaaggaggggaagtagagttggctaagcaaggggaaggttcttttgcaggagaaacatgggaaccagattgagtgctttcaccctgtgaatgttgagatcatgcctacgaagaattgagacagatgccccaagctgtccttgttccattgggttttcatagatgcttaatatggctgcagaatcgactgtagtctgagcagaccccatcctgccgactcctttattagtttagcagtgccaagactctgtcctgctcagttatacatgcctcagcttcagcaccatcaccctacctctgtcctaggagtaaactcacatgggctgggcctgttggagtattgcctcagctgcatcggcttagttttgtcactcaatagagcccatctgttttgcaagcaaacagatgaatttgagactagtacatttacaaccaaaaggtgtgagttatctgtagctgtaacagtatagtcacagggcatgtttaatctcgggacaaaagctctgactcgggtaatttttttgctaggaaactccaaagcgtgttggtagataagaactataagaatgtgagatattgtcattattttctaagcccaagaattaatttcatcaccctttggaaactttaactttctttatattttatctctcctgggtagacattgaaaggattacagaagcttggcatcacccactttcctgtgaccccagggacagggttcttgagagaaccaagatctggggtcaaaaagtgtcacgttttccagccaggtgcagtggctgatgcctataatcccagcactttgggaggctgaggcagttggatcacctgaggtcaggagttcaagaccagcctggccaacatggtgaaaccccgtctctactaaaaatacaaaaattagctgggtgtggtggcacccacctatgatcccagctacttgagaggctgtggcatgagaatctcttgaaccggggaggcagaggccgcagtgaactgagatcatgccactgcactccagcctggacaacagagtaagactctgtctcaaaaaaagtataatgtttttacttgtttatgggtataagtttctaaaaattgagagagccattgatagtgaaaaactgtgctctagtaatcagcaagcttctcactcctcacctcacaaatgggattgacttccttcagaataggagaaggtgaatgtttgtctccaggggcatgtctttcagtcttccagcttcttcacaagaaccccacatctcttagctgcagtccatatcatgactgcagtagatggtgctgagaaatatcactaagggagcattggccacagatgttctcaaagtcattttcagctgagcgtggtggctcacgcctgtaatcccagcactttgagaggctgagacaggcggattccttgagcccaagagtttgagaccagcctgagcaacatggtcaaactgtgtctctacaaaaaatacaaaaactttaatggataagcagaggctgaaaaaaaaaaagtataaaaattagccaggtgtggtggtgctcacctgtggtcccagctacttgggaggctgaggtgggaggatcatttgaacccaggaagtggaggttgaagtgagccgtgattgtgccactgcactctagcctgggcaacagagagagactctgtctccaaaaaaaaaaaaaaaaaaaaagtttcatattttactctacattcagataaataacatttgccatttgtaaggcttttcattttgaatatttagttgtatttattatatactaggcatcattcttgttgctgttaaaaaaaaaaaaaaagagtatagtccttgcccatgaggagattattcattttctcaatgaaacatttgatgtgtaagcaaaatagaatttttatggtaaaaatggctttatattaagaaaattcttacattttaaaatcatatctggatttattcatttaatagatttcattgaacttttgttggcatgttctggcactgagtatacaacgttgaacaaaaatggagatgcttgcactcttaaagcattaacttgaagcctgataagtattagggagcagtatggatcaccaagatcctttaccaacaacacattatatgattaaatttgaagcagaagtaattattgttatagcactaaacagatcttgccatatctttatgatatgtattgtataccttagttgtagtctataaactctatagggtacttagagggagaggaactcagcctctttgcatagtacctcatttttgcttgctctctcttacatcccagtggtccccaaaggacagggaatgattggttggattctttcaagatcttcattgagtagtgtttgctagtaatccagattatcgtctgtcaacaaacactctagtactttctggttcattgtgtggggagacaaggagataaattgacttgggcccaggcattttgctcctgccttttgtcttgctccttgctttgtggggcacacagatgtcaggatgggcctaccaactcttctcccctaccacgggacaggattagctaaccaaaccagggcttttctcatgtcctggccaagttatgttctcagtactgttgccctggtttgtagaatagacttttctatgtgcatgtttgttgcgtttgatacattggtaagtcatgtactttattagctggtagtaaattaaaagttgcataacagaaaggtttgggtcattttccacttttacttactatataatatatgagcaattggttgttaaggaatagattttgagaccgtatttggtgcttaaaatttttctgccatgattatgaggtggctcagagaacagaggtaactcaataggagttacatctttgcattctttcctaggttttagtgccttctaagaccagatacctttgttccttttttataactctttcattgttcttggcctcttttggccttagctttctttgtaacacaataaagggattgcattaaatgatctctgaggtgccttcaagctcttaaacaaaagtctgtaatctcctgggagcttcagtcatttctgttttcctcttagattgtgtgggcttcagtctttgctttatttggagatggaagctactctatgttgtatttgcattttgcctacactgtattaacttaaactgaaactttgccaagctatatactgagttggtgactgagatgtttgccttaatgagggattattaatcttttgtttttccaaagctcttgtttcagttgtcttctttgtcatttggtctcaggtcttgatcgggggactgagtataatttccgagtggctgctctaacaatcaatggtacaggcccggcaactgactggctgtctgctgaaacttttgaaagtgacctagatggtaagaataacaattggcaagactggaacacaatagatactagctgtagtcaaatgagtcaaactggaaagccacagacttggggtggatatggctcaagtctgtgaactttagtgcatcacgctgctgttgttcctgtattgcatcgaggctgctggaatggattttttgcagtgccttgtagagaactgtcctttcaagcagaactagagcaaataaaaatgtgtatgtgctataagttggattttttttttaatcaaggccattaagtagatggatgatctaaaatttaaggctgagccacataaatcatgcctttatttcaactgcagtttcccttttcttttagtcctggacaccttgccctttttctcacatgtttattcagtgagtactcccaaatgggtgtgtataggtagcacctttatcagtgataggtgctggacttgggaggcaaaagacctgagttcttgttctgagtctcattttactaatttttttttttttttgaaaagggatctcacactgtcacccagtctggagtgcagtcatggttcactgcagcctcgacctcccatgcttaagcacgatcctcccacctcagcctcctgagcagctgggaccacgggtgtgtgccaacacacttagctatttttttttagagacagggtctcactatgttgcccaagctggtcttgaactcctgggctcaggtgattctttctccttggccttgcaaagtgctgggacaacagacatgagccaccatacctggcctcagtttactaatttttaaattaaggtagtaacttatgccctgaaaacagtgtatgtgaaagagcatgtaaatttcctcctttgtaagcctcttagtctctcaccaattgaatcaactgtggctccaaactttcatgttttctgacttaccatactacttaggggagtaaataattggtgctattgctataatgtgatgcttaaacacctgttaacaacaggcttcccactactcagtttatgcctttctcattccacctggtagagtttgggaatggatgtgggaccaagagagatggtaactattgaaaggcaatttatttttctccattggggcagaagaggttcttgtatctctttgttttctcttccaaattaatattgcagtgtcttgtatttaaagctgttcaggtcttttttttttttttttcttagaatgcagtaaaatcatgggctgtatttcactatacatacagattctttttgaactcttgggcataatgtaaaaaacttagccccaaacagtgtggtaggaagctaaacaccattccccaaggatggtgagatattttaaaggacagtatatctcatcttgcttttccacttttccttcccagaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctgggtatgtttgctaagtagagaaagttaattgtgtgggagattcctttctttttaaccttttatgtaatatttttatttttacaagaaaattgcgaaaatagtacaagtaatttctgcatgttattcacctgaattccccaaatgttaacatttaaccacatttacagctatattttgcagaatgcccctcaatttagacttggcttaatatttcttcattacattcaggttttgcatttttggaaggaatagggtagaagtgttgggtttctgtcagtgcatcatatcaggaggcacattacagcctatattgataatgatgttaactttaatcagttggctaaaacggtatctgccacattttcctgctataaaattgttatttttttccttggtaattaaaagtatcttgtggatgagatactttgagtctttataaacatcttgtttcccattacactttcactccctagtttcagcatctgtagtaacagttattagaatggtgtttccccagtggtgattttctaattccatatttcctctacacgtgttaacatcctgtgataaggaagaactttctttcacccctatgaagagaatggccaatgggaatctctttataactggttcctgtgtccatttgacatcttccatctttctttgagcactttcttcctttttgacaacatagtaagatgttcctggctcatctagtatttcactagcctcggccctggaaccagccatttctctaaggaaccctgatttattttatgaaaaatgattttggaaaccaatatctgggcactatatctattcattgtaactagggtagaaaatcctaaggaatctacaaaagggccacaagatacaaagtgaatatacaaaaacagtaaaatgattttggaaaccaatatctggtcactatatctgttcgttgtaactggggtagaaaatcctaaggaatctacaaaaaggtcactaaaactataagtgaatttagcaaggccacaagatacaaagtgaatatacaaaaacagttgtatctccatatactaataataagcagttggaaattggaattaaaataacaataccacgtagaatagcatcaaaaaatatgaagtacataggagcagacttataaaatgtgtgtaatatctgtgcactgaaaatagaaaattgttactgagagaaattaaagaatacttaagataccatgttcactggttggaagccgtgatattactaaggtgacaattctccccagtgcagtccaagaaaagtcacaataggcttttttgtagaaattgataagctgattctaataatttttatgaaaaatcaaaggaactagaatagacaatttttttaaagaataaaattagaagacccatactagctgatttcatgtcttcttataattgagacatagtggtggtattgtaaaggaagatgttatacatcaatggaacagaatagagtccagaaatagatccatatgtatatagtcagttggtttttagaaaagctgcttagataatttagtggggagaagacagtctttttaacaaaagttgtgggaatacctggatatccatatgagaaagaaaaggaactttaacccttgtcttacgctatatgcaaaaacagacctaaatgcaaatgacccaatgactttgggacaacaattctagaagaaagtgtaggaaaaaatctttatgactttgggataggcaaggacctcttaggttgtaaaacagcacaaatcataaaatttaaaaattgataaattggatttcatcaaaattttaaaacttctacttttagaaacataccaataaaatgaaaaggcaagccacagacttggagaaaatacccaccatttaaatatctgacaaagaatttgagtccaaaatatataaaaactcttacaactcaataataagaaggtaacccaataaaaagtgggcaggagatttgaacagacactataccaaagaaaatatatgagtggacaataaccatatgaaaagatgctcggcaacattaatcatcagaaaatgcaaattaaacccacaatgaaatgctattgcacacccgctagaattgctaaatgttagtagactggcaataacaaatatcaacaaggatacagaactggaatgctcatactagctggtaggaatgtttgacagtacaaccactttggaaaacagtttagaggtttcttgtaaagttataacccagtaatcccacacgtagataattaaaagaaataaaaatacatgtctgtgtaaaagcttatatacaatgttcatagtaactttatgaacaaggggaaataacaaattttcatcaacaggtaagtggtaaatcgtgatatatccatggagtactactcagcaattaataggctatcaagacacaacagaaattaatctcataaacatgctgaccaaagacgtcaaacactgttatattttgtgaattacaaaataggcagaatttatctatagtgacaaagcaagatcagtggttgcctggaaccaggggtgttaggaatcaactacaagggcaccagggagcttctcggagtattggaaatgttctatatcttgattttggtggttatgatgcaaggtatatatatttgtcaaaactgtaaatgtacagttaaatggatacattttattatatgctaattatacctcatagttgactttttttttttttttttttttgagacagcatctcactctgttgcccaggctggagggcagtggcgcgatctcagctcactgcaacctccacctcctgggttcaaatgattctcctgcctcaacctcctgagtagctgggattacaggcttgcgccaccatgcccagctaatttttgtatttttggtagagatggggtttcaccatgttgccccaggctggtctcaaactcctgacctcagatgatctacccacctcagccttccaaagtgctgggattacaggcgtgagccactgcacccggcctcattgttgattttaaaagcaaaagaatttgagaaatatttatattttataataaataatttattttgttaggtataattacttttccaaattggattatcgttatagatcttttttgaaacacttgtttctaaaattaaaatctgccctgaccaaattttcattcagatcgtttctttgtaaacatcttttctaagaacaacttcaagtgcctaacagaagagttatattcatcctttctgttaaaaaataagctgggatttaaatattcaaaaaaaaagtaacctttagctttttccttacaaggaagaaacagtacagttaacctaggaaatgtatcccccacgtgaacatcttttaagacaattgttagcaaaaggaaagctttgctggtagaataaaaatgtctggccaggcacagtggctcacacctctaatcccagcactttgggaggctaaggcaggaggatcgcttgagcccagacgttcaagaccaacttgggcaacatattgcgacctcatctctacaaaaaatttaaaaaattagctaggcatggtggtgtgtgcttctagtcccagctactcgggaggctgagataggaggatcgcttgatccctagaggtcaaggctgcagtgagtcctgattataccactgtactccagctgggtgacagagcaagactttgtctgaaaagaaaaaaaaaaaatgtccctgtagtgaccagcttcatactgtttcctttatgcaactactgatgtgaaactcctttgcagtattgacaggacatggtccttgatcttcaggtgctttcagtctaacagaacaaaaagaaaacacaagaaacagtgaagtgagttgaagtgaattttgttcagagaagggagaacgctatagcaagacacagtagagcagtcagggaagaaacccctgagcttgaaagatagaatcaaaatagcgtttgaaatagagagatgagaggagtgctgcatgtgcagaagagagtaagcagatagaatttattagaaaatggagtgcacattgcagagtagcaaaaaaattaatgcagcataaagtaaaataagcttgagctataattattgacctagatagatctaagatgcctatgatgttgagtaaaagaagcaagtgagaggtggagaaatgcagttagcaattcatctattcatcatcctggaactctcccctgaccttcagatccatataaacatctgcctactgggtatcagcacctggatatatctcatattccatctggcccaaaattaaagttaatgccttctccctcaaacctgttgatcaatcagcaaatatttaataaacacttacaatgtcccagacactgtgctagagatagagcagagaatgagacagacgttctcacaattattagaaataatacaattcaaaaataattgaaattgttcacggtgctgagggagagaaatgggctgtgtaactagagaggctagtccagtgtggaatgagccctttgagatgaataggcgcttacctaggtaaacaggaagagtgggatgtgaccccagcatagggagcagctgcaagcgagaaggccctgtgttggagagaacacagtgctcagtgaactgataagtggccggtaatgatggagcacagagaactaggcaaagagtggtgggagaagacaagtagtagattcaacaaaacttgattgtttgtctggaggggatgagggaaaaggaggtcttaataactcccaggtttctggcttgagcagcagggttggtggtagtgtcgtttactaaaccaggggacactggagccgatctgaagctggaggcagggtgggaagggaaagatttgagacacccaagaggaaatgccaaacagacaattgaacataaaggtctggtgctcataagaaagatccagactagagatctgtatttgtaattgatgacacatacatgctaatcaaagctaaggaaatgaatgaaagtgcatagggtgagagcgaagagtgggaatagaagaggacctagaatcaagccttgcacatgtgtattatggttgctcttgccccttttcccaatctcagtgaatgacactgctatctactgtgttgcccaaagcactttttccttgccagtcacgaagtaagtcttactgattccatttgttgttagttctgacacaggaagaccaggtgcctctatttgttgccctctagtggcaatctagggagtgggtgggccgccaagaaaagcagctgttttaagcttttgagccacatgaggcatggctcatgaggcatgatggctaggtgaggtttggccatttctggatttggaggccacttggagagtcaaggacattgagcacttaactgacttaacagtttatctccttcttctctaccttgtctgttcccatcgctgtccttccaggaatgaaaggggtttgtttaattccaagctccatctatagacttcagcacattaaatcttatctcttcattctcagccaagccctacaccataccctgaacatcactaaaccataggagagaccaagagagaattcaaacacagcccacctcctctactgagactaaatccgggaagttggtcccagccagtttttctgtactgtgtgtacttccatctccatatctccctacaacctgaaataatcccccataaaaatttttaaagttgtctttcttgaattcttctgtggttaagattatgcacagccacccttgaatttttaaaattctgtagtgagcatttttttaatgtgtgtttcttttttttcagatcccagctctcactatgtgattaccctgaaagcatttaataacgtgggtgaaggcatccccctgtatgagagtgctgtgaccaggcctcacacaggtaaggtatcctatctttcctagtctccagcacttttcctagcagcttaggcagaatattggcatgaggcctatcccataggtgttagggaagaaaaagcatatggcagtttcgggtgctgacttcaaatgggaaagtgggctttcagcatggaaagttctgttaatttgttttgcttttttttttggaagattctaattctgccacgtaagccattctgtgtagatatatacacgtttttaatctgttaggatgtggaaagcagagtttttagataattaaaagtgattttccgtcttttgggcatgtgagttgaaactaaagtgagtcaaaaacaaaaaatgtaggttactgacggtggcaataaatgcatgcgattcgtgaacccaacatcatttggttactagccacctgagttggttaggaaagtgtttttctatgtgccttttgtaagcttgagtataaggtcagaggtactatccatttgatcagttatacatttattacaaacgagaccaaatattcattgtttttctttgaattatctacttaaaatatctctaaaggccgggtgcagtggttcatgcctgtaatcccagcagtttgggaggccaaggcaggcagaccccgaggtcaggagatcgagaccatcctggctaacacagtgaaaccctatctctactaaaaatacaaaaaattagccaggcgtggtgctgggcgcctgtagtcccagcaactcggaaggctgaggaaggagaatggcatgaactcaggaagcagagcttgcaatgagccaagatcgtgccactgcactccaggctaggcgacagagagagattgtctcaaaaaacaaaacaaacaaaaatctctaaaataaagtaatatacatgtcatgtaaatttttctatagatatataagacatctaatttagatctgaaagagaaagtttattgaatatgttagagttataaattttttttcttttttttattatactttaagttttagggtacatgtgcacaacatgcaggtttgttacatatgtatacatgtgccatgttggtgtgctgcacccattaactcttcatttaacattaggtatatctcctaatgctatccctccccctccccccaccccacaacaggccctggtgtgtgatgttccccttcctgtgtccatgtgttctcattgttcagctcccacctatgagtgagaacatgcggtgtttggttttttgtccttgcgatagtttgctgagaatgatggtttccagcttcatccatgtccctacaaaggacatgaactcatcattttttatggctgcatagcattccatggtgtatatgtgccacattttcttaatccagtctatcattattggacatttgggttggttccaagtctttgcttagagttataaattttttaaaagggcactggaaaccaaagaatttattttcggaaatgttctttttcatttatttccaaaaattttgattctttattgtccagtgatatctgctggatatgttgcataattgtgcagatttggtaacattcttaaggaaggcttacctttcctgaaggaagagtacatccttgagttccttttgctttatttgggtgtgagctatgtcactctactgccattagacccagaacatcagggggcctaatattctctgtccttttttttaagcttctatttaagactactacatgtttggtagttctgttctgtcttctatatgcttacagtttataatttcttttagaaatagctttagtattacaaaaaggagcaaaaattaagtgaaaaagtatttaaataagtggtctgctactttctaaaatcaggctataatagtaaaaaacaaatttgacattacttccttttatgtggcttaaaaatatagcctactagctagaaatacacaagaaaatgttcctaagtcatgtaatctagatatgttttctaagggttgctacatataagaaaaaaaatttctacaagaattctaatgacttctacacctgaaggtgcattttctgtaactaattggtatgtgtcctgccaaactttgaacaaagctcttggttatataatgtatgctactcctctgttatttttagtcctcattgcacaggaaatacacaaatggagactattactttagcttagcaattattcataaacaaggtccatgccattccacattttgagtaataagggctagtcaccatgactatgtgagaaacccattgtaaactgtgaacttaaatcagtatgtgtaaacttagaaaacctaagcatgaattgggaaagcccgtatggattctgctgtattgccctgggcccatggtgcatggtgcttttgtgctcattctggcctcagagaaggtgtctgttgtatatggcacaggacagctccatgagtatagactttccatcaaataagtactgtacagtactctgatttctaaagtttgtgaagtttgttacttggaactgtgataaccatggcatttccgttaactgatgggaattcatcactgggttgttctctgactctgtggaagaaactatggtagatagtccagcatggtgtcagcttacctttcctgaaggaagagtacacccttgagttccttttgctttatttgggtgtcagctatgtcactgtactgccattagacccaggacatcaggaggtctgaacttgaccctttgtgggtatcagataccgtcaatacccatggctgacattcaagactcaggtttgagtgttggacccttacatgaatagtgatatgcacagataactcttgtcccaaaaattcagccacattcactgaaatctcaaaccatgaggtttgtattgcttgtttagaaattgtacccctgattctaaaagcagtttttgtcttcgtgagcctttttggttttggggtttttttgttttctgagacagagtcttgctctgtcacccaggctggagtacagtggtgcaatctcagctcaccgcagcctccatctcccagattcaagcgattctcatgcctcagcctcccgagtagctgggaccccaggcacctgccaccatgcccagctaatttttgtatttttagtagagacaggtttcaccatattggctaggctggtcttgaactcctgacctcaggtgatctgcccgcctctgcctcccatagtgctgggattacaggcatgagccactgcacctggcctcatgaggctttttgaacaggaagtagaattttcaagttattttaagaaaattcaagcacgaatacattaatataatcactggattataacattttaatatgcctatagaatgcagtagagaatatagtttattactgcttctcttaacatttttctgtaattttttcctgaaagaacacaagtggaaatagtcttttaaatgaatggtggttatctattaactctgaattttctttctttttctccatttctcacctttcattccattatattaccctgcatttcccttttattttatttttgtttacattaaaatgccacttccctttttaaattattttctgctcagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaaggtactgacacatttgccctggctgaaaaaagctaatcattgatactttctaattttaaagtctcaattcatgtttttttcagaatgcaaatgcaaccactttgagttatttggtgactggtttaaagccgaatacactctatgaattctctgtgatggtgaccaaaggtcgaagatcaagtacatggagtatgacagcccatgggaccacctttgaattaggtatgtgttgtcagaagccatgtcacatggctgcttttacttcccaaggaaagaattgagtgcctgaattgacatatttacaaaacacagtgagcaactacatttggaattcagtgtttgctatttcagctgacaagttgtgtgtttttaattactgaacaagaacattagcaaataacaggatactacagggaaaacatgataaattacaaagcactgggtagatgtaagggattattgccattaatcctgctttactggtaaactgagatagaaaagatgaagtgacctgcccttgaccaggcagttccaatgccatgcttgcttggagcctgaacactttgctgggtgaccccaaagctgcctctgcagtttgcttgcaagcaaattagcgtcttataaaatcttccactgaaataatccttaaggtctttgtaagtggacacgagagggaaaagatgactaagcaaattaaagagagaacaggctatctgggtttgagattctgtttggtttttgctgacttttagacatgcctttctgctaccccctgggctttcctagtctagggatatgcataaccatttcaaatctctgtctattttggcctcctatttctctcctatatgaataatggagttataaattctccacaaactgggcttggcctcagtgtctttttgtcttctgcacagttcactggactttgtacagagagaagggttggatttgaagagttagaaatacagtacatcaaagtttaaatagaccttgagtttgctttctttgccaaccattttaagaaaatgtttttacttcaatcctaacccattagataacaaatgagattgtgttttcccttaggatatttgcatttcaccaggcttccttacattttatactaagagaattctagtattttaggaagagttgagtaaatttaaggatgtacttaatttgctcattttcctactagtgtgttaaaagttttcagctatcacatggaaacacaggaaacgtattgtcctgttgcataaacgaacagcttcactttagagctgtaacctcaatagttggcagtatgtttgcagaataaactcatagtgaaaaatattaatctgtaaatcatctattctttgaagaaatagggcttttaaaagttatatttggggctgggagtggtggcttgcacctgtaatcccagtgctttgggaggccatggtgggcggatcacctgaggccaagagttcgagaccagcctggccaacatggcgaaaccccatctctactaaaaatacaaaaattagctggatgtggtggtgcgcacctgtaatcccagctactcggtaggctaaggcacgagaatcacttgaacccaggaggcagaggttgcaatgagcagagattgtgccactgcactccagcctgggtgacagagctagactccatctcaaaaaaaaaaaaaaaaaaacagctatatttggtttggagagccaactataaatgagagagaaaactgttttacaatttacagtattctaacaaaataatccagtgtgacagggaagaagtcatcttggacgaattacataacttctctaattttttggtgtcctgatccataaagcagagatagtgataactacctttcaaattttctacaaatactaagtgagatactatgtgtacgttacctggtatacggtaggtacttggtacaaatgccacttgactttcctacctaattatcctgtttatccctgactcccagccaagatgccaattctgtatcttcatagtatggtatttcctctttggtactctgaatattcttcttttgattggaacttttgatagacaaactgtgatttctttgaagccagaagctttatcttttttgccttgtgccctttattttgccttacaagtggaaaaggttgaagaaatagtgaactaatttgaaatggacagaaattattaaaaattttgttattttgtagttccgacttctccacccaaggatgtgactgttgtgagtaaagaggggaaacctaagaccataattgtgaattggcagcctccctccgaagccaatggcaaaattacaggtaaaatgcaatcaagtgtgcatttctttgtgcgctcttcctgcctgacaggagtattccaggagagtaccatgttgctgggagaagtgggagtctgaaggctggcttggtcattttatggtaaggtgtgagtcatgatggtccttgaaattggggtgaggctgtgctggtcgcccatagcggcataaaatgggttgcctgttggtggttctgactgcagtcggggatgggaggcactagacagcctttggctatagtgggactttgtagacatttattttccttaggaaagctgctcttctctgtctccgcctagatggacagcttcagaattatataccccctccctggttctgtagagtaatacccaataaacagagattctgctcttgtaccctgaagccacaaaaaaaaaaaaaaaaaaagcccattagatatttaattccttttcactgccccccgagacctgctacttcaagtacctgtgctcttataattagagttaaaagtgaacttgcctaggtctttgtagggacctggaattttttccttgtactttcagaggaaaaccttccacagtagaggggacactctgccttcctcagccttatcagggatggaagcctgatggggttcagctgctcttacttcctttggcgcctctggcccatgtaggtgtgtgctgaggaactggggtttgccctgaagttcctctgtatgaataggtggcctaaggaaatggaaagtgtttcttagcactgtcctgcttcttgctttcagtaggaatctctttctgtacatcctggtctttatgtcatttttttaggttttgactttgcctcttttgtgaaagaatgaatcatgacttgacttggattacattttactttgtcttttaaaaccggcaacagcgcagtgcccttttgctgtgggtcagatagattcatggttgtgatgcttcccttctcaatgtggggattaagtgccccctggtggaagtatcaggtgacagttcactgtggctctgcccaggagttcctaggagatcacatcggtaagagctaaaacagcctgtcaggcaattcctggttttcaaaactgaattattttaattgtagacccttgagggtacattattcaaatattatgctataatattcatatgatataataggtacttattgatttactgaaggcaaaaggaaaagcaggagtgagatttcttttcccattaattcctttggacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaaggtaatgctccccaagctgagggttttgttgtgtgtctctttagtggggctatgctgacactatcacttgagcatatagagtctgtggatagtatatgaagtcttaatgatgagcttgtgagccatgatgtgaagatttatcccagaatgattcctcacctactcattgaccaaatcagtgctccctgggttaccagcctaaacatatcatataaaagaggacactggttccaggctatttggggcagatcaattgcagtgatctaaaagtttttactggtcagatcagatatgattcttttggttcccatatagagaaagagtagtgtgttcttgtgatggatagttcaactcaggcaggctattaacctgaaagacttatttgtggacgttacagagaaaaagagactaaaaagagccttttaaataaaaccctagataagaaaatgaagataaagcactgaaccaagtaagcctagcctaataaaatttaactggggactgaatctaaggaattatggaagccctgtatgaatttaatttctgttagtactaaagtcaagtttcagtttgtttggaagtttgtgggggttttagtttttttcctttaaaaagttctgcctgtcccatcttcaaagcttgtgatccttgctcttgttttttcttcccctgtgcttggcctgttagcggactcctctgataaaatgcctaatgatcaaggtaaatgagtagatggcctctcttttctttcctttcttttgtgacctattattagcttttggtttttgtttcttttttttttttttttcctgaaaaatcagcaccatgtgttaaaagccacacagttattggccaaagtagagttgagtccatgttctgaaaagctggggaatttatgtagaagctaactaggctggcagaagaaaactgaaccagtaaactggtcctgcagctgtaggagattcgtcttaagtgtggatcagatcatcctttgtgctgagatattgaagttctgtgacaacgataagcatttaagtcatgattagaccgatcataccaattgttcatgtttgcagcagttgttcatatttgatcataccaattgtttatatttgtagcatctagaattttattagtgtctttaagtggaaagttgtatcacattcagtgaataccctattttcctcttcccacaaagaatccacaaatttaccttactcaatgttgtgattctgtgtgactaaattactgctttgtttattctgttaccataaacttaattcagagctcttttttcatttctccccttaaatatatctgatcatattaaaagaggatcaaaactatttgaaataaaaacttaggccacgtacggtggctcaggcctgtaatcccagcactttgggaggccaaggtgggaggatcacttgagcccaagagttcaagactagcctgggcaacaaagtgagaccccctctctacaaaaaataggaaaaaaaagttagctgggcatggtggtgcgcacctataatcccagctactccggaggctgaggtgggaggatggtttgagcctgggaggtggaggctgcagtgagtcgtgatcacaccactgcactcctgcctaggtgacagagtgagaccctgtctcaaaaaaaaagtaaataaataataataatagtgataattgaaatggggacctagcaaacaggggcctccatgtcaccattcttgaaaccatctgtcaatagtctttacactgtaactgccatggtggagggatagctatattttgtgatttttatctctaggaagtcagctaatgctagtatgttttccatactgagaatgaacattaaaagtaaatttaattattgctctcttggtttaagagtagttgttagaattgcaagttatttggatcttggctaatggcaaggaagagtcagaacttgaggtatcaagttttccagaacactttggaaatgtgtttgcattcagtgagtcttttgcactacattggagaaactgcaaacatactttctgttgtgtgaaagtgcaggaatataaaaatacccataatatatatatgcacagaatataaatgggctcattgttttctcacttgattccatagccagagtgcaattcttagctgcctgacacctctggtatttaaaattctttactcattgatatttttggtgctcagttcatccttggaatttcttgttcatagtttacattcaagagaaacaatgttgggaaatacaggaatataaaccatccagtttgttagcaatgtgtgttctttgacaattaggtacataatccaatgctctggatagtttggcttaaatgtagcctagctgtcaactaagtacacttaaacctgaagagccttgcaggtgctaagccatctccaccagctagactttgtcatagtgaaaagcatatgaggaacaactggactcttaatctatggtgtgtgtcacttgggagaaatgatggcatcagaagtaaggagataaagtaatatgtgtggacaatggaaaaagggccagggactgtgagtaaattctagaatatgcccttttggatatccaggaactcctgttaccttcttttggtaggttttcagtttctggaagcatagcattgttttagtcactggatttattctgttagatgaactgcatacacaaacttcagattttaatgttttcatttcattgaatatatgtatctcctgataatttatggaagtacttgacattagctctaatgttttgcagaaacacctagtttatacatttctagtaaggctttatttgtagaaataactctcatttataagtgttttttgaagcttcatgctctctgcctctttaaagagaagattatactctttcgtgaagattttttatgcttgtaataggagtggttaacatttatggaacatctactatgtgtcagtcagtattaaaaatattttatggtattaaatttccatttaatcctcacaacagctttgtgaagtggataccattattatccctgtgttacaatgagaaaactgaggcccaaaaagaataaataacttgcccaaagtcaaacagttgtatatgatggaggtaatatgcaagtgcagtctgtctattaaacaatgtgctatattaacctcatagttaacttcataaaacagcttttactttgcaattctttcagacctctttttcaggagaagtatgatattgctttctgggtataaaccttagattgacacctttgctttattggaaaaaggtcctcgtatttgcttttcccaagcagcttttcctataaatgtgaagagcaaaattcaaggccaagtataagaattttttaaaaaactgatatttgcactttctgaggcctccttctggggtggtcctaggcctgaggtcagcagcctcacttagtatgttccctgatgatggattaggagacagtgtctttttgagcaactaggaggaagactgtttttttcagcctctggaatgtttaggtgactgagcaggaactgagaacctgatttgaacttccatttaccttcctgctcctgcttagcttagggtaactttatattcagaaggacaactttgtaatttgagaaaagaatctaaacaatactaacacctgctaggtcaggtattagtatccacatagccaggtcccttggaagagtatagttctttaatgtagacattaacctaattagtccccttggttgcttttctaggagaagctacttttgctgtaagtcctctgagcagtcctttgggaactgtttcctaagctagagaaatagcacctactgtcccagcttctaaacagcagtgacagtcagctcacagccgtgagacaagcgtgtcagtctttcagatgcctcattacatagaaagctataccttagtttgctttccacacatagactatagattcccatgatttatgtgctactttattttctcatggacagaatagactaaaaattgtgttttttgtttaaaacactccctagctatgaagtggactgtcacgccaaatgtgtggggtcattattgacatgatttcttctcctttagcctcagggtctggagggaaaggaagccggctgccagacctaggatccgactacaaacctccaatgagcggtaaagcctttcccatggcgttttttgcttactatggacatgaagcacttttgcttaaatttttgaaatgtcctttatagcttgtgtgtggtgggttgtagcatattagcctgttttcttttattgctagatttaagtgtttgccaaatcactccaagcccatgtgtcgtaggacccataaatcaaattgtttccccagttatccaacttaagattaattcctaaacaatttgttcatcctgttgcctactgcctctagaaaagagttagagtttcgctttcaaaaataaaccctctagtgggattagccaccatccaaaccaagccaaacaaatgcttttagaatcattaagttcttccagtgctactacatactgcagtgtttttagtttagcaattctagaaaattcttccactctcctagccatcctgagagctggtgccttctaatttaatgatgacacccccgtctttacagagcttcaccatatataagctactttcacacatgaagtcacaattgattcttacaacatggtgaagcagggagaacagataccgttattcccgtttaatacattcagaaactaagtggagaagtaacgtgcctggggccacgtgctaattgtggcagtcctaggaccaaaacccagggcttctcatttctgattgtgcttttcccactgtcacattcagcctaaaaaagcagtgggtgctgtaccagacgtgggaacctagagtggaaagtgtccacagaagtagttactaggaatgacccttactgtctcttcacatgtggaagagagagacatatgagagaaacgcctgtcccctagtaactcatagtctaattgtaggaatacgatgatgtcttaatctccagctatctatttaaatcaaaagtggaactgcccagactttaatgaaatcagccttaaaagaaccagacaaacttaacatccttccagaaataattgtgctccaggttctaggactctgtttatgagtttcttcttctccatgtgtatgtgacatttatattgtgtccacagtataatttttaaggctgtgaggaaggtaattactcctttgtctttctttcattcatgtattcactcatgcatgcatgtttttttgttgttttggttttggtttttttttttttttgagatggaatctcgctctgtcacccaggctggagtgcagtggcatgatctcagttcactgcagcctccacctcccgggttcaagggagtctcctgcctcagcctctcgagtagctgggattacaagcgcctgccaccacgcccagctaatttttgtgtttttagtagagacggggtttcaccatgttggccagactagtcttgatctcctgatctcaggtgatccgcccacctcggcctcccaaagtgctgggattacaggcgtgagccaccacgcccggggcccgcgtgcacgtttttaaagatgcaggctctatgtgacaagctgtgggagcaagaggagttaataacaaactacctgataaagggaaagcttcctagaagaggtgccgtctaacccggatcttcaaggatgctagaagattgctaaatgtcaagaaagggattggacattccaggaagcaatatcagcatgtgcagaggcatggcaatatattaataaaacagcctgctctctccaggagtcacactgcatagagaaaggatagagattgagttgaaaatgcaggttggaatcagcctgtcaaaaactcaagtaccagtgctaagaaatatgagctttatcctacaaataacatgtgaaatatctgacaccactggtacactatgacatccatcttttattatcaactgttattactctgatagcagtgaagaataagttgggggctaagagtataaagtcaggcaagaggggttagggagctgttacaggccaggcgtggtggtatgcacgtgtaatcccagctactcagaaggctgaagcagaagaatcacttgaacccgggaggcagaggttgcagtgagccgaggtcacaccactgcactccagcctgggcagcagagtgaggttccgtctcaaaaaaaaaaaaaggaagctgttatagtagtccagatgaggcataaagaaatggcatatatattgtccctggtaggactgttctttggcagctcactcttgctgtatcttagaagaaaacttttgtccagctcattcgcaagaggtcagatgcgagtaaatgagaatttgtcagtgaaatgcaggaaagaaccacctccacctctgcctgcctcccatacttcagctccccagcctctaatttgcaatgcctgccctgccaagtacccaaccctgtagttcagcactgctattaataacagtgttatggaaagccctactctaatatgaacagtatggtccattttagtggccccagtaccatggtctttcccaaatataaaaacattattttattgaaggtcagtatgtacagtttaagttgtctgtctgcttacctttttctcataaatgaaagataaaaatgattgaaccaaatgtagaataggctcttaatcccttctaaatcagccccagatttagcactgtacttagatgtagtctgtaaaatcaaagaagcaaagttggagggtcagttaatccggcgttgtggaagggattcccacaatgagtgtaagtttggattagaacataaatttgggccgggcgcagtggctcatgcctgtaatcccagcactttgggaggctgaggtaggcagatcacgaggtcaggagatcgagaccatcctggcaaacactgtgaaaccccgtctctactaaaaatacaaaaaaaaattagccgggcatggtggcgggcgcctgtagtcccagctactcgggaggctaaggcaggagaatggcatgaaccagaggggcggagcttgcagtgagcggagattgtgccactgtactccagcctggacgacagagcgagactcaaaaaaaaaaaaaacacataaatttataagccaggttgttaggagaaccacttcaggagattttttcccccctagacggagtcttgctctgtcgcccaggctggagtgcatggcgcgatctccgctcactgcaagctccgcctcccaggttcgcgccattctgctgcctcagcctcctgagtagctgggactacaggcaccgccaccatgcccggctaatttttttgaattttttattagagacgaggtttcaccatgttagccaggatggtctcgatctcctgacctcgtgatccacccgcctcggcctcccaaagtgctgggattaacaggcgtgagccactgcgccaagccaagagatttttttttaaaacacacattccaggccatactttgatggtaggaacttcttccacaacatcccacgctggcaggatgcctcttaagtacttccaataactaaagatgcatttcttggcaaggcagctcatcccattattgtacacctctgattgttagaaaattaagagagagagtagctagaaggaaagagattagatatccatggtggttagacatgtgtggtgggatttgccacattttataatatgagcatacataaataatgagtagggaggcaaagaaacatgtttcaagaaatggaagacagtaagacttagagctaaattacaaagcctagagctcatcctttcagcaatggggaaataataataggaaaaggaaaagaaaatctgaatttccttcttcagggtcctaaatggtccagcctctgcagcttttccagccttatcccttttttcctcctcacttccttccttctgacttgcatctctctgcttaaacaacactggctgcatttctcttccttgagaagagcttgttcctgcctcagggtcctttcccttgtatgatggaatctttcttactcagatctgaactcaaatgccatcttctcagagaagctttttctaaccattcaatctaaattggctacccagacactctgtatcataacccctcattttctttttttcacaccgttagttattaactaataatttcatatttatcgtttatcccattcccccgccaaacgttcacatctttgttgttcaccattgcaccttagtacctagaacaatgactgacacatagtaaccattcagtatttgtcaaattaagccatacttcagacctactgtttcttgaagttgaacaagagaattaactctgcgtaggctgtgtatttataaaaacagactttacttttcatgcaatttttataatctcagatatctgcctgttggggaaaacttctgctttgtatgaatgaacatttttaaatggttttgaaaaccagaaaactaaatgacttataagtggtgctttacaaaatgagtttatatatcacatgagacaccagagagccaagactctttatctgtctaagtatatctcaacctttgaaagctcttgaatgttcagtacaatttgagaagctttaattaagtactatctttgagcaggctctgtcctgagcactgttcataggacagactcttagctgtctaggagctcatcatctagagaagagagccatgttcacgcggcacttttatataagtcagagcaatgagtgttatcaagaagttcacgtgagatattaatggttctgtagcttgatagtatgcatgttttaaattctctaaccctaacacatgtaccatttctctctctgcaggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagtaagaagccccagatgcaccccttagatttttggcatcttatcttttgcttccatgtgacttctgtatatggagtggtacacaaagttaagacataaaaatacatgaaaaggaatttaagatattttaaaagaaaatgggaagtggttcctcttatcagtcagtgtcctggcagaaaagagctggcacatttaaaaggatttcaaaagaggtaatttacaaagtcataggtggggttagggcaaactaggcagggatattcagaggctagcagctatgataagacaccatcatccttgggcctgaaagggcaagaggagagagctgttttcagaaatctgaagcagtaggagagggcttcctgacaaaagcaaagtgggtgctagaggcatgcagccattgccagcctcctcccagcgggcagtggcaggaaaagaaacacctcctaccctccagcctcttgccagtgtctagtattagctatacccagctggaagccaggaaacccagcaggattgccaagtaatagttaatttagctcaacctctggggtcagagggccaactagagaatagatgtggtgagaaaagtagaaagtgtctggcattgctggtcaccccctttggagcaccatctgtacatgcccacagtgaacccgatgcccaggagtctgtggacattcttacaggctgtgtcacagcacaaatgccagcccagttggaagaagaccataggcctgtcattctaaatctaagtttaagaatatttttaaagaattgctaccaagtgtagagttgggggtgggggtaggattgctttaatgaacaggaaaggatcattgataatcaatttatcagtttctcagagcggctgaatggctgctagccttgaactcctctgggattttgagggttgtggctaatggtctaagtgcagatagcaagggggctcagttatgtagtgcttgctaataccatacagtcctacacttgaaagaatccttgatcctaaattacattcaactcagatatctggttagcaaaatagatagaaaaaaaaaaggagattcctgagttattcctaatagcagtaccataatgtgcataataaaatgactttagttgcaatatcttgaaagatcataagatgggggtgttgctccgctagagaaagagaaattcatgtttatgtgattatccatgcagacttgatctgcccaaggcaagaatgcatgtatttaataatcataaatttgttcattttcactgtacagggtaagtacaggccaccctgtaactgctactggtaatgactttatgtcattttttgtaagttatgtgatattttaaatctctctttcttttgcccaaatgaaatagctttccatagcttgtactgtatcacttttccaagaaaaatggaggcttcttttataatccttctgaccactgcctcttatagctcttcctttttttttttttttttttcttttgagacggtgtctctctctgttgcccaggctggaatgcagtggcacattcttggctcactgcaacctctgcctcctggattcaagcgattctcctgcctcaggctcccaagtagctgggattacaggcacccaccaccatgcctggctaatttttgtattttttaagtagagatggggtttcaccatgttggccaggctggtctcgaattcccgacctcaaatgatccgcccgcctcggcttcccaaagtgctgggattagaggcatgagccactgcgcccggccctgtctacttttaatagtggaaaactattatttttaaagcctcaaagactacatttttttttctactctagaacttttcttcaagcctctttatttggcatttaatatttatctatctatgaacttgattttatatcagttttagaaatattgggatctttatttttctgttattgaaataatttgaaaaccaaaatgacagaattccttagtgctttggaagacttcaaattcaaagtaaatttttttttagacaggattttggtctgtcacccaggctgaagtgcagtggaacaatctcatctcactgcaacctccacctcccgggttcaagtgattctcctgcctcagcctcccaagtagctgggattacaggcatgtgccaccatgcccggctaatttttgtatttttagtagagacagggtttcaccatgttggccaggctggtgtcaaactcctgacctcaagtgatctgcccacctcagcctgccaaataaggtactcagtcttcagattgaaagtaagaagatgagttgataataggctctattctctgtattggcacgtcctacagatttgggtccctttgttgaaaatcatcatatcagatcttcatggggttttcccctcccccacttccccagttatctgctttgcaagtattccattgactgttgaaaaatataagcgagcttttcttactacttttcttcctacttttcttcctctgtaatacctgaggttcatttagatggtagctgtttacagagtcttacaacctcaaagttgatagagcatttagagaatctaaaccctcgttggttctcagcacattcccccttagcccctgactggcaacaggtaagctgggcttctccttcatgaagaaggcagaagctgtcagataagaacaacctcagcacaccaccatcaaatctgacacctttctacactggtaatcatcgtttcctcctccctcctaagtgtacttcccctgtttgaagcccgttctaccctttaccccctgaatctcattgtcttccatttttctaagaccttttacctgctgttattcctctctccagcatagctgacctcttactcgttattggccgcctcttcagtatttaagtgtgctctaacttcttccagcttaaggaataattataattataacctcacccccacccccaccccctgtatggtccttttcaccggctgcttactaacctttcttctccaccacagaattccttgataacttgcttatactcttatgtctgttcactgcctacccatgcatcagccctttctaatctttattctgcccctaccacttcaccagaattgcttttgtggaggtcaccagcgacctgtgtattgctaaagccaaagaacatttttcagttctcatcttagtctctcagcaacatttcacacagtcaaccattccttccttctggaaacattttcttcttttgtatccatgacagcatgttttgttttgttttttgttttttttcataggtcctcctgtctacctagccatcaaatacagacattcctcagggcctgggcctggacttactctcttctccttctgtgttctccccaagtgatctcatctgctcccgtggcttcagcattccagctacttttgtatttctgtctccagccaaggcctccctcctctgagtatcagacttgcacacacagttgcctcttctacatttcctcttgaatgtctcagagacatttcaaattcagcatgtccagagcagaattcatcatcttttcaggcaaacccgcttctgctcctttattcccaatattaagtggcttaaatcagaaaccttagcatcatcctgtactcctctttcttctttactcccacctcaccctacatccatttatttaccaagacctgtcatgtctgcctcctgaataactttcaaatctgcctcttgcctctactcccactgtcccatgccatcagttatggctgagattgcagtagcatcctagctggtctcctcttctatccccaaccccacagagctattcttcacatcacagctggtataaagttttaactcaaaagtgttctccttactctcttgcttaaaaccatttaatggtttctcattactcacaaagggaagttcacactcttagcattgccctaaaagctctttatgatctggtccctgactacctttctagtattatttcacatcattctctgcagggttcactatgtccccaccactcaggatttcttaaaatccttctaatataccaccagggcattgcactctgctttagggttttgacataagctgatttcaccacctggaatgcactttctgttccctttaggtcttagcttaaatgtcacttcctcctctaggtttttcctgttcagcttaagtccaactgttaagaagttactctaacacttgacatttcagtaagctcagaacattttaaaataatagttcaacgtctgtattcctcactttatcaaaaattctgagggcacagcagtctagcacagggtctggcatatactgggtacccagtatgtcctcattaggggtaagtaagagagtgaatggagaagctaaaacacagagaagtagacattgttgtccccattcttgactccacctagttggtagtcctagtttggcagtcttcgaagttgttccggccaggtacagtggctcacgcctgtaatcccagcactttgggaggccaaggcggcagatcacctgagttcaggaattcgagaacagcctggccaacatggtgaaaccctgtctctactaaaaacacaaaaattagctgggtgtggtggtggacgcctgtaatcccagctactcaggaagctgaggcaggagaatctcttgaacccaggaggccaggttgcaatgagccgatatctcgccattacactgtagcttgggcgacgagcaaaactccatctcaaaaaaaaaaaacaaaaaaagtttttgcctccctcctttataagccacagactttccctctactccattgttatgtttctacattgctctaattagaaacttgtggatgaaccttctggttatgagattatataatgaaaaatgctatcttaatcttttaacagtcaaaaaaagtagtcacaaggcaggattcaaacataaagaccctggtaagtatctctaaatatgtgtggacaaaatagagatacatttactctccccaggagcaaacttgttgttgttgttgttgttgttgggggcaggaggtatgtttttagtttttgctttttttgcttgaaacatctctcagaaaggaagttttaatcactcaagccttttgacaaatacgttcaaatgagttactttttaaaagctcctctgaacttcgtgcctaggaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagaggtaccattttaagtgcaggttttttctcaaatgttaggaaactattttcatttaaatctttttttttttccctgagtttgccttcatttggcaattcctatatgagatcagatttagagaaatgtgtatgataagatttgggaacatatgatgaagaatacctagcttcttatgggagagagattctgtagccatacgagacaatcttgcagatcttttaggtctctcatcaggcttcagcagcgtgatattcaaggatttgaggctagctagcccatgtctgtgcatttcattctgtgtcttcagctggcttccagcttgcattgtggtattcagaacattcttggtctggaggctcttatagacaccctgtgaagtatggtgggcagcattgtgacatccacattgattcagcaggaactcttgtaatgctctaatgatcattttcctctttatttcacttcttacagaaatgtcttgtccccattatgctgtttgtgaattctgaatcccctactagaaatgtttcactgttgaggctgctcagtggcatagggcacatgctggtaactaacctccacgtttaacatctagggcatgagtcagaggacagcatgtctacactggctggaaggcgaggaatgagaccaaaaatgatgatgccctttgactcccagccaccccagcgtaagtagaagcatctcttttcctcagtgctaccaatctgttcagtcatgtaggggaacaactatgaatgatctttttgacttcacttgattctaacacaaagataatctaccaaagctttgacaccttgaaggaggaagtaccaaacacttgccatattttgcaacaaacattattcttgaggctagcgtcgttatgtttatggtaaataagctgaaaagccaatgtctccagattcccaggaataggggagtaactagtctccctaaaagtgcatcatatctctatgggagagatgggaaagcttccctcctccagactagagctaaggatggtctgatgttacaagttttcattacgctgcctgacaccagtgctgatgagcacctgtgaaatttatttttttaattaatagatttgaaggccaagcaagatggcccacacctataatcctagagttttgggagaccaaagtgggaggattgctggaggccaggagttctagaccagcctgggcaatgtagtgggaccccatctctaccaaaaaaaataaaattaaaaattagccaggtatggtggtacatgtctataatcccagctactcaggtggctgaggcatgagaatcacttgaacctgggaagcagaggttgcagtgagccaaaatcgtgctgttgcactccagcctgggtgacagagtgagactctgtctcaaaaaaaataaaaaaaataaagccaggcatcgtggcacacaacctgtagtcccagctacccaagaggctgaggctacccaggaggctgagatggaaggattacttgaacccagcgtttaaggttgcattgagctatgattttgcaccattgcactccagcttgggcaacagagccaagagccagtctctaaattaattaattaaaataataaaatttaaaaataaaattagtagactttatattttagaatagctttaggttttactgtgtggaattttttttttttttttttttttttttttgagacagagtcagagtcttgctgtgtcgccaaggctggagtgcagtgtcacgatctcagctcactgcagcctccacctcccgggttcaagcaattctcctgcctcggcctcccaagcagctgggattacaggtgctcgccaccacacctggctagttttttgtagacacggggtttcaccatattggccaggctggtctcaaactcctgacctcagatgatccacccaactcggcctcccaaagtgctgggattacaggcctgagccaccaccacccgcccagccggaattttttaaacaacatttttcattcttgattcgtgcctcactttgataagcataaaggtttctgagcctcttttaataatagttgaaattcaaaataaatatcatgattaaaccagaaagcagtgggacaaaccgattctttcaaactactatgtcctctctcgtcactgttttcaaggaagtgaagcctttcagactagctagcacagtggggcttgcagttgagggaattctcagccatctgtcaacaaacgatgcgatttaatagccatgaatatcatacatgcaacgaggtacaccatgacatcgtgcacttggaaaagttcctcaaatccccaacctcttggtggaagcttcaagcacgtggatgtctgcacacgcattccctctcccacaaacactgtacacaaacatgtaagatactggattacaaaaaccatctttgaaagagtaataccctatttgttaacaggtaatttcagctcaaagtagcttatgcttgtggtccttgatggaaagaaaagcctggacttggaaatgcaggggaaaaccatggtttccctcttacaagaggtgccctggatggggttcccaggtttaaagatacaaatgcccaagaagagtaaattaatccatcccagttgcttctgattgatcaagaagatgctagcactatactcttatttgtttgttttgtataagacttgagttcctacctgaactggcttattttgaaaacttgtaaaattttactatctttatttctagatgtattacttttaaatatgttaagtaaaaaagatatgttgtccagttgatatcattcttctttttttgatgttggggaaggagtttgcaccaatatacaatattatttaatttgtgccttaacagttgggtgggtaagtggaatcttttaaaaacctgcaaccataagatccacttgtggtctttaggttttcagatactgtttttaaaacccgcatggctacagttctgtttcacaagctggtattccctgagctctgggccctggaatgctgcaggagccatatacccactccccaccttccctggtcttaaatgactgagcagtgccaggaagggtttgctggtgctgggacatggctccatccagggccatgcactgaagcaacaagttcagagtcagctaacagctgctgatttcctactatatcctaggcaggcacattcacactgctttatttttttttatttacttacctagaaagactggaaatgccttataaaagggaaaaagtcaattttgtttttcccttgtgagagtcctaaaatgctttcaaattgtactttcctaggtaaaaatcaggtttattccccctaccccagcctgaattctggaaaacactgagtctgaagcacctacttctaaaaactacctgtcttcccctagagttgctgactccccagttacctcaagagccctcctcagacagctttcctctgttgttttattcccgggcacaacctggagcctctggtccccaagagcagcacctgagggaaagccccttttttgttcctcaggccttgagaagggaaggaagggtcagcagtgctcaagggtcccagtcatgccacctgcttgcttgcatgtggccaggacaagggatagctggaaagtaaaggcacccattttgttgaccaggatttcttttcaccagagtaatgttgaatagccccacaaagactttagggagatccttggggacagaagacatttcaataggccactaagtgttaattaagtagtattattaagttcatgaagcctttgtttggagaaaaaaagattcccagtattgttagtcagctttggcctatttgcctgtttggtgggggtagagctggttatcttgatcttaaacgtgccatttctacaaccactccaagggagttcctcagaaaagtttattctcagactctgggcttctaattttatctgtttccatctcagatggataatgaagcctcatagaaagtagtacatggaatctctgtcttcatagaaagtagtatgtgaaatctgtgtggaaatttcagattctttagctaaacgcagttaattgaatccttagccagtgtgggaaggaaagagccatttattctcttacatgcagatgggtatgtctgagtccccagactggaagcagtaaaagatggtgccatcagccagtggttcatgcttttagtactagatgggaccatcagagttcaattccatttgcatttattttaagacatgaaagccgattaaacagctacttatttatttggcctaaatacccattaaatgcttcattcagcagttttaacaaaggcagaatgaattaggaatgtactcgaaaaagaagggacttctttctatccttttagcaggacaaaatagaaaatttatgtgttggcttatggatttatattttgtgacatattcaaatagatacttgtaataactcatgtaatccatgtttattatagtagaattggaaaatacagataagccaaaagaaaaatattattttaatcctgaccactcttccctgcaagataataactgttaacattttagtgtatattcctttttttctatatatatgtagacatatgcaaaagagtatcttcatttttaaaaaacaacgtaaaaatcaatggctaattgaccagatctagccagctgccaccaaaaaaccaagggagtgtttggattgtatgggaggtgggaagggggtgactttgctcttaaactgtgatttgtgtgtgtttgtgcaagcatgttaagcatttctctgtcttgtgttcattcacagctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacaggtgagagatgaggatcaagcccagatggaaaccattccaaaagagtcggcaagcagaaatggggaaggacttgccctacttagaagagggatttggaatttttctgttttatttaacttagcataacatttctgtgactgactcaaatttgtttctgtaaaattcaccccatatttctacttaagttttaaacattcagtgcaaggttttcttttagtaaaaacagtatctctaatcacataagcatcccttgttccataaacttgcactttaactcagtcttttttccaatttctttcttttaatcctctagtttgaaaggaaaactcatcctgggtgatttcagacactagtggttgcctttgcctggcagtcactgtaacattgggtaggtccaaaggttaactgttacatacaggttacttccaccgtggaccaaagtgcaaacaacatccaaggagcagtggggccaccagccacgaggagttgtgtgtattgtaaaccacagggtgcctgatgtaaacctcaggattattaaaattaggaagcgatgcacaggaatagatcctctctgaagaaacagaaaattacctctgaagtgtatttaaagaaatacgttgctagacaaacatgtccccagtttggaaatcttaggaaaccgcattatcaaacagttttaaggaggaaagaaatagtgaaggtgtgaggacagtaagcggcataaatattcttcattaattgaaaattaattttcatcctcagttttaaacggcaagcctagtaacttcccatatattcaacatattatttttccaccatttgaaacttgcctattaatagttattatgttactgatagaactgagttttgctggtctggggaataagggaatttcaagtgagttccattttaaaagaacctcaaaactttatgctggaaatttgggtttccagtaatatccccattcttttaagttttttgtttttctttggtttctttgtttgtttttgagacagagcctcagtctgttgcccaggctggagtgcagtggtgcgatctcggctcactgtaacctccacctcctgggttcaagcgattctcctgcctcagcctcccaagtagctgggattacaggcacacaccaccacacccagctgatttttgtattcttagtagagacagggtttccccatgttggccaggctggtctcaaactcctgacctcaagtgatccgcctgcattggcctcccaaagtgctgaaattacaggcgtgagctaccgcgcccggtccccattctttcaagttttcatcaatcataaacatacccaaaacatcaaatgaagctttattaaggggtgcctaataatttccaacattagctactcccaaagctattacctgatttggagaatgctgcttgaactcacatctaaatttggccttccaggctgagcagtgtggctcatgcctgtaattctagcactttgggtggctgaggcaggaggatcgcttgagcccatgagtttgtgaccagcctgggcaacaaggcaagatcccgtctctactaaatattaaatatatatatatatatatgtaaaaatttggcctttctactatctccctccaaatcccaatttggagttctgcatttaggaaagacggtttccaagatggacagttactccagccagctgcatggagagccaaagtctgccttacagacatagtctcaaatagaacagaggaccagaaagcagcctccacacctgctcttagaaaggaggttttgtgcccaaccctgtttctccatctttaaggccaaggaatctcacatgctaggatgtggtcctgcctgagtggatggcaggcaccttccaatcaaatcagccccttcctccttcctcctgggtttggggattggagagaagcatggcagctcctacccagccctctcccttgtgatctagtattggtaagcattccctgctctacggacctaggcagaaagtgaagagagggggaaagaataatttgcattactgagagaggccatgctttgatgactagttggataatagaaggtaaaactaaagtgatagacttactgaagactgatttgaaatatagagcaagtatccagaaatgatcaaagttctttttcacgattgtactttgctaagctcctgtgtctctggagctcagagtgttgccacagcttggtatatatgggctaagcagggccagtctctgctctaaggagcattcactatgtcaccaccacttgacattggaaaagcactttcctcttgtccaatcacttggccagtgtgaactctgtgtgtcttaactctttaagaggcaagtcagtcaggaagtagcccccttgccaaagcaggaattttacttacagcatggattctaagcaggccagtgattttgcacactgtcagggagcacccttcatgataaaagcaacgtgcctggggcccccggagttgtgcaaggcagccctggtctgtggtagcaggcctgggtgctgactcatgtaggcaaccccattttcctttttcaccttttgcgccatctctttggccctcagaagcttatatatccagttacagaccgttgaggcagtcaggagaggccggtttgcccagagctgacctaacatatctgtcagtacaggctgacatggcctggacatgagtctactgttctctctcctcctccctgctacccttcctagccagctcctaccctgcccagcttctccctggcccaggatcacagagggggaccaccagctcccccgccgtggggatggctagcttgagcaagcctaagaagatcctcagcacacccctttaaggggtgaggagtgacctaagcctggtagggccaacatagttaggcacacttgggagggtgtacgagtccctcatccatggacccaagatcagaggtgccactcgtgactggtgtggcctgacttctcagagcccaagggcacagattcactgctacttcagcaacaaaggcagggaaatgtgttggatttctgcagattgctcatgctttacagtatccccatctgcggggatacattccaagaccctccccctccccccgcagtggaggcctgaagtcgcatatagtactgaaccctttatatctgttttctccatctgataaccgagacagctactaagtgactcaagggcaggtagtgtacgcagtctggataggctggactaagggatgaggcacatccccagtggaatggcgtaagatttcatcatgctactcagaacggtgcaaaatgtaaaacttatgaattatttatttctggaatttttcatttaaatttttggacagcagttggccacagataattgaaatcattgaaagcaaaagcatggataagggggactactgtacttgttaaggttgaggactccagaagtcagaagaggccttcaggccacctggtacagtccattgccctgagctgtgtccccatccctctcctcacaggtggggaagctggtcaccagctcatgctgttggaagggtcttccttatgtggtctccccgggccttggtgctgcttctgccccacagggtgggggcaagtggtagtctgggtgtggaaaggtgtgtggtggtccagagcatgtgtgtggaagtcggaaggcagggattcagattccaccctgctagttcttaactgtgcaaatgggcaatttgcttaacctcccagtgccttctgagttactttgaggatctagtgaactaatgaatgtaaagcagctggcatagtgcttggcttaaagtaagcacccagtaatttacaaagaaaagaatcttaatagatagatattcaagcaccgtgttcagcacttttcatacatctcattcaatcctcaaagaattatgtgttattctccctcttttgtagatgaagaaactgagactcagagatattcagtgactttgtcaaattcacccagctagtacacaaagattggagtccaggtctgtctgactccagagtccgtgcttttctaccctgctgtgctgccttccagaacaactctgccccttcttatattttgagattgttatcatgttcttcctgagccttcccttctccaggctaatctacccccatttccttctctgaatcaaaaatgcccttcatttggtgtgatctgaaagctgtgtgcagacctctgggctgctctgtttgttgtccaattctcacttgagctatgggttttttgctgtgatgaggccatgcacagtccctggaggcacgaaggcctgtggcattggcctctcctgcagtgaccgccaggccttgtcagcagagctggctactgtcaggtacccggccagccttggtggttagccatggttgtctatgaaaggccactgtctaagattccagtgagtgaagtttttaattttcttttatacttatttatatcttaatatcttagtcatctcaggaacctttacaagtgcttcataataaataatgaggagaactttaaatctacaaaattgtgaccacttagctgtgaggtgaaaaactggaatagctggttgagtacaaaattgttcgagactccattcttatccctggcagtggtgctaatccatgttctcttggactagcactgatcgcaagtgctattgagctggtttagggaacccctagaagtagccaaactgtgggactgtcacatatttaatggcaaaagaaatgctaacatttagactttcctgctgtagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaaggtgagtgaggatggcagcacacctggagggagcacacctggagtgaccctttggctcaagcttgggacaaagccaccccttctttgaagtatagcaaagcaaatatcctccaagcctatcttagcaattctgttagcgtagcagtgtgccattgccccgcccaggaagtttatggcctccccttttctgggaacacttacaaaccggagaataatttgctgggaaccaagggctgaccttttgaattgtgttttatgtgcagcacctttggtggtaagtccaatggcatgggaatggatagcagatctagtctgcccagacccctggaatcacctcacttcgtaaggtccctgcaaactagagaagggatcagggaggccaaggcttggactcatagggtggtgaaagcagaagtaacctcagaatagggaaaggaatcctgtgaagggaaagtcatttacccaaatccacacagctcagtaacagtcccctgacctcaaaggcatgcttgctttctgctcttccaaattgttacctattcatttgctttagaataagccagtggttttcaaaatttctggtctcagtatccctttatagcttaaaagctattgagcacctaaaagagcttttcttcatatgggttatatctatcaatatttaccatattaaaattaaaactaagaaatttttaaagtattttattcatttaaaaaagcaagtatctatcatgttaagataagtagcatatttttatgaaaaacaactattttcctttttttttttttatttgggatggagtctcgctctgtcacccaggctggagtacagtggggcaatctcggctcactgcaagctccgactcccgggttcacgccattctcctgccttagcctcccaagcagctgggactacaggtgcccaccaccatgcgcagctaattttttgtgtatttagtagagacggggtttcaccacattagccaggatggtcttgatctcctgacctcgtgatccgcccacctcggcctcccaaagtgctgggaatataggcgtgagccactgcgcccagccgaaaagcaactattttcaaaacaaaaatatagtgagaagagtcgttttattttttgcagatctctttaatgtctggcttaatagaagacagctggattttcctatctgcttctgcattcaatctgttgcaatatggtgttttggttgaaatataagaagaaaatctggcctaacagatatgtaattggaaaagggaagagtatttttataaccttttcagataattgtggatattcttttttgatactacagcaaaactcagcaagttgtagttttttaaaggtttgtttgtaaagtgaaatctgaaaccttatctatgaaatattcatacttcattccattgaaattcattcatctgtcttgcatttaatgcatgatactaaaatatcacacatcggtcatttagaaaatattggtccactacattatgcaaattctgcaaatagtgatacatttcattatccagtatctaaaaacatattcattaatatcatcaaaatgtgtaagtattaagttctcaagaccatggtggcggatgcaagttttccaaaatcctgatttttacttaaaacttaaattttatcattggcaagaaacactatccattgtgttccttgaattgacaggctcactttgttcattttctaaaagatgtctcaagaaccagtttgtctgtctttgaactaacagtgatattccatgataaaaacattcaactcaaaactcaaaactatcacaagtacctttatttaagacagctgttggccgggcgcggtggctcacgcttgtaatcccagcacttcgggaggccgaggcgggtagatcacctgaggtcaggagttcaagaccagcctggccaccatggtgaaaccccgcctctactaaaaatacaaaaagttagccgggtgtggtagcagacacctgtaatcccagctactcgggaggctgaggctggagaatcacttgaacccgggaggtggaggttgcagtgagcagaggttgctccactgcactccagcctgggcaacaaggagagactccgtctcaaaaaaaaagacagctgtcatactttgcacacagctgaagtactttatgcatactttccattttgtcacatacagtaaggtcaagatttagtaaaataaaaaatatgtattcctttattaaggatggttcttagtgaaactggcttttttaaactgcacgtgcgtgtcagtgaatggctttacagtttggcaccactgccttaatttgtgctaaggctccagcagctcacccactattgcctttgtatcctcagtgcaaaggcaaacacagtggaaaggcaaataatgtcttactataaagagagctttggccttccagatatcctgcaagggtttgtggactaccacactttgagaaccactggactaggatattggttttctagagacagtggaatattttctctggcctcatgaatgccctgctatctccctccttccctcttattccagtaacttttcagagcagtatccctgcactgggtctgtatgtctctctcaccccgaagcagcacttggaccttagggccttcatgaggtctaggggaggcaggcttggccacatatctgatggtgccctttcccctcagctctgaaccatcacattcactcagtgaagacagcctccatcgggactctaggaaggagccggcctcctatgccagtggttgttcccagtgcccctgaagtgcaggagaccacaaggatgttggaagactccgagagtgtaagttcgtggggccatcagtccagccagattgcctgggaacatgccccagggcctgagactgctggtcaagctgataatctgtgcataccaggcccgccacccagaactatgaagcagatacactcattcattcagtagatacagtgttgagcatctcttctgagccgggaactgtgctgaggacttggtgtgctttctttcccatatccactcttttttttttttgagacagaatcttgctctgtctcccaggctggaatacagtggcatgatctcggctcactacaacgtctgcgtcctgggttcaagggattctcctgcctcagcctcctgagtagctggaactacaggcacccatcaccatgcctggctattgttttgtatttttaatagagatggggtttcactatgttggccaggctggtcttgaactccctacctcaggtgatccacctgcctcagcctcccaaagtgctgggataacaggcgtgagccaccacgctcggcccccatatccactcttgaacatcttaaattagcttttcacactagcccagctaatggccccttcccccacatcctgcctgccttttagttctgtcccttctgtcattgttcttttcttggtttgaaccatccatacattccctcagttctactctgtgacctttcctgagcaagatgctggaggagaaagtgcctgagtggttgttctcgaaacaaaaatcaccagggtctttctttgatctttcactctcaaactccagtaaaaatgttttgcctctgaatttccaggtacaggattctctaagcggaaagcttggggcccagagatccagggacataccaactgtgctgactggggcagagacctagaaggggcaagcagtgggccttctggcctgtgaagtcattgtgaccctggggagtatgtgttgggagaaaggcattgtgcattatcaggaaacgggatcctagtgaccttgggtctatcctgctactttccactcttctgagccaccctgcgtgttagtagccagttttctggggccatttgactactgaccacatgaggctttggcctctctctgggctctcctttctgagctgctccctggatccagcccagtaacagtgttttcttttccatagagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaactctggtctggtcaaagagttattttcctttgtccttaaaaaaaaaaaataacaacaactttggggccccctgcttcccagcctctaactgacttcacggttgccttcacaactgtaaagccagtagtctatgaggagactcagggaagggtggcaggtgagccaggaggctgcaggaggtgtttggaccgtccaccagtaccaaaaatgagtcttgtccctgttcccatccccctgttgctgccctgcagggactgagcagcctgaggaatcagagggggcccctggcagccgtccctgaatggagtgcaggccatgtccctgccgcggcagcgcattctgttagggcagactgactgtccacgtggggcctggcctccccactcccagccccaccactcatagggacctgaagctggagcagatgtctcctgggatgcccgcttgccccaggctgcctcaccttactgtgttcactgtgtaagattcctcgtggtgtcccagagtctgggccagggaataggggacctcagcagccagaggcctgagcttgcaataatagaatgagggctaaacacagagcacagtgtcctcactgctccctttgccccactgttcatctgctctgtggctagagtgtactttaggaagcccaaatcccgtccttcccattagccacactccactgggctcaggatgaagtccatgctcccatagctgcaggttggtgcttgtctgccacagcctccaggtccagactaatgttgccttgtgtaccaggggtgtggccacagaaagctaccagtgaggccattctcagtctgcctggagtgtcctctttactgccattctgtcttaagtgccgggcgtctgctgctactatccctcctgtgcgtccctaggtggagctcttggcacatattaccatgatttgtttgagtcttttcctgggccctgtgggctcagtggggacaagattatttctcactcctttctgaatgtctaatgccaggggcagtttctgacaatagcagatgcttgtctcttggatggatagacaaacagtcacgaggactcatgccctggagcgtgctgaaaggcttcacacacgcgcacaagaagccccctcctggcagggatcctagtaggtccccagtgttctggtgctagaacactcccatttcagcagccatggccgtttggcctcctggggtaaacgtgaaagatgaaagatgacagtcatgagaaacgatgctggactgggcccagtggctcacgcctgtaatcccagcactttgggaggcagaggcaggcggatcacctgagatcaggagttcttgaccagcctggccaacatagtgaaactctgtctctactaaaaatacaaaaattagccaggcatggtggcgggcgcctataatcccagctacttgggaggctgaggcaggagaatcgtttgaacctgggagacggacgttgcagtgagcagagaccatgccattgcactccagcctgggcaagagtgaaactccatctcaaaaaaaaaaaaaaaaaagaaaaagaaacaatggtgctgcctcatgaccaacttcaagctgggaactaacacaagaatatcttgcagatttgttctaagatgagcatatggacaagggtgtatacgaagaagaaacacctcttcccctaccccattcctgccccatccatcaacctctcccaattgcagccaccttcctgccagaagtggggagaaccatcaggagagactggagacaagcaataagcaagccatcaaattgatgatgacagggccatgggcagggattggagaaccagggagccaagaggaaccactgctaaccacagacagaaccccagacagcaggtacccgattcttaacctagggttcccagctaccaaaggagggagttcaccaggggtgcaggaggaagaggtaggagacagtagttgagagaaaataatacttgtttttaataatcttgtaaatgtacataatgttggaaaagtgctacttaaaactaccactaccctctaagcatggtggatgatattcatctcaagacacccttttcctcaattaggaacttggtttgtaaaatgaaagggacctaaagctgagctccaaaaggttggtgggagtacctgctgcactatagcacaagaataattcgggatttcctgaaataattaggggtggaggggacacgcaaccggtataatcaacaagatggtgcaagaatgaggggctctgtgggaaagcaccccagtgggaactggctggcctcaaggtgttcaaagacctttcttaaatgggaagatctttttgtttgtttgtttgttttgttgtttttgagtcagagtctcactctgtcacccaggctggagtgcaatggcgtgatctcggctcactgcaacctccgattcccaggttcaagcgattctccagcctcagcctccagagtagctgggactacaggcacccgccaccatgcccagctaatttttgtattttttagtagagacagggtttcaccatattgaacaggctggtctcgaactcctgacctcgtgatccacctgcctcggcctcccaaaattctgggattacaagcgtggaccaccgcgcccggccaaatgagaagatcttgccctatttgcacttctatggagtgaaccccctccagctccccaaatctcatgtaacatctgctgtgtgcacatggccttgaatgtgttactggacactcccccagtgaagaaaacagcatctgggccaacatggcggtgggcaggccatgagtctggcatggcacgggtgacccatgaatggaattggttcgctagaagcaggagctgagggccagaagtgaccataagaatctaaacctgagaactctcagaagtccagggggcaaagggggacacaggtcaagaaatgtgggttccaatcagcctaatccagattttaagaggcagactgacctcagcttgtgtctgagttgccatcagtttacaatttctccctcctcggggtcctggagcaaagcctcatcaccctgttactaggtgtcagccccttgctaatggggtctgccttctgtggacccggttgcccaaaggagaaatctgggagccattctaaattcttccctcaacaccacagcacattgctcagcaaatcctgccagctcttacctctcagaggtcccccagagtagctctttgctgtctggtaggcaaactactaattaagccccctgcctgagtctcaccagcaatcagggagcgatcctccacacaagtgttcaggtgctgcttctaacgcaaatctgatgcttccccgctgctcagcactgtgcgatgagagctccagcacctgccctacggtagagactccagtgtggccctgtctgcctcgtcccttttatttcccactaacctgccccttcacccgaatttggccctaaccattgacagcaatttacacttgcagaataagccgtgatgtctggcctctactgtttcctctgcctcaatttctctctatcccctaccctgaccactggctttctctgtctggtcatatctattcatctttgaaggcccagcctaaccatccagtcccctgatcattcttgttcacgtttctgtctccgccaatacactgtgacctcgctaaggaaagcagctgtgcttggattctccacccgagcacccagcacaccataggtcttcactaaatgaacttgcctcgtgaggcagatggacttgaaatcaggtaactaatacatcatggcccggtactgagggaatttaacaaagccctaattcctcctaggagcatatacttaaggttttgcagaggaactaaggctgagctgagcctagggtgtaatgtgaggcttatctttctggaggaaggaggaggccactgcagagctgtggagctgcctgcttcacgtggccatcagtacagatcccagccatcccatgtcactcctgtgctcagcctcctgtcactgcattcagtgcagaggccccagcaggccagtgcaaaggctatggagggtgcacaggtctggctagctggctttcggggagagagggagctggtcccccagattcctggaacactgcaagggcaatactgggcccagtcaagctaagtttggctggccagataccacagcttggggtcagttctagtgagacaagaataaagtggttccttttgtaaactcaaaacccaggtcttgccgagaattctgggcagctcatggctttctggagaggaaagagccaggatttacttttgaaggcaaaattatggatcaggctcctgcagacaaagttgcccatgatacgtaaggagaatcagccaatgaacattctagactaacacacagaagggaaattgactgtaaccaaagccagagagatctcagtgtgggcaggtgggatgagagaaggaatatttgcggccagtcagaaaagggtcttcctcacccaaaaagctggaaatcttcaattgtttccaaagatacttctgaaggcccactatatgccaggcactgaggatgcaaaatgagtacgagagtactcatgagatggtaatttcatgaaaagaacatgaaaagtgctaagagacccaaacaaagtgatctggtaaagtaaagaaggaatttccaaccctaactggagagttgcgtgtcacgaagtaggtgacactgagaatgatggacgaattcaccaaagaaaggagtttcttccagcattgcttgaactaatctaaaaagcaggaaaaattccaacactggataaattacaacagaaaatgcttttcagtgatttgctccaaagacagtaagggatgtccgtaacaggaacagaaaatctgacccaagtggtagatgaaaaaagaggttggggtttcctcagggaaaagcctaatactaagaaccagagggaagcctgactgacgcttatcaaaaaataagtaaatgagtgatcatcatcttccctgagaatttgttgagaattttgtgtctatattcataagagatattggtctgtagttttttttgaaggggggagtgttgtactttttgagtggaggggtctggctttggtatcagtataatactagcctcatagaataagggaagtgttccctccttgtctattttttggaagagtttgaaggattgctattaattgttctctaaagctttggtcgaattcaccaataaagccattggggcttgggcctttctttgtgggaagcattctttattactaatgtaatctgtcgacttgttatagatctattcggattctgtatttattcttgagtcagttttggtaatttgtttctaatttgtccattttatctaggttatctaatttgttggtatacaactttttatagtgttctcttataatctgttttatttctttaaggctggtagtaatatattttatttgactcctgatgttagcaagtctctcttctctctctctctctctctctctcttagtctagctaaaggctgcccattttgttgatcttttccaagaactaacttttgattttgctgattttttatattggttttctgttctctattctatttttttctgctttcatctttattatttcctttcttctgtttgctttgagtttagtttgttcttcttttcctggtttcttcaggtgaatgtttaggttattgattggatttttttaagtatcagagcatactactctacattttcctataagcactgtttctgctgcatcccatgtttttggaatggtacgttatctttttgttttcattttcattcatctcaacttgtttttttcggggttttttgttgttgtttgtttgtttttgagacagagtctcgctctgtcacacaggctgaagtgcagtggcatgatctcagctcactgcaacctctgcctcccgggctcaaatgattctcctgcctcagcctcccttgtagctgggactacatgtgcctgccaccaggcctggctaatcttttatatttttagtagagatggggtttcaccatgttggccaggctggtctcaaactcctgacctcaagggatccacccgcttcggcctcccaaagtgctggaattacaggcgtgagctactgcacctggcctcaacttattttctaatatcctttgtgatttctgctttgattcaatgattacttacatatgtgtttaatttgtatatatttgtgaatttttcaaatatctgttactaatttctaaatgttgttctattgttggtcagagaatatatttcatattatttcaatcctcttaaatttattgagacttggtttgtggcctaacagatagtctgtcctgtagaatgttccacgtgcccttgagaagaatacatattctgctgttgttggatggagtgttccagagatccctcttagctctctttggtttatattgttcaaatcttctatttcctggctgatcttttgtctagttgttctatcagttattgaaagtagagtattgaagtctgcaactatgactgttgaattgtctatcctcccttccattatgtcagattcacttcatgagtatatgtgtatgtgtatgtgtgtgtgtgtgtgtgtgtgtgtataatccaaatagatccataacaagtagacagattacattagtaataaagaacacttaccacaaagaaaggcctaggacccaatggtttcactggtgaattctaccaaagctttagaaaacaattaatagcaatccttcacaaactcttcctaattttatatatatatatatatacatatataatttttttttttttagagagagacaggatctggctgtgttgtccagtctggactcaaactcccgggcttaagtgatcctcccacctcactctcgtgagtagctggaactataagcatgtaccaccatggtggcttaggagtttgggggctctgttgttaggtatatacatataattgtttaatcttcttgatggattgacctttttctcattataaaatgttctttgtctttagtaataatttttgtcttaaagtctactttgatattattaaatagtatagccactccagctctccttcagctaatgtttgcttggtatgtctttttgcacccttttactctcaacatatttgcatctttgaatacaaaatctgtctgttgtagacagtatacagttggatcatggttttgtatccattctgccaatttctgcctctaaactgaatgtttaatccacttacatttaatgtaattgctggtaaggtaggatttacatctgccatttacctatttgttttctatatgtcttgtgtcttttttttttttttttttgagatgcagtctcactctgtcacccaggctggagggcagtggcatgatctcagctaatttttgtatttttagtagagacaggttttcaccatgttggccaggctagtcatgaactcctgacctcaggtgatccacccgcctcccaaagagctgggattacaggcgtgagccaccatgcccggccatgtcttacgtcttttttgtcacgctattactctattactgccttctttttgttaagtagatattttctagtgtaccattttaattcccttgtcaaaaagcatgaatcatgaaagaaaaatttggtaagttggatatcatcaaaattaaaaatgtttactctcttaaagtcatggttaaaaagtgaaaagtcaggctgggcgtggtggctcacgcctgtaatcccagcactttgggaggctgagcaggtggatcacaaggtcaagagatcaagaccgtcctggctaacacggtgaaaccccgtctctactaaaaatacaaaaaaattagctgggtgtggtggcaagcagctgtagtcccagctactcggaaggctgaggcaggggaatggaatgaacccgggagacggagcttgcagtgagccaagatggcgccactgcactccagcctgggcgatggagcaagactctgtctcaaaaaaagaaaaaaaacgaaaaactgaaaaggcaagccaaaaactaggagatgataatcgcaaaacttatatcttataaaggacttatatcctgaatatattacttacaattcaataaagtgactcagcaaaaacaaatgagtaaatattcgaacagtcactttaccaaagaacatatacagatagcaagtaaacacctgaaaagatgctcggtatctttagtcattatggaaatgcaaattaaatccaggagttaatattacacactctcttgaatggtaaaaaatcaagactgacaacatcaagtgttgcatgaatatgaagtaaccgaaactctcatatgattgctgggagaaatgcaaaagagtattccagctttggaaaagaatcttgtgaagtttcttataaagttaaaaatatatttatcaggccaggcatggtggctcactcctgtaatttaagcactttgggaggctgaggcaagtggatcacaagggttcgagaccagcctggccaacatagcaaaaccctgtctctactaaaaataaaggctgcagtgagccaagatcgaggcactgcactccagcctgagcaacagagtgagactccatctcaaagaaacagaaaaaaaaggaatatatatatatatatatataaaaaatagcccagcaatgccattccttgagtattaagataaacaaaaatctacatccatcttgaaaatgacagaagtagattttaagtgtcctcaccacaaaaaatggaaagtatgtgaggtaatgtgataagtatgtcagtttaattatttcaacgtagtcattccacaatgtatacatatttcaaaacgtggtacatgataaatttacacaatttttctttgtcaatttaaataattacctaaaaagaaaatccacacccagataaagaattgaacataaattttcacaggagctttattcttaatagcccaaaactggaaacagttccatgttcatgaatgggtgagtgaataaacaaactatggcatagccatcagaaacattaggctaaaggagagaaatcagacacagaccatatgctttatgatgatactgatatgaaattctagaaaagtcaaaactttagtgacagaaggcagactggcagggttcgggagtgggaggaggggattgactgcaaagagccatgcaggaacctggggagtgatggaaagagtctatgacttactcgtttaggtagttgtagtactgtctgtcaaaactcattgagctgtgcacataaaattgctgaatttgatacatatgagttatacctcaataaagaaaatacgaggtcaagctcagtggctcagcctgtagtcccagcactttgggaggctgaggcaggtggatcactaggtcaggagttcgagaccagcctggccaatatggtgaaaccccgtctctactaaaaaatgcaaaaattagctgggcgtggtggcgtacacctgtagtcccagctactcaggaggctgagacaggagaattgctggaacccaggaggcggaggttgcagtgagccgagatcacgccactgcactccagcccaggcaacagagtgagattccatctaaaaaaaaaaaagaaaagaaaagaaaagaaagaaaatagaattagcactagcaacaaaaatataaggtactaggaattaatgtaatgaaatgcaaaaaccttcatgaagaaaatgataagattgtgttgaaagaattggcagggacagttaatacccagcaaagattgcaggtgatctcccacacagcacagcctcctctgcagttacgctgtggccttgtgacaatggaatataagagcaagtgatgttcactggtgagagatgtagttcagatgcgggaatctcatctagttgtctcttcttctcccacaatgatcttggagaatgggggttcagttcaagttggtatcagtgaggaaaatgctgcctgggctgcacaggactttacccaagctggaataaacctttattgtcttaaaccttgaaatttgtggctctttctgttggggctgtttgtgctcattaataccaaagacattaaagaagacccaaatgtgggaagttataccctgttcatccatgggaatacacatttccgcaacaatgtcaatgtaatttcaatcagaagcccactggactcttcatgtacctcaacagattctaaaatgtctgtggtagtgcaaagagattggagtagccaagacattccttaagaaaaagctggggggccgggcacggtggctcatgcctgtaatccctgcacttttggaggccgaggcaggtggatcacctgaggtcaggagcttgagaccagcctggccaacatggtgaaaactcgtctctactaaaaatacaaaaaaattagccaggcatggtggtgggtgcctgtagtcccagctactcaggaggctgaggtaggagaatcgcttaaacctgggaggcggaggttgcagtgagctgagatcacaccattgcactccagcctgggtgacaagagcaagattccatctgaaaaaaaaaaaagaagaagaagaaggtgggggacttactctatatcaacatactttataaagctagtgtaactaagacaattgactgtttgaatggggatagacaagctaatagtacagaatagagagcctcgacacagacccagatatgatagagacgtgacattgtattgcatattaatcaagcctcattcaagaaacaatgtaggaaaaattggttatccatatgcggcaaaaaagaaattgaactacgccttcacaccacaccaaagtcaattagagtaaggacttaaatgtgaaaagcaaaacttcacttctagaaagaatatagaacacatctttacaacatcagggtaagataggtttcttaagcaaaaaaggcactaaggaagtactagacattaaatatatatatatatatatagccaaaattgacctcattaaagtgtaaagcttctgtttatcagggaacacccctccaaaaaaagcaaaaatacaaaccataaacagatatttgcaataaatatagcggacaaaggatttagtttttcaaaaagatgtgtaaaattctgacaaatcaataaaaagacaatagaaaattggtcaaaatatgtgaataaatatttctcagaaaaggaaacacaaacagcaaatgaatatacgaacaagcatccaaccttactggtaattggggatttgcacattaaaacacaagtagatatgactagattaggaaaaataagaaagcctgatgattccaattattggcaagaatatgaagcaagagcaattctcatactctgcaggtgggagtggaaattgttagaaccacttaaaacagcttggcattatcttgtaaagtgaagattaatttactctgtgagtcagttattccactcctagatacagagcctagagatcctcttaccatgtttttcaggagccacaaacaagaacatttgtcgcagcagtcctgttaatcacaggaatgaaaactgactgaaatgtctatgttcggaagaacacatatgtaaatggtggacgattcatatactggaatgctatacagcaatgaaaacgaactatccatgcattgacaggatctcaaaattacagtattgaatgaaaaaaacccaaattattaaagaatgcatgcagcataccatttatgcaaagttttaaaattacaaatatattcagtggtgtatgaagatggtgggtatggcccacccctaatgcaggtaataaaaaggcccactgtttgtaaagaaaagaataataaaactgaccaaaatctgatttttattgtcaccatacatcagcaattctggacaatattattgataaaaattcttgccacaaaggcagctacttccaatctccactccccaccttggtgtgcaactgaatacattctttagagtcatttgtttctatagaaagagtatcatgaaaagtaatgataaaattcaggtgagaggttttccttggagggagggagagggacacacttgggcaacagcatagatgccttcaaaggtattccttatgctccattccttatgttccattccttaaactgagtgattggtacatagctgttgatattattttttatatctgatttacataatgtatctcttcagtaggtacgaaatattccaccctcaagagaaagaaaattaaagcagcaaaatcaacaaggggtgcaggtggaggagaaggcatgctttgtagtgcactggaagctgcaaacccaagaaagaataaaagggccgtggtcagtcagaagagaatgagggaccctggagcagctgcccaggccgaggctcagggcatgcgggggcctgaattggggtaggggaactctgggaagcttttgcttccaggctggggaagccacaggcctaggtgaggttaaccccaggaagtgcatctggagtgagaagacgggggacaaggccagaggcccagggagcaccaaccttttgggagaaagaagagcccttcaagctgaggctgagcttgagaaaggtgaagcagtgagcagaggatggggtcccatgtgctgaggagggcctggtggaggaggtcacaccctgctaagaggacagcaggacgccggctgggaaggaggccctggatttcacaatgtgggcaggtgaattcatcagaaattgtcagagccatgcggtggaggaggaaatgaggacagggaggggacacagctctccggtgggaagagtgaggagtagcggctgggaagagacgtggagtccaggtagggatcttacgcatctttcaattgtcccttaaaaatcccagtcgggtttagccccactagggagaaaaagtgccttcaggccttcccacagcgccagcagcacgagcacagcaggtgtcccttggggctgacgcatagggtgctcatggtggggtggaggagctgtctgcccctgtgctgggagcattctatcactgacactgtctgaattgctggtacatggtgatcagaggaagcaaactgacatttagtcacttttaccgtctttttaaaattctctacagttaacacaccctttgttgcctgcaccagggacagacagctcctaccgccagcccttgctaaggctctagtgggacgagaccagattgagtccccggcacctgggtgtgcagccccgctcctttcttctagctgacagggctggcaaattcctgcctctctgagcccctttccctttggctcactgtaactgagggaaattctgacctctggggtggttgggcagatgacagcaaaggaaagacccagggcctaccgcacaggaggtacttactagctgtccttcccgcatcagggaacagaggagacagtgactgaggaccccgcagcgaatgccccacccacacaggcttcctctcagcggggcctgtccccactgcttccccacagccccagaggccaggcctcagccattcagacgcgggggaggtgatcgcagcacagggccgcgccctgcctctgccgctccgggggtccccaaggaagcaccaacgcctggccgcagggggcagttgtcatggggacgccagggcccgctgagctgcctccttagcaacgggactccccggccagttgccatggaaacagcatcccctggcaagcggtgatggggaacggctgggtttcctgcccttttccgaggactttcccctcctagggcgggagacacggcactccctataccggcgggagccgcgaggacttggtttttccagtcgcccgtcgccaccccaggagggggcctctgcccgaccccgcgaagtcccagggcccggaggaaccctctggagacaggggtggggaagggggtcacccggggaccaggcctagccccgaacaggcacagcagtgggaagtccgtgccctgcctccttccagaggccccacatgctgcctctgccctcgggcccccaccaacccacacaggagcccagcgctgttcccccacccctcggccaccctctgatgccctcccccttgcccagtcaccttgtgtctccagccaccctcccacttctgagagcttacctaagacggcatccccctctatctagctggatggagcccaggtgcacattcaccaccctcctcctcagccagccctggcagtagggggtgggaagggtctcacacctcccccactcctgcgtttctcccctccactagcaaagcacacatgcccactcgctctcaccctcctcaatgattctcaccagtccataagcacgtgcacacctgtgtccatagccaggccttgcacatcccccgtgcacacctctatgcacagaacacagctccatgctcttgcaggcataggtttgcacatacacaagtgccctctgggccatgtcccctgccttccacacccgagttcccaagactccaggatttcccaatgacctcacccccacccctatccctggcccctagaagaaggtagcatctgctggaattttttttatttaaataaaatatacaatacggcgcatttaccggtttctgttttaaaagtggatttgaaaattccttgtaggtgactgggtgtgggagggcccattgcctgcacctgtctgtcccagtctctgcagagtggccaggttgggtcagagctattataaaatgcatgtgtgtgtaagtagagaagagggtggttaggccaggctctgatggcaagggggctcctcatggccctggaccctccaccttcacccctgctgcctccaggacaagactgtgggtttggatcaagtcctgctgcctctcagagctgccttccttaaggggaaggggtgtgtgcagaactcaggttgaggctaagtccttccagttctcagaactcctgagccagcacagtagagaccagtactaggcggcgtctagtctttacctaagatcccaggaaccttcacccacttctctcctggagtactgcctcccactccctgcagcccatctatggagaaatcggtttgtctcacatcccaggatagctcaaggcaaaacccgatcttgccaacattctggcttggagcatggaaggttctggatggataatgtgggaccagcccttctcattacttggggattgcagccatacctgctctggccctataggcaggggcagacccctgaccttggctctggcaagatcccatctgggaggagggaggatggtgcctccaaaggcatctgagctgctttctcgttcccgcaatctggaacctgcttatggctcctagttgccaggactaagcccagacaatcccttaccctatcacccaaggccgtccctctgacccctcagcctggggatcccctcccaaagccctgatccaccactccacatccacctcaggaatctccccaccatacactccatcccacccaccattccctccctctctccctgttgaagtcttcccacttctcaaggcctggctcccacccacctctggccacacaccttccttgggcccttagggaggcccagccacctcctgagtcctgagattttaagtcttggagccctcagccaaagctccctgggctctcacatagtttgctggagcaataggctgggcatatgaggggcagaagaaatgtgattttttattgagcacctaccatggtatgtgccaggcgctgggctgggcatttcacatatagatttttctcatctggtcctcataggtccttgtgaggcagtaccataattattcccattttacaaatgaggtgacagaaaggtcagataacttgcccaagatcatacagctaagaagtggcagggctgggattcaaacccaggcctgactgctgccaaaatctggtgtcttccttctgtaccatgcttggggaccatctacctcagcccccctcaacacagttttctgatggaaggaacacagacttgggcctcaaggaggcgtggactcgaacctcaaatcagtccccactctgccactcctagttacatgattctggaaaaattacccaaaactgtttcttcctctgctaaatggggagaatcaaagtacccaccccatggtctttgtgaaactgaaggagttaatgtgtgtaaagtgcgaaaccagtgcttggcacagagcagactcaataaacagaagttccgctcacctcccactgtacagatgggcaaactgacggccccagaggtggcggtgtgtgcttgaggccctaggaaaggggagtcttccacttccgtgtggtgagaggtcaggctgggactggctttgagaccagagatggggagagagggggcctgctgcgaagtcctggggtcctcttccctgaggactggagagagaacgtccctagaccatgcagtgcacagcctgtgggccaaggcgggttgctgggtgtaaggtgacctgggcatcctgtcaacatgggattaaactagaccgcacacgtgtgcgcacatgtgagtggctatctacatggctctacagagcgctacatagctatacatatacacatcttacatacatatacatatacatattcatatacagatcttgctacgtttacagtagaaaaaatgctaggccctcagggccctggcccttttctcccaaggtcgcaggcttctgaggctccccagggcacaccccagggcagcccctttctgggggcagagtggagctccaagttacagctaacgggctgatggcagctgtttctctaaatgaacacaatgacacatctgctctaagaaccgccaacactggccactcccacccctgcccagccccggagaccccatctgcctttctctggcttttgcatttgggacctgcctgctccctcctccctccccctccctccctctagtgctgagtattaaaatagtctataaaagcaagtgaccaaaaatctatagctctaagaatacctggttattttctgctgtcttttgtttttctggtgtgtgtggttttttaaataattattactgttattggtatatctcctaatcacagttaaacctgaaggaagaaggaagggagagaaaagaagaaagaagagggaaggaagggcccagctcatagattggatggcagtttggagcgcactggctcaggcctggccccaggttccctctggggtccagcagtcagagggggccccccagaagaggtggctcttgccccaaacaaagacagagggggtggcaaagaacctgaggatgtcttccgaggcagagtgacgtgctggccggggatggcaccatagggcctcccagggggaccgaggcccccgctgctcccactgcccccgctgccacccccagccctggggaagagcgggaaggcagccatggactcccctgaggagtgcggggaggctctgcggagagtctgcgccccgtcctgaggcagggctggctgagacgcggagatgagcttgaggtcctgggtgaggcggccgggggtgagcgggggtgtgccccggcgctgggggacctggggtggtggggggctggatgcaggtggcaggagcaaggatccgtgggagccagaggcccggggcggggcactcgggaaggttcttggggggcctgggctgtggccaggggggctgagacctcctcggggagtaaagcctacaggggaagcccccccagaggcccctgccacaagggacggcggctcaggctgccgtgggggtgtctctggcgtgctcagtgggccagtggccagacctagggacaactccccgggaggctggcccagctgcccggggctagatgacggggatctggatgagggtgggggtggcaggaagtgctccgggagtcccaggcctccccgggccccgggtggcgcgggagatggctgggcagcctgcggggagcgggcgcctggctgcagcggggtgagcaggggagagtcggaggaggacagggagccacccagcgccttgtggaagtggccaaacccggctatggtggtggcggctacgccagctgatggtgtgggagccgagggggagccacaggccccggggggtggggaggagctggatgagggcaggagtgggctcagtccagcgggggcagagaatccagccagctgttggatgtggaaggaggatgaagacggtgtgtccacctgggacgggctgctggcgggcgaggcggagcccagcgcagaagggatcagggactgcagccgtttcaggtgccttggcgtctgcccggcaccgaggttgcccagcccagatcctgggggagggcggaagatggcagcaggcaggcgagggtggtgggtgagggctatggccacagaagtggtggcagcggcagcctgcagtggtgcctggatcagcggggtccagatgacgggcgtgggggttggggtggcagaggcagcagcctggacgcggtgcgcgcagtgggccatctcccggtcatgctgcacaatctgctggatgatctcattctcctggtagttgaagacgccggagttgaggtcgtgctggactttgtggaggaggatggagttcttcttgcctgggccacagaacaagaacaggcactcagggcagagcggggaaggagatcaggtgcagacctggcttaggcataaaggagccctgccctcctcccccaacaccccccacctgccccgcctgtggcccctccccctcaccaatgcggtccaggcggtccagcgccacggtctcgaaggcccttcgcatcatggggtactcctccagcacctcattgaagttgtccacgctcagcgagtagaggcggcagtaggtgtcggccctcacgctggctgtgcgccggccccgggtcagcaggcagatctctgccagagcatcaggactcaggatgaggcatgcacagcctgcccaggccagggggactgcccaccctgaccttggccctgactgcctggcacagaagccttggcaggctcacaaggccctgcccccagactgcggccacactggatgcctcttccccaccaaatgggggctggacagactttcccatctttgggacataccctctgctctggactgaatgtgttcccccaaaatttatatgttgaacccctaatcccagcatgatggtatttggaggtggggcctagggaggtgattagatcacgagggtggagccctcgtggatggaattagtgcctttttaggaggaggccggggagctggctcatcctccttctgccacatgaggacacagcgagaagtcagcagtgcagcccagaagagggccctcaccagccccaaccatgctggccccctcagctcagatggccagcctccagaaccatgacacatacatttctgcagtttacaagccacccagtctgcggcacttttgttacaagaacccagactgactaagacacccctaccctgggctcacagacacctccctccaggctgtggccaagaagggtgctcactgcctctgtcccctcggtatctccccaaaccagcccctgggagcagctgccctgtcccccagggcccagggctgcctcacctccaaagtaggagccgtcggccagcttggtctccttgttgcccttggtgagcacgctgaccacgccatgctggatgaagtacatcttcttgccaatggtgccttcccggatgatgtagtccccaggctggaagacctcgaaacgcagcttggtcagcatggacgtcacgaagttggggtccgcattggcaaacagtggcatggaggccaccagcttccgacagttaaagttgatgatctcctgccggacagggtggattgggacacgggaaggaggtggtgaggggagctggctgccaggaaggcctggctcccctccacgccgggccgccacacagctcacctcccgcaggggctcgcttagctcgcccaggatgctctcctcgtcgaacatcttgccctggtagcggtgctcgtagtagtcgtggatgcgctgccgggtgtcgggcgggagcttgtgaaaggacatgtactgctccacctgcttgtactgaggccgggagaagggggcgtcagctccaccccaccagggggcgtcagcagccagccccaccacctcggcaggcaccacatccgggcacccaccccgggggatttcctggctaaacttggttccttgagatctgaggtctacagtgtggaaatgacctcactgtgctcaaaacaactgcccgggctcccagctgcttggcatggaggaggggcccccaccagcatctgctcctcgctgtgttcaatactaaggaggtgggtgagggcggcagggaatgtccaaagcccagtgacaggacatcaactgtatctccagggaggtcgatcacatttccttggaatgttacactggggacagggaggcctcaccgactctgcggggaaagaagctgtttcctcccagcagtgacaactggcacagtcaggaggcaagggtgcgatggatcagaacgctcagaggcagaagcaaggatgcctggctgctcgatgctatgaatccaaacgtggcctcagctgagaccccgggtcatttcgttgagagcaactccaggtaagggaaaagcagggtagactaatttgaggggaccttcaaatagaggctcgggtacaaaagatttgtgagcctcagaccctggggctcaaacaaataagaaacgatcctgcccgccctcactgagaggagtggacattgctcccaccatcctagattgtgggtggacagtgggattcccaagagcaggatgagggatgggaggtattgattaggcaacaacacagactcctcccggatgggaagtagaggaagtccctatcaccccagcagcaatcagaaacggggcagcctgtttgcatctatgtgtgctccaaagaggtgggaacgcacaactgctgcacagaaacacccacgggcaaatgagggctgagaaatgacatttcctaaacttcttccagccaccctggcctctgactgctccaagttatgcaaagtcccaggggacagtgacttcctggctggttacagagatggaggcagctggaaaacctggagctgtgttttagagagtccctcccctgacccccagagaacaggtaggggtagggaggcagggtctggacatggggcaggagttaaaaggttgaagtggtccaggtgagagacagacgtggggatggagaggagggaagacatttaagagaaatttattgggcagacttagatattagccaaaggacaaacattttaaagtctcaaatgaaaagccacagacgccttgactctggccctaaaataaactctgatgcattttcttttctttttttctttttatttatttatttatttatttattttttttgttaagacagggtctcgttgtgttgcctagactggagtgcagtgatatgaacacagctcactgcagcctcaacctcctgggctcaagcgattctcccatctcagcctcctaaacagctggcactataggcacatgccaccacgcctggctaatttttgtatttttagtacagacagggttttgccacgttgcccaggctgctcttgaactcctgggctcaagaaatcagctcgcttcagcctctcaaagtgctgggattgcaggcatgagccatcatgcccagcctcccagacgctttttctttttcttttttttttttttttgagatggagtctccctctgttgcccaggctggggtgcagtggtgcaatcttagctcactgcaacctccgcctcctaggttcaagtgattctcctgcctcagcctccctgagtagctgggactacaggtgtgcaccaccacgcccagctaattttttttttacttttagtagggatgaagtttcaccatgttggccaggctggtcatgaactcttgacctcaggtgatctgcccgccttggcctcccaaagtgctgggattacaggcgtgagccacagcgcccggccccagatgctttttctaaactaatccctgatcttgaccccagactaaaacctagccttgatcacacactgagccctgaccccactcacatgctgagccccaccccagtcacaggctgggcactggtgctggctccagaaggatccctcacctggctgagccccaccccagtcacaggctgggtcctggtgctggctccagaatgatccctcatctgggcccggactaagccctgacctttgtagcttgatgccttctctacctccctaggaggtagagaagggtcctctaacctaggaccctgtgttctagccaggctaatttctctgccaccacccctatgctcatcctcatcctgatgcctggcctagaattctcttccaccttctccttcctctgcttccccacagtgagctctccttgcctcccagctctgtaggctctcctgagctctcttcttggcatcatgggacctggacctccacacctgggtggcccccacctgtcagtcaccccaccaaaggacagtgcctgggacaggcaggcaggcagtgaatccacaaatgctgaccctactgtgtgccaggcatggggcataaaacagaaaacgacatactgggtcctcccctcatggagccgtggcctggagagggaaggtgggtttgttaaacagatggctgcctatggttaattacatcaccacagagtgccgagtgtggtgaaggaggagagggtgccatggggtcacatgacaggtgaggggctggccaggtcacagacggcttctctaagtggtgaggctggacgtggagagggtgtcaggtggacacctggggaggagagttgagggtgaaagcccgtgtctgggtcccatggcaggagcaggcatggggagagaagtctggccaggctgaaataaagggtgcaaggcccagggcaggagctgagcatgagggcagatccctggttatgctcctcaaatgccaggctgggaaaacatgctgaggagttaatctacatcttcagagcaacgtgaagtccctgaagagtttcaagcagaggatgaggctgacgtgttttagatgccgctccaactgctgtgtgaggtgtgcagtggaaggtgccagggcagaacctgcttagctgataaacacaggggagcttacttgcaacccccacagcctgatgcccagtaccacccccgccctgcagatgaggaaacggggcctcacgctgtggaggcacaggcccacgctcaaacagagctcggcagcagagaagctggggtagggcccaggtggcctgactccaggccacaggactcattctctgtggtgagggggctgctgttgagaccccagggagagatgaagctggggacgggggaaggtggttgggatgcagagaaggagctgtggctttgaggtaggcattgatgacagagagaggccagggatggctcctagtctctggcctgggcatctgggaagagcagagacttggagtagagagaacagggcagccttctcattacagacatgaggggcgtggggtgtccagagagggatgaaataaaccacctggagctgagagatgaggtggggctgctgatgctgtgcaggccccactgtgcaaagatgggcacagagcctgtgggcctgggtggtgaaaccacagcaccggggccccagacagagggagggtcaggggcgaggcccgggccactggggactccagtggcagtgactgggaagagaagccagcaaatgggggcaggggactggccagaggggcaggagcaacaccgcgagagtgcggtcctggagaacgagtgagcagccaggaagggcgtggtgactgtcaaatgcctactggagcagcacggagggcacagggcctcagccaggagccacaggccccagtgacactggagacggggaaggtgggaacagaaaaaaagacatgtggaggggccaggccagggagctgaaactcagattctcatctcagaggtgtctccctcctcctgctcttccctcacactgggagttccgatcctgtggggtgggagcagggggcggttcctgctgggggcccactggctggtggcctgtgctccctcttgggagggaccaatgtgcgggtgctccctgggtagacctaccttttcctggtactggcgccgggaggagtccagggactggatgagggcagtggcgtggccaatgaacatggcgtagcaggtggcacccacgatcatgctgagcatggtgagccagacgtcggacatgcccacgggcgcctgccgcccgtagccgatgcacagcatgtggctcatggccttgaagagcgcgtaggagtactgcttcccccaggagttgttctgtggacagacggatgggtggggacagtggatgagagggaaggcccttctcactagcaagaaaaggccctgccacctcctcacctcaacctaactttctcagtggctgggcccagggctccctaaccttgctgttggctgaaagccttgggtgagaagcagcctgtgctgccagcgagtcctcctcttgtgccttcctcttgcaatgggggcagagatcagactggaagccccagtaaaggtacgggagccagcgtggcccagcccccatggggcagcttggagcctcctggctgggtagcaaaggccccgggctgagccaccgtgctgtccttcccttgctaaaacagctccaccccccaaccccctaaacagctgccaagtgaagcccatttccccactgacctcaattataaaaccagatatgcttcccttggggggacaagctctggcggactgagccgaaaaacactgtcctcattttggatgagcaaaagttaaagctgtgagctaacgggcctcctgcatgaaccctgcccgcctctgctagggctgcggccaccagttctcctcccactacccccaaggcagactctccggaacacacaaggcgtggggacaggaggagggaagctcttggctatttttgtctacaaagccagtcggtgtctcaaggaaggctcagcgtgggaacactgggatcggaagggccatctcttgaatttagtgcatgtgtgggcctgccaccctcacatagagaggacactgccccagatgagggcccattgaacctgacgaatgccagcactggccacctccctggtgtctttctgctcacagggcagatgcatgagccacagtgcagaaacctacccaggcccacagagcacctgccagaggcccagcccccaggggaaggcgcaggagcccgtgagcttcgagccatattcaaggtcagccagactgccctgaacagagctgagctggctccttgggtctgatggctcagtctagactggagtggggaccaggagggctcatccccaggggtggaagagacctgggttcccagccttggggaacaggggtaggcccccagcggcctttactgctgagcctctgggaacagggaattcaatccatatggctgattcatttacacttagctcatcaaaaggctgttttgtaaaggcctgtttgatgctgaaagatgcctcagggtctctttcacctctttcaaagccaatttttcctcccctggggccctgggaatttgccttcagaacaaaccaaactgactgggaggaagcctgggagaggcaggggttcaccagagacacagaaaggctcacagatccagggtgtcttctgtcctgcctggaacccacctcatccacagggggactggaaactctgccctatggcttccgaggccccaagttcaacttctctcacccaccctgacccacttgcaaggttggagggatagggtggggtcaggcttcatcctgcctgccctccctatcgggactccacctcggatcaggatatgttggcgagtgggggcagcccagctctgctgttggagtagaaagtgaccacatatgacctgggagtctgcgtgggctgcaaatagtacccttgaaggcgtctgttttcttgggctcagctttttgttttttatttttatttatttattccttttgagacaggatcttgctctgtcacccaggctgaagtacaagcgagctcaagggatccccctgtacagccgggacacatgtgcttgccaccacaccagctagttttttaaaaataaattttatttatttgttgaagtcaggggtctccctatgccgctcaggctggtttacaattcctgggctgaagggatccccctgcctcggcctcctaaagcactgggattactggtatgagccactgcacccagcctcaggctcagcttttaaggacttggcttctaaggggcagaggcaggaggccaggagctgccagcccagcattgccatgcctgggggaggccgcccaggtcttagtctccctgggtaaaatcaagatgaaatactgaggctcccagttgcaatggaggctgtgagaagatggaggtaccagctcccaacccagagctgtgaatggatccctggactggcagcaagcgattgggcctgtactgggtagagctatgtgccccctcagccccaggcagcactcagggtcctacatgctggaactcagaagttccaagtccacatctcgccaccctacctctggagagcccgcctatggcccagagagaggaccgggctgggcgcactcaccaccatgttgttgatggacacccagcagtcgtcagggaagtcctgtagcatgggtaccaggaactgcaggcagccgtcccagtggcagagcaggagcatcatgccgatgaggttcacgatgcgcaccacggcgctggccaggtcgtaggtcatgtggaagatctgccagcagaggaggagaaattggctgggataggtgagtggccaggagggccagcggccactttccctgccctggagctgctggtgggcactgctctgcctggactctgcagggcgcccactcagtgcaaatccaggctgggggtgggatgggaaggcgtcagtctaggtcttggaagaggaagactgtaggctgcagggtcccagagggacatctcctggcatctatacagatggggggtcttcctgaaaggtctagccatccaggacatgtggaaggacacctggagccccatgcagcccagaagtgggcagagaagccactttctcagctttcctggggtgtgaggataccagggagaaaagcctgccagcctgaggctcctcagggaaccaaaagtctacagacatgccaggggcgtgtttccctaaatctatcactaaattctcaagactcacacacggtagccacggaactgcagaggaagcggcacaggctcacaggccccaagttcaggcagaccttgatcccaagcccaggtcctacccagttcctagctgtgtaaccttgaacctctctgatcatgttttctcatctggaaaatggtgataaaaattcttatctgagtgggctgtcaaaaggactaaattatacatataaagtgcttagtaatgggtagaggagtgttcaataaattacaaaccattattaattgataagctgttattaataattaatcttcctgattggttaatacgtatttggggtaatgttctcctttacagcacccttgaccccagcccactggcaccagcccctctctactcctgcagctcggagtggggggctgcagtgtagctggacagggccaaggtgggcatatcccagcccctcctcctcccaaagctgccatgctggggtccccttgctgacagggcagtgggggatggagaggtggaggcaagtctagaggaaagtctctggaagctctggccttgcttctgtggcctgggagactttgaagtgggtctagccacccagcccccattctcatccctccatactattcccaggcaaagacacccctcttggaggggggcttgggtcaaatgccacagagacctagtttaagcccatttcagatgtggaaactaggcccaaacagacagagcctagatatgtcagcccctgtctactggtcttccagctacagccctgtagctagtggcaagctgttctgatactagtgaccgaagatgagtactttttgtccacagctcatcacctgcagtcacccccacctgtggcccccatcaagggcatgaccctgaaggttccagctacaaagctgggagtctttccaggatgaagtggacagcgaaaggttcatggggtccggtagcttaagcttgccccatcatttccctgtggccctggtgacagaggggacaatagtgccacacctgactgtggacatgaaattccacagccatcctctatttaaactcacaaaaatcctttgctgaagatattgttcatctgttttataccaaggctcagagaagtacaggaacttgcccaagatcacggtggcagtggaaaggccagatgttgtagccaggtctgcctgattctgaggcctgtagccaccatattagattgttagattgacctagtgaggaaagggtagctctcagcagttccattttgtggataaaacaactcaaacccaaagtggctgaatgaggtgcccagattcacacagcaagctgggtcctaggccaggtgggaattgccagcttctcgcctccccagcccctgcacacagtgtgatggtgtagacggtgctgtgtgccctgcagcccagtaccactggggcacagaccagctctggggctgtcagcgtttgagctcctggctaagctgacactgctcagcatctgccatggcctggaaggaatggtgggccctggagagcaggccggtctgtggctgggctggggcctgggtctgggacacagagcagatctgattatgaatttggggtctctggtccattttctgtggctggtcatgttcaggcacctgtatcctaagaccgtgaggctctccccagcaggtccctgagcaccagagcccccagcaccagccggggggaagatcccacttttgcctccttaattaacacttaggtgaatgtgacatgtctatgaccctgggcaaatcctaacctttctatgtcttggttgaccaggatgccactagctccccagctcacccaaccccctggtgtctgagctaagacaccaggggtttggggagggcgagtgacacagcaccattcacggtctcagagccggccatcctccacacctgcctccccaccaccacaactcagcctccccctcaaacaagctagacatctgccccctgttttacaagattgcttgtgaattaaactagctagcaaagtgctctctgcacacccgtcatagacgcaagggtggggccattattattaagctccttctcttcccagctgctagggactgcacctttgtgtccctctcaaattcctacgttgaattcctaaccctcgaggtgatggcatttggaaatgaggccttcggaaggtcatcaggtcatgaagttggcaccctcatgagtgggatgagtgcccttataaaaagagaccagacagagacgatctctttgtcctgtgagggcacagggagaaggcggccgtctacaagtcagaaaaaaaaaaggccttaccagaagcccccgtgctggcactctcaacccagactgccagcctccagagctgtgggaagtagtgtttgttatttcagcgcccccagcctctgttgtttatgttgtcacagcctgagctgactgagacaccaaccttcagaacccagccctctgccacagacaggaaagctgcgcaggaggccaagggtactggaggcacagacgggggcccgtgggggcaggacagcagcctccccgaggcacatggctgagtgctgagctggggtaatgaggcaggcctgccccagggttggagagtccaggacaaggggcaaatcaggttccacaagccacagatttggatatttaaagtcgtaactcaagccaacaaactgttaaagaaaatatattctattctcctaccttgacagaaggcaccatcgtaatgccctggagggccagacttgaaatgagaactcttacaaaaccacaccagagcacagcccacctcccttctcttccctgactgtgccccccagcagaggaccctggcccacagccaagccacatccatgccactcctgcgaacagccacttgtaagtgggtcaaggggtgggcacagaggcagaatggtcccctcaggacatcctgggaacggccctgcacaggccttgacagcaagcttagaggtgtctgtgccaggaatgctgggtacccaagtgtggtcaagaaagagttgcaaagagcccccagactcctcactgtggggagaggagccttccggagtgggggccagtggggcccttctttcctgggtctcggggcagtacccttagaaagacccaaatgtctatgccatgtcccctggaagtcagcctgtgtcagtgcccaagaaagcccccctccctatgggggtcagggaggaaagtcttgcccttgcttgcccagagctcatagtctggctggggaaggaagccgcacccaggaaagggacttgggaacatgtatatagaaacccagcaacagaggaaggcaagcagggcacaatggggaggtgagtagagaggctggtccaggctctgagcacccccagcccagatgctgctgtggggctggacagcacggctggtagcagagcccacagccacaagcatgccgttctcctcccacccctggcttgtcaaggcagcaggaattctgctgaaagtttctttagttgaggagggtatcaaagtctagggcatctctggaagcaccctgagtggggtctccctggctaaagggctccccaggatgcaactgtgttgccgccatcacaaggggctgtggagaccggcaatgctcctcctctgatgaaggcaaccttccctgtgctcctctttcaagccctgggatacccccagttccttgcttctgtcatgcctaagacacacaggtggactcagagtaacacaaattggctcgtatgtccagctgtctcggtctatctctacgtggacacatccaaaacctgtttccatctcacaattggtgtcgctgttcgtgaggctgagcaacaaaaacccaccagccagccgtgagtgagtctctcatccctccccacatcccatcaatccaggtggttttggctctactgcctaagtggacatctcaaagccatttacttccctccaatcccaatatgaccccaatctaaacacccgcaagatgacagccccaacctcttgatgaggctccccgcccctccaagccactctcaaccaagcagctagaaagacctcttggagacataaatcagaccatgtcactctcttaccataaaccttccaatgacttcccactgcacccatgaatacactccaaatgccaactgtggccctcggcatctcggctcccaactaccggcctccctgactctgcccaaagccatctctggccacagcggccttccttcatgtccttgaatgccccaggccagttcgtgcttgccccaggccctcagtactgggcttgctcttccatctgcctgcgtgctgcctccagctccttcttgtcatcctgtcttggctcaaaagccacttccatggaaaggaaggacactggatccctgtgtgtgacacagccaagggctctcccttcccattctcactgtgactctttgccctgatgaatttccttcctggagttctcactatctgaaatgacattcactgacttgcgtgctgctgcacgaggcagggctcctctctacttctcacttctgtgttcctccatgcttagcacaagcaggcatcaaaaatatctgctgattgcctgaataaatgcgcgtacatctaaatgaatgagtgggtaccatatgggagctcaaggaagcctccgggcatggctagaaagagtcccagactgtcacaggccacagtaactgctcctttggacagatcacgctgggccttaaagacagagcatcgaaggtggcatgttttcctgcaatgacctcctttccttctgtatcgcctttatcttttcattactccttttcttctaagatcaggtccttgtctaattgtgcctttatcgtgatctcagcaatgaacacggcacagagcatgtggtaaggtttcaggaactgagaagggcttcgtgatgaaggtgaaggcaatggtgacagtgacgagaatggtggtcagcagggctcctgctagtgtagacagtggaagaacaaaaaggtacccgctctgggcagatgcagcccacagggaacctacccttgtccctgtgggaagaaccaaggtgccttctcctgcaggggacacagacttccgtgtcctactgagagcatggtggtggtgaagcctggaactgcggtgaggaggactgtgggcactggggtggtgggtgcaggtggcagggctggagaggtgtgtttcaggtggtttttagacaccacaaagctggagcgccaacaacgcacagtctgagctgcctgggaagagctggtgggggcacatccattcaggttagggggtgccctagatttgaggacactcacctcacctgcaccactctccagcacctgggaagtggttgccgagaacaaggctggacgttgctgggagaggctgctaaacactggtgtgtccccactgttggctggggccacaggccaccggagagtcagttgcaccaggcaaatatttgccttgctctttatatttcattagaactccctcttacgatgttggttctgactgcaggggttgagcaccttcatttccaggccactacaagccttgcccgtcaggcggtccaggcagctcactctgccacacatggaacttggggaagccctgctctcactccttctgcagtttctcaactgcagtgcaaggacagagccactgccttttccaccccgagcctcagtttcctcatctgtggaatgggtaattgccagatctcagggctatcatgggggtcaggtgagatcatatccaccactagcacatggtaggcactcaggacatgttggttcctttccttccctctctttcccagccctcccaacaaagagttgatttctcagtcccaaggagaggccagaaattggaggtctggctgctgctgtttccaccaaggcctcttcctggggcctgattgaatcctctcctgtggattcattttctcctcatggaagaacaacttccacctgtgtctcaagaacaagtgtctgcgttgaagacagcaaccccaggcctggcagaacaggctgctgcatatgcatgctgggtgcagtttgaaggcagctgcactgagggtcatgccgggtcccatcctgggtgcaggagacagggccagtacccacgccccaggacctctccttgtgtcatctccacttctcgcagatgccaagcacctgattctgagatgaggcaatcaaggtctacaggatgaggggactcatcagaggccacacagcagccccagctggccttctgcctccagcccctctttggccacttcaggctgccaagggagaggagagacttctgggatgggtcactggagtgctgagccttgcagggtaacgtccaaagaagggtaaccatggtttctaacaatagcctccatgcctggaacaagctcacacctcggagggagggaggaggcatggctggagaggctcgggagggagtctgctgacccagatcgcccaggatggaggcaagaggcttgcatcctccaagatggtggcccacctgcgctgactcacaagactgcctgactgccaccaacacttaggagatctcctgggggcctggtctgggcccggctgggggaggcagtagaagcctggggtcaggagtctagcttcttgcagtgccaggcagcctggggcaagctttccccagtctgtgggaggcaagctccctagccccaaccgagggcatcctccttcacgttccgtgagctacaacaaggtcttcagaatcagctaacataaaccttgccaaggcagatgggagctggggactgggccccagggagccacagcttcagagaacatcattatgtgcctcacaagtggggaaactgaggcccaaaggaggaaagagactcatagagggacttgaaagaggagattagggcagggttttctgtactaaatactctcctcagctctcatgtggacctagggctccaaagggtctttctgctgctgcctctgggccaagcagaggtgggagaagcccccgggctggagtggcctgctatggtcctggagacagggttcctggggccagctgggaaaccccagtccaatctcaggggtccagtgagagccctaggctggccagtgtgcccggcagaaactagctcaaagcaattttcttcccagctggtaggagagataaaggtttgtgtgtggaagggtgagagtcatccatctggcctcctgggatcttcttcctccccacgagatggggcggcacgtctagttcagaggcctgactcaaggcctcctggggcctctgcctcccccagagaaaggccaggaccagcgcctgaccagttctgggtgcccaagagggtggcctggccagggtggcagtggggacaggagccctgggcctgagctcccaggatgcataatgtggggacgtgaaagacaagcttagctccaacccacgactcaccctgtccagccactggcatctctgccaactcctacaaaagaccacagccctcaggccctggaggagtaaggtcagcccctgggaggctgaggcctggagacacgaatggatgctggaggagggaaagagctggcgtgtctctgcttttcatggcagtctagctgtgggtccaagacatgcagaaggttgggggtttctcagggtctgagggagccaacctggtcctacatttccacctgcgacggaaaccaggagacaagtgtgtcagagcatgaggggaaacacgcctccatctttccttcacagcccctcagagtggacccagccgcaccctccagagtcactgtcccctctcagccctcagctcagaccacctgccacatctctgcacatctctgtctcacaggcacctccaactcaacctgttgcacagatctcctcccctgccactgccctcccactctctgccaacagtcgtcctagtcctttgatcccagcgcccacccaggccagcacaggtgggtgcccggcaagcacttgctggactgaatgaagtccagtcccccatggaggggccccagccatgaaaggaaacaatcgtagaatcaaagtcattccctttccatctgagaaggcgggaagtgcatggaacaggaagacaggaggcctaggccaaaagccctaccactggggcggctggcctttctgatcttcagtttcctcacttgacacatgaggatcataaatcttgccctgtttctcttgacagctaagtatggggaaccaaggaaatgttactaagacaacttggtggggagggaggtaggtgtgtgtgtgtgtgtgtgtgtgtgtgtgtgtgtataaatatatatatattataaatataaataacatctatttatttatttttttgagacggagtttcactcttgttgcccaggctggagtacagtggtgcgatcttggctcactctgcaacctctgcctcctgggttcaagcaattctcttatttcagcctcccgagtagctgggattacaggcgcccaccaccacgcctggctaattttttgtatttttagtagagacggggtttcaccacgttggccaggctggttttgaactcctggcctcaagcaatccacccatctcggcctcccaaagtgctaggattacaggcgtgagccaccgcgcccggccaggagggacacatattaaacagttcttctgcaccaggcttcatgctaaggctttataaacatcaggtacaacttatacctattttgcagataaagagactgaggcacagagaggcaaagtggacccaaagctacatgctaggcagtgtggagccgggattttaacttgggtcttaaatgcgccattccactacaccggggtgggacagcccacactatgtgctgggggccaagagggctagctggattctgtcccagttctaccagaggtctaactgcatgaccttgggagagtcacggcccctctctgtcagcataagtaatgtgaattttccaagccaaagagaatttctgccatggagggacgctgccaaactggtgcacacacttctcctatggcacatgcgttcatgacgcctctgaccatcagccataggtgctgccagtcgaggcccaggctgctgctgggggtgagcatggggggcttcatgtcctgaacatgggaacttctgccaggcaagcagggggtcctggaggctgggaagtcagccacgcggcacagggatggagcgggaaatggccctccatggaagcttgtcccgcccacaggtggcagggatccaaggtgggctgtctcacagagagagtaggccctccaggctggcctgcctgccgctgctgccaagttgtgtaacttgggtgggtggcagacacagaccgaagcacttggcaaggtcagctgctcttcctcccagcaaagcccttagctcctctgctgcagatgactgcttcagcccatggatgagtgaggtttgttcacaatgcagttggtccgcccagttctttttcaatgttttattttcctcctgtagccagtgttcacagcccctaggatccctttacagtttctgagcacaagactccaacttgcccgcgtgatttcactctctacagccagcggccgcaccttttgtcagaggcctgcccgggctgctggaaactgctttggctgtgagtgctgagggctggcagtgccttgaaccaatgactgacaggtaaggggatataaacattccaactcccttgccctgactgggacaactccaaggtgtggcgcacactatcctcagatcccatagggctgaggcaaacagccatccacaggacaccctccaatgtccaaccattgcttggcttcctgcctttccctgtccctctccccagtccccttaccagattttcctgggaatgcatccccaaaacatccctttcatgcaaatctttgtctcaggttctgctcaggaagaacccaaactaagagagttgccaacaaaatttgtataaaaatccagatttccatttctcataatgctatagatctagcaaccctgggcccattcccacttgacaaaaattagctggagctgcatagaggccacccaatataacggagatgttctctagttcttctcatccaccacactgtctactgtcccccaactggcccttttcacccatccctattccctgcctgtccccaacaagtttatgggtttacaaaccctacaacataacgcagtggttaataatgtgggctctagaggtgatcggcttaagttcacattccaggttcacaaattactaatcatgcaaccttgtataagtcacttaatatttctgtctgtttcttcaggtgaaaaatgagtatatacatgtacctatatggttccctctatagctgttacacacttcattgagatactgcatgtaaagtatccagcacatgataagaggtcaagaacttactagtatttgtcctcttggagcaggtgtgcctgccacaatctgacagcctatgttcaattatctgaggttccctgccagttcctcactccctctgtggggagtggcctttcccccaagaggtttgcactgaccacttacctcttcccactggtgaatatatcgaatgaggcgggagaggcgtaacaggcgtaagaggctgaggatcttcgtgaagcggacaatgcgcagggcccgggcagtcttgtagacctccgagtcgatgcgtgtctccacaatgaggaagatgtagtccacggggatggaggaaatgaaatctaccatgaaccagcttttcaggtacttcattttaatccgctgcgggtccaggatgatctctgtgttgtcctccaccacgatccctgtgcggaagttgaggaccaagtcgatgaggaagaatgtgtctgacaccacattgaagacaatccagggtgtggtgttctcatccttgaagaaggtgatgcccacaggaatgataatcaggtttcccaccatcagcagcagcatggtcaggtcccagtaaaatctgcccagagacacaggggtcagtcgccaggaagagagagaggacaagttacagactaagggaggaagatctgagggacagcatctgggacagagaagtcttgggaggttctgagacaggaagacaggcacatgggtaccagggcaagatgtggagattggcacagggaatgacacaataagaggctcttcattcactaaggataccctccgtgctgcccttctgtgagtttccccgagccccaacaacaagcttcctcctcccatccccagcccgcagtaagagtcaggctgaaaagcaaatcagtgacactcagagagaagcaagaggctgttttagcaaaaggagcagctcaccccacaccaccccaggctcaggctaggctgccccatcctccctgagggtcagctgtggcttgagatgggctgtcagggagacattccacagaccatgaccaaagagcaggggaggtacagacatgactcaggtgcctggaaggcaggaggcccaggctccggccccagctttgtcatcaacatgctatgtgacatccggaagggcctccctattctgggcctcagtttcctcactgtgtaatgagtcctatcattctgatctggccctctcccaaactggttctctggcatccacctttagtccatcccctataatcagaaaatgtctgaccatctccttccctcagaggtttgcatcctaacatgggggtgtggagggggagagatagcttcaaaacaagaataattaatggggggatttcaggcaccagtgagataccactcaatgtgatagaaagagaccagcccagggcttccagaatcatttctcctaaggcctcaggcaccttcaagtcgtttgtagagggagcctcagggcaaagccttggagaagttgagcagcatgaggaggaggcacaacaccaactcacaggtctgtggtgggtttctcccaactcaccaagcagggggccttctggagtgtggaaacaacacaggtggccaagaccccaatccagaaggcatggccagttattcccagggaccctgcccaagcaccagccatcccagggctggccccaagaccaaaaacttgcactgcagagctgtttccctctgctattaatttagacatttacacaataacagataaaggtattaagtgaggcagaaataagcatgtcttctcccaggagaaataacctttccaccatctttgattctttactgcagggaagccaggaggaaggaagtgggaaagaaagagataagctttcctcgagtcttcagagggtctcactgtaaaccaaagtgcccctgcctgcagagttccaggttgcaaagaaattacttcatagcaaattgtttgtttgtttgccagactcaaaatggggctgtgattcaaggagagggtagggcctgttttgctgaaggtgggtgagatggctgtcctacatcacactgtgtggcaaagggcagtttccagagagtcagctttctgcagctcctttgaaagccaagctcttcagggcctcaagacagggccttatgggggataaggccggatgccaagaggccaacttcagctcctctctaccccatgacccaccactccttcctgtggccccagtacccatatgccagctgagagaacccaactaaggcctgaggacccatcctcagcttcacactttactacaaagaatgcagcacacctgctaatgagtcatgggccccaggaggatggtttcagcatctatggggtgccctagagccgtgcatgctctacccagccacatagacctcactcaaagacagctgtgtacactcattagatgccacacgcaggtatccccattcacacacacagtgcacaaacacccctctatacactctgctgtcatccctcttcatttaatctcctgggaaaaacaaaagaaaacaaattttttaactgtgcatagaaaggccactgagggctatgtggccctctgtacataaagctaataatacacccaggctggaggagtttctaaaattaacagagcgggtgcaaggcggctgggaatgctgactcgggcgggcctgccactccaacgggtttctacactctccccagctctagttccctcaattacagtccaaatttgagagagtaattaacaggagaatgtttgcattttgtggtcttcataaaaccaaattgcataaggcaaaaacacccatttcctcgcactctgactaatggtttcaatcttgagcttccagatgctcagggatatttccagcactcgatctgggctggggtcgggatcctggatcattctttcccacaaaccactaccctggaacatcacagagctgctggagagacagtataatatggtgggaggagggatgggcctgaagtcagggttcgattcctgctccatggtttactagcaagtcactttaccatgccacacctcagttttgttatctgctcaatgaggataaccacagtacctgactagcagcactgtcataaggaggaaatcaattgatttctgtcaaatgctctgacctatgcccagctacattatgaaatgagtaaataaatcatcaaaatcaataaatttgcaggaaagaggtaagagggaggatcaaatctcccagagaagagccaaagcaaaacatctgctgggagtgggatcacagaggagcctgtaatagacccaggaaagccagtagcaggaggtccctccagcaatcagatgacagacctatttgcctcagtacacagatgccctcacctccagagactcatggtctggtcagagcgcaaggcttggatagaaggcaattggcaatggtgtaagaaaccatccctatgagcccaggtatccgtaaaaagcccaggtatccataaaaatgggatcccggtggcctagaagggtgaggccgggaaactgcttctggaggaggtgagaggagttgggttttgggaactgccgttggcttctggactacctttccttactccttgccagatgcttgcacaggtctccgaaagccaggccctgccagagctagatatgacgttcagcaccacggacagcgcccagcacacctgccagccccgttcagtgggtttagccaggggaaggtggcaacagcttctacactggcatcctcagcttgctggcccctcttcatttccaatcctgctggtcgaagcatctcaagtgatgccttaatatctctgagcatttttactggggctccttggtgactgaaaagtctttattcataaagaccccaaaacacttcacatgtatagagaacttacttgggttttccatgcattacttcatttatccctcacactagcactgtggctgctgttattttacagatgatgatcttgaggctgacagagaagtgtctgccctagactacacagctagtgagggacagacacaagattaggagaagtctctgggactccagagtttgagttcttggggttgtgggtaccctagagggatgtgggaggcagatatgcctttctgacacctttacatcacagtggaaaggcagcctaccacagcaggtgtggcccctgccccagagaaagaagagaagactgcaaagaggatttggggggcccatgctcctgatgctagggctgtctgaggtagaggaagtagcacacctctcaagtgctgaaggcaccctggccatcagcaatcactcggtcacggtcacacatgtcctatagaagggaaaacgaaggctcacaaaggaaggaagagtaacatttccgaagcctcaagctggatgcccaatgctcccttatcatctggccaccccgagaatcactcatgaataaatctcacaatccagggtgtgaatccagggtggtgggtgtaatgccctgacaggaaagcaaggggcagtcaggctcagatatcctggagttggcacgtgcctgaattaggggccctagtctctccaaatccagaggatcctcctccagcccagtgccctttaagttaacaggagtcctggccagcaagacaccaactgggctctgggagccccagcagccccaggcttccagacctgtcttatctcaatccttacttcctacctggaccaatgggtccacccaggcaggcaggtggcctctcagcaggaagaggcaacttataggctgacactggaggggcaggtcccatatgcagaaagaatgggggatggtaaaaagccaagcagcccattacaccgatatctggaaatttcatgttttggtgtgagaggaagttcatagcctcaagggagctgaggaagacatgacaggaggtggctgatactgaactcggggactcaaggacaagactaagggccctctccttccctggaggccaaagaggatgggaagggtgacagaatgaaagtaggaaaagtggaggtcccagctagggatgacctccttcagcctcttcttgtccacacacacccacgcttgcctttgaggacatatgcacatatatacacgcatgcacatgtgcacatgcacagacacgaacatgcgtgcacacacgcacacacacatgcacacccacatgcaataccatgaatacattttttgtaaacacgctcttgccttttgccctcctacatgcatccatttttacacatgcatactttcttgcatacattttggcacaaatgatatccactgggaatcctgtcagctggaagaagaatgtcattgttttgtcattaaaatattttccacctttcaagctagctcttcaactctgaccactgaagcctctgcacagcctgagtcttggttttagctcctaaaacaccatgggttcatggaggacagggaccttgtctcagacacccatgtccctgcagtgctgactgtagcccgtgggtctccacgctttctcccaggtgagcagcacactcagtgccccatctgttaccctctccaactttgcagacagctcccactcagtgccactcccagcaccagacctgcattcttacctgcctgcaaaatgcatccacctggagggcctgctgtctcctacagccaacgactccagagctgaactcagcatcatcctcctcaaagctgaatggcacagtttgcatttcaataatctaggctcaaaacctcccagccatcccttactgctgcctcttacctcccacccacccctacagcaacacccccagcagtcaccatgtctagtctagctgcttccatgatggcttctgcatctgtctctcagctggacccttgccccacctccttcctggtctccagcctccattctcattctctccaactcatatgccctctgggttatctttcccattcccttggttttccagacccagcaaagatcctgacactgaaaacagtgagaatggaggaggatggcagtcaatactttttggacacttaccatttgccaggcactaatctgagtaccttatctggactactttatttaatcttcattaaaaaaaaacccctatgaggtagatactatgattatgcccattttacagatgaggagactgaggtacaaggagttgagagatttgccatatatggtgggccaagtattcaaacccaaagagtctgactccagaggcctgctttctaaccactccacagaaatatcaatctggctggtggtattttattactcccaaactctgtccctccccaagctccttgtctccctcccagctctctctcctgtgctctcttccatggcacctgcatccttaacttcttcactcccagaccccactgcctccccgcttaagtgaaccctagttgtgtcctaaggacatcactcttccaaatccctcatgcctcagaatcaggggtgagtcagcatcctcccctctccctactgctgctacctcctgcctgtggcagaaacgtctacaagatcttttgggtatccttgtcatttgctggccatccttccagcacccatctgccatcctcaaggactttggcaatgctggcacctggttcacaacctcccgttccactccaaatcctgtgattgtcctgggtgacttctactccatatcattgacccagacaacaccttggcctcttggtagcttgccaccctgactctaacaatcccacctcaatggtccattccaaagcacacacttgaccacgtcaccacctccggtgctgcatctctgcagtcctcttgtacaccctgcccttctttcctgccggctcttctattcagttgtgctgcacctgtttttcagagtcctgggaatatccagtctgctgactcctctgatcctctcatcagaaccctcctacatcctcccaaccacccttcaccccagacacgatggtccagctcattcgcctctctaaaaccaacgcctttaactcccatgcccctcctcctggcaccgtcatgaaatcccagccccaggcaaggaccaccatcaacccttttcatgttcacatgggagctgtgtagagaatcccacaacctcagaccagtcctactaaatatccaagtttcttagctcctcatgcctcaatgtcatcatcatggcctcattcacagccctcatctctgtcccctgatccttccaggagaacctagtaaactttcctgcccattccccatagctgctatttcaaattaattcctctctcctcaaagctctgaaaccaccactttttctctcagagtcagcagataacaccactttctacgtcacagagaaaagcaaagccgccagtgtccccttcctctttctgccaccttgaagcatctccccaatcccatctcctcttcccagtcacaggggaatcagcggctcttctacctgcccttttgataccatccccattttcctccccagggaccttaatctacagaagattccctctctctcttccatctgtctctctccactgatcctttcccatcagcttttccttttaagctctctaaacttaaaaaaaaatccctccctgaacccctgctgtcttatctcttaccaagctccttgaaggaggtgtcaccgtccccacactctcgctttcgtgcccctcacccagcgctcctctccactccacttgatcttagccaaaaggccgagaagcgatgctgctctccactcctcagcacgtcaccaatatgcatcctgctgctaaatccaatggtcactttccagtccatttcctccctggcctttagcatcatctggtcctgtagaccattcttacctgcagacagtctcctccttggcttccaaggtggcccactccactgacttttctctgttctcactgcctctcctttcccttcccttgaacggcctcctttccctcggcatgacctttccatgtttttgctccttggggccctcatctcttcccgctctgtgcactctttccaggtgatttcactgactcccatggccttgttattctgctgccttgtaaaccatacccctctcttgaactgtaaacccatgcatccacttgctgactacatgtctacaactggatgtcccacgggaacctcacccttgccatattcagacagagcttcacagcttcctccacactcttgtgctcccagaaaatggtaccaccaggcatccaaaagtatatcccagaaacctcagagctatcctcaactcttctatctcccttgccttccaacacttcatcacactggatccaacgtgtcccatcaacccaccatggggactactccaacagcttcccagctgagctcctggccagtccaggacctcacatacctcagggtcagggctggggccagcaccctcctccaatcgactctccacactttgctaagccccaaatccttctgcgcttcccatcacctcttaagtgaaatccaaattcctcactgttgtccccaaggcctttcctggcctggactctgcctccttctcctgccttgatgctccccattcctctccttgcacactctgctgcagacagactcagcagccttcggtgtccccaacgcatggtgctttctttgcctctgggctttcccacatgctgtcatctctgcctggaactcttctccccacttgtacccacctaccccccttggttcacaggaggcatcacttctcctgggaagccttctttgtatcctaggaaatctggttaactgcccctcacaggcgctgccctggcatagtacttatcatgttataagaaactgtgtgtgtgacagtctaacttgccatcactgactctctgaagtcggcgcagtaccttttatacggtaggtcctcataaatacgtgaatgggtggaaacatacgaatgagtggatgggggatgggtgaacagatgagtgcatgccatgcatgcctcaggagtgcgtgccaaaggctgagtggcagggagcccagcagaagccacatgatgcgggcagccctcagaaacagactccttcccaccaggcttccacaagcctccgacaatcagggaagaacttagcacatccaaacccccaagactcacagcaacagccctcggcaggtggtcccacccagtgctgaggatcatggtggaaaagtgacagaaaaagagcggagacattgaaagtgggggagaaggcaggtgaacagacatgggacagaagaaacagggggcctggggtctctgacaggatgggatgagagagagctggtcgggggaccttgtggctaaagactgccaaccagggccctgactgtgtttccagcctgagctgtgcaggcggtgggagcagaaccaaccacccataataagcctctcattatgggcacacccccttggccctcctctaccccacctccaccacaggggattttagaagttctcccttcttcccaaataggcctagcagtgagactcaggagccctgaggaggggatgaaggaggcaactccactgctctcccggaatcccctccattccccaaccagacagacccaggaggagtcttagggcttcccctactgtgagctccccaagggcagaaatgatttctcttccttttccaagatgggaacacacagttgggcaagggatggggaggaatctcagtaacattatcttattgttaaatggatggatggacagatggatggatggatggatggatggatggatggatggatggatggacggacggacgggagactgttgccagaagaagaaaagactgccaaagataaaacaaaaaaagaattcactaaatcattaacattgatgatttctaagggtgggaatatatcgtgactctgagtttctccatttcacctttctacattttccaccttccccaaaacaggcagatgttacctttataatcagaaacattcatctacctttaaacaatggccagcgccctgtgctgtaaggggtcctctaacatgtgtcaggggaaagacacgatcctggtccccagatggctcctaagtggtcagcagaaatatgtggcaaagtcattgccgtgcccgggaggtcaggatgagaagatgttttggagatcaatgatgaaggtggagagagggtggttgtctgaagagcaggtgtaataggcaaaggaggacagcttaacatcacacgcatgtcagtccatgacacagacacgtgacacgcatgaggatgcctttcctgcctcccctcctcacaccttgataactgtctgaaagcacctattactccccctccacaccccctatctgtctagctcctctttaccattctctgaggcagagccactgtcaccaccttcaccatcccataccctagaaggagctgcctctctggtggtgggggagtgttttgtcccagggtgagcaggagtcctccctgcctgtgtcctggggctggcatcttagcctccccctgtaccctcagggttgaaatcacctcccacagccttcttgagccaggctgggtgctcagctcaggtctctggagggaaatatagccccacccactgcccaaccttcctgcccaacctcccctcactgttgttcttccctgaccccagggtctccccaccacaatagataaattgctgtcttcctcccacccccgcctggccactagggctctatttttaacccacctcaaaaactctgactcagaatcacagggctcccaggtaagctgctcccttgcctgcctagggctgcctcagacacagtccgatttagagccaagggcatctggggcttggtttacaggcgggttgtttggatttgggtgtacatttattttccaatttttctatgtttatcaatatttgaggaacaaagtttgtttcgttttgtttttcttaaaacccaatgatgaccctttacccctgcctcttctaaggtacctccccatcctgggctgaggtcctgcctgtcatgatgcaatgagagctggcctcagcctctccccaagaaggtgagctgtgtgagggcaacagctaacccagtcttctcttcttggcctgtgatccttcagccatacagcacggcgcccctcacacaggaatgtgcacacacatcacctggggactttctgagctgcagacctggtggacttcagtcggctgtggggtggggccaacatctgcactgttaacaagcacccaggtgatgctgagactgctggtgcagggaccacatttctgtgtggccaggctattgtagatgtacggtggctaggtgctctgctgtgaggccttgggcaaatcacttaacctctctgagcctgttttctaatgtgcaggatgagaacattaatccccacctcacaggagtctaggaagaccaaatgagataatatttacaatatgctatatggcataaatactcaattcaagtgggccattatccccatcatcatcatccccatcatcatcatcatcatcatcattctatggccattaagatgcaggtcctggcctgagagctaggaggatcctgagggacacaaatggtcccacctcaagaagccctcaatatagaggatggacagacccaccccacagcggagctgaaaatccaggccagctccatgggcagatggggccatgagccaagggaagggagtaagagggttgatgcagaatctctgactctgtatccctcaggctggggatggccagaggggaggagaaattcagccaggcttgctccagaaaggagcagggggcagcatgccctgttgggtactaaagcctcaaagaggatgcaggcgcccaagtaggtccgctggtcaggagacagcactgtggctagaggccaggggttacaggaaggaggcccatgctatgcgatggaaggtgtctgggtcaggggcctgagattctcaagttctagtcccgtccctgtctctaacttgctatgtgaccttgaataagtcccttcctctcactgtctcttcctcagtttccccattggcacaacacgaggatggagctagacatctctaaagatatgctgagttccatgaatctctgcagtgcagaggctaaagaggtcagccaagggcagctggccagattgacagctcactcacggaagaacgcgcacctcagggaaccctgacacctcagctcccagctctgaagagaatgtggaagacatcctgaacgccagcttgagaactcagggctcttccagggtacatgaggggctgggaaagttatagaggaagagaattccttgagaaagggactgcaaccgcaccttctcaacagcacagtgagaacaggcctgggcaaaagaaacactttgagatgaaaacccattgtttatctgatgggctaattcctcctctgcagaccctatgttgcatatgcagaaacacaccagtgaatatgtacatgcgcacacacacacacacacacaccgccaaactgcacagcaggggacatctgcttcacagtgctccaagttgcccagatgcatgttccctcaggccagggcctaacctctctgtgcttcacccagtggacaagaccactggggaagatgggggaggtaacaagcagttggagaacctctcagtcaagcttacaagaatcaaagaaggctccaacaccactcccccaggaaccttctgtcctcccactcaggagattggagcaaaaatagaacattgttgtggagtagcacgggagcacaccctctggggaaattaggtgggagagctcacctgctcacacaggaaggcactgccagcagcgggaggaaacaggcttgaggggcaacatgaagcactggaaatggatttggggcagaacgtctttgttttttgctttttttttttttttgagatagggtctcactctgtagcccaggctggagtgtggtggtgcaatcttggctcactgcagcctcgacctccctgggctcaagccacgctcctgcttgagtctctggagtggctgggactacaggcacacactaccatgcccagctaatttttctttcttttcttttctttttttttttttttttttgtagaggtagggtctctccatgttgcccaggctggtctttaactcctgggctcgagtgatcctcctgcctcagcctccaaaaatgctgggattacaggagtgagccacagtgcctgacccggggcagaacttcttaaggcaggcagcattggtcatagaaggggctaacaaggaggccataggaaggcttccctataaagagtagctaaatactgactctgcaagggtctacaccacccctttttgatgggatggagcttggggccaaacaacaaggattctctggggcatctggggacacagagctggagggaacgggctgccttctctccaggaaaacacagtctaacaaggaagatgagtggggccatgttctctgaggtcccttctggcctcagaattttatgattttgactcctcacaacccacaaggaaaaaaaaggtataaaagctccctggagagggaggcctattaccaatggggttggatattgtgctaagaaggcaggattttaccccaagctctggggagccaccgtaggactaaggcaaatgcagagcaatcagagaactgcaggctgttagtgcagatgggggcttggggatgcccagctcattggctcccaaagtgatggaggcagaatcacctgagtgcttcctgaaactctacctgcccggcctcacccagggagcccaaacatccatgatcacataagcacccagatgactcttcagcggctgccaattcaggctttgggatcttgctaacacccaacccctctctggtcccattttcagaggaggaaagcaagactcagagaggtgaggcctcagttaagtccacacagctgggcagcacagagccaagtcttctactggtaggattcacaggcttgtcccctagactctgtccccaggagctacagagcaacccaacaggatgatgatgccccagagcctctgggacacgttgaacggcttttcctgtttccttcctctgccaatcccagagtagatgatcccgctggcctgtcccacagggcccctccacccacagtcatctggtgtgccctgcagtctgcatgggtcctcacactctgagctcttctgaggccaggtctgagcttccaggaggggactgctccctaggaggggaggctgggaggagagcgtggttgaggccctttcccggatggcatttcagttcattttcattaagctcctgctgcatcacttcccgggaaggatgccccggaaacaaagaaaagaaagcctggcctccatccacggaggccatgacctaatggagggagggccttcaagaggcctcaccaatatgacacaacgtgccaggaagacccccagccccgctccccaggacaagggccgacaaagcctccacaaaacaaggcccctaggtaagagatcttccacgtgtccctggcccccagggactgcagaactctaggatcatgactggctggacctcggtgacagagccagaaagagggagggagattctcaaaagctctactggtcggcagcactgtccctgccctgctggctctatttgtgctaatggggtcaggattcagggctcaatacctatttggccaattagctctgctctcttcagcctcatactgaggcccgaccctggacactgagagaagagaggagcttgctgaggtcacccagcagaacaggatgagggtcaggaggggaagctgagggtgggagaggtgggcagttctgggcaggctggctcaagatagaggacccagggctctggggcgggccggcccccacactgcaggaagccaggccccaggggcagtctcccctgctggaccaagtttcttctaaaaggtgctaatggcatgaacgggacctgtggacctgagggtctttcctgtctttggggaaaggaacaagtgccctcacatcctctgaagatactggaggtgggagaagcccatggctgactttggcatacagtggctggggactcacattaatcattaacaggggctgctctagcctccaacggggaactgcagggtaattacttctgggctccaggccacacgctcagtgacattattgcaggcaacacctgccttctgggcctagtaaggcaggagaagcgagtcttctcaaaggctgtgcacctaggaccagggtgcacacatacacacaggcaaacacaccacacgtactcagatggcagcacaggcagcccgctcagagtcctcaagggtgaagggcagggactaaggagtacaggttaaaggaggcaggttctgaataagcagcccccagcacctgccaacacccaccccagccaggcggcccttagcttaagcttccaagaaagtgcacagagtggttctctctttccttcagatccagctcagagtcacttgctccaggatgccttccctgaccatcaatccatattgatctattgctcatctgccctcccataaaccagaagtggaaccctactctccattttgccacctccagcacccttaatagtgaaagcagtcttggaatgggtgatatggtattctggagggcatgactcccttagcttgcctctctccaagcccagaggataatgtattagccagcccccattatgtattaatttctgaaagcctcgttcacgcagacataacacatccacccacacagataaatgcttagacagacacaaaatcatcagcagccaattatcaggcccccgcagctgccgtgatcagacctggaggccccgctgcttgctctgcaatttgtggtagcccagagctgggggagcagtgggtggagggagtccccctatccagccggcacggctcgaggtccagccctgaccctgagggcacctgagcttgctgcctggctgagaacaccaaacaccagccccaaacgatgaagagagcagagttgggtggggagctgtcacgtgtgagatttggtggctctggcgtcggcagtggtggctctgttgtttatttataatttgtactttacctcccagagaggaccagaggcagctggctcagatactaagaggtgtaggagctcagggaacttagggagagcttcctaaaggggggcggggcacgaaggtagagtcctgagccttggtacctcagcaagggcaccgaaattggctcaaaggctttgcacaaggatgccagttcctgaccctagaccaaacccttcccttggccacagacttagccctgaccccagccacggactgaaccccaatcctggttacacactgagccccgaccattgtcagaagctgagttctagccatggtcacagaataagccctgattctggtcacacactgagtcctaaaccacagatcaaccccacttcttgacttttctgaagtctagcatgaatagatcacgtgaccatttctctggtggatcagagaaagataccactggacacttgccccttctcctctgaaccccaatcaccgccatccatgaacaggggcattaatggcacccggatatggtccccaaaccccaaaggtctctagcagtcaggacctgcccaggaagaggaggtgagctggcatcccagcccagcatcctcagaaacagcatccccagatctggggtcaggacagcatgtcccagccaccagactctgcatcttcagaaaggggaaggctcccttctcatgggagcagcctaattttgatgggatcctgaaaatatctatcatcccagaaagacaggtatgaagctagagtgacaagaaaaagctccaactgacaggaccattcaggaaaagccttccctgtgaaccctctggctgggaagctgggggtggacttaagcttgaaggcctttgcagacaagacgttacacaacccacttggtctctggtttcgcctctgacatactctgtgaccttgagccagctgctccccctctttgctcctctactccccatctatgaaacaaaggctccaggccagcggcttgctaaggcctctccagatctgatattccgacacctgatccattttctgtgcctgctgactatccctttctgagcccctcctcgacgttttaattctcaggagaatgttttcttgaactacttgtgtaattaaattttttaaacactaacataaaagaaggaggaatgtcaaattccagttctgatattcatggctgcatgatttgggggacctctctctctctctctctcctttcctcgtcggaggcttatctgtaagttggggatataaaactatttggaggccatcgtgaagaataaatgaaatgggagatatagagctcctagcacagcctggcacatggtaggtgctttgtaaatggtggttactgatctgtgaacccacctggctttagtctctgttgatttgagtctagggctataaaatccaaagcctacaggggtcaggcagctaaatggcatgaatgacgtggctgggtgtaagacagtggccttagcgacagctggggacctgcacaactgcagagcaaaagccaatgtaaaggaggcagcctctagtgtctccttcagctccccgctgtggagtgggaatgtggggccagggctgccagggtttccagtttttcaagagaagcccgagagccatattttcatgttgtatctttccatttaaaaacattggctcagatttgttatgacccactatgctggccaaacagagcacatctggatgctgtatttggtgcatgggatgctgcttggcaacctctgatcgaagtactgcccagtcttatcttgagcgcccacggtgacggggagctcaccacctctctgtgctgcctcccacctcagatccgagtgggtgctgatggtacagtgtctcccagtggcttcctagcccttgggactgcagacttctagggccctggcaatgcctcctcagtaaagaagcctagctggcagagaacatcctctccaaagccaacacaatgcccctgcccgcccatggccctctctgtctgggaaacgtgaattcttcagcatcccctgggcgaaagcaagactgtctggccggcctcagtagcccttctattaattagcaactggcagtcgcagctttgtaagagcccttgagccaagtgagtctgtgcaggagccggctgcctcctcggttctaagacaagcccccaggggactggggctggaccttctgctctgagtgaattcctccatggtggtcagtgttgtggcaggcacaagggccactcaggctgctatgacacttgtcagccccatcatttgtatgaaagctaatgcctttcagggtaggagggggcagggagaagtgacaagcaagcccagcccccaggggcggctgctggccatagcctggggcagggaagaaggatataagattgggaagaaggcctggatgcctctgtcctcctctcagctggcccctgtcagagccactggctcccctgctcagtcacctctgcgctcataccgacatctgctcctttccagaaatctcattgcaatgcagcagtcacagtactccctgcgccttctccccagccaggcccacccctctggccctttggatgggagaaaagctgcaaaagtggtgggacaggatggattaatgagggtcctctgaccacccagcttcttcctgttcacacccatcccaaaagccagcatgcgggaccagcagcgtccaagcagcagtgcaggaaaggaggaagagcaagctatgaatcccacatccccacactggcaggcagacctctgtgacttggctcagcccagttcacagacttcaccctgccacgctgagcttggggatagaggccacaggctctgaggccaaagagataaaacggagctctgccctcagggagctcagtttgggagcttgggctaagcatggaacaagcgcatgaacagtaacctcaatactccaagcatggtcctggtctggacaccagccacattagcaatctttgggcgcttaatgagaaatacagcatctcaggccccatccagacctactgaatcagaatctgtattgaacaagatcgccgggtgagtcggatgacattacagcaggacaagctgcattgtaacaaacacagagctccgtccaaatgccacaaggtggtcagccaggaagagatggatggtggccagggtggcctgagagagcatcccacaaggccctggggacactgggccctaaagcatgggagagaagggtggatggacagggagacaggtcagcacagttggaaactccctatgtgaggcaggcagctacctggcagcccaaaaccctcgaagctcacagcagctaagggaaccagtgtggcagggccaagcaggggagaaggtaacccccatccttaccatgtagccaccagaccaggaacttgagccttgcagcagggagaacctggagccgaggcctctctagccaggcagtatggggatcctggccctctgcccctatcgggtttttgtgcacccagcatcctggaagcacctcggtcctgagctccagcagcccctgccttgtcaggtgggacacatctcatccccagagagagccctgctgcccactgtgccagctgatagcacagcccaggcagctcaccttggaattcccctctgcaactaggcacccttccccctccaacacagcctgcggctcctttccgcctggctttgcacactgagagtcctaacaacattcctgggtaatggccccaggaaagcccagcaaagaaggggcctcggaacccccagacccagagtcaggctgctgcctcttcctccttgccacctcctgccagaacagtcctttccaggattcaaagtgagaaaggtgggagcgggtaggactgaggaaatagaaaagaaaccagtcccaagggagaacccctttcccccctcaggcatctaactctgagccctgtttttgtttccatcctgctggcaatgggaggcccaagccccagattgcagagggacccccactgccaggctccagagaaggtgagtgtctgcctctcaccaggcccaggctctcttctgggatggcctagagaggggttcacaaccttgagctcccagatggtcctcaacttagggggccacagacaccagaaattaagtgccacactctatgtgtctggacacccaggtatccttctggatggagtaaaatgtctgaccccaagaaggttcacaacccctgcttgagccaaggacagaggcccttgtgatcttcccaaaaccaaggaaaggaagttgtgaggacaggggaggtgtggttcacaacagcatcacggctcctctgacagctcactgcagcttctcacctcggcagggcgaccacagttgtacaatttgtgcttgacatggcaacaggcaacaagattcccattttctaaatgggaaaactggggctcaaataaggctcataacccacacagggctccacagcagtcagggttggggaggtgatgggaggtgagtaatggcagtgacggggtgccagtgaccagcagcaggaagtcggctcaggacacccctgggacctgctaggccactggcccagtttccaagattttggagcccagctctttctgccccaaggaaaggacactttaagcacccccgtcttcccttcctcatggcttcaggaggctcagtctaggagagggtagggacagggggatgagaaaggccaagcttctgcctgcctccattattaaggctgagccagctttgggggcgcagcagcaatcccagaactgacgttccacacagggacttccccaccagcttccacatccacccacacagcccccagacacccactcagacagacacctagatacacacacccaggctgactccctgagcctgaccagcttccaggaacacaaccagctacatctgcacttggggttccatttcctttctctcctcttagaaaaacaagattagccagtacctatgttttttgttgttgttgttgttccaggttctccaggacacagcttgtgtggaaggaaggacccatccaggacccaagagcccagccagcctcggggaggagcccggggagctatgtcctgaggggctgcagcatcctggcctcttcccttaacacaccacaaatacaagtttcaaaaggcagatggggagttggaggggaggggaagccagaaaagcccagggagcctggggaagccatggcggtggccagggcatggtttcttttctattggggggtgggatcgggggcaggtagagtaatgagaagcagaggtagcccagaaaagcctatgattagccatggcccaggttatgctggtccctcaaagcacagcccacccttgccctggaaaaggcacccagccttcctcccccagcaatgggagatgctggaagcagcccatcacagccagccctgaactccaaaccgcaaactcaatctatcattgtttgctggcaattctttattaaaccagttctgctggatcaatgcttcctgcccgtcaaaatgatgaataaatcctcgactagcctgagcaatgcttgcagaagctcttgcgaagcctgaggtgggcaatggcgattggctacacatagaggcccaaggccaatggctaaaactctagagaccaaggctgggggtgctggtcggggtgcggtgggttaggtggggttgggtggtgggttttcgaagcttagaagaattagctaggctcttgcctgtttgacattctaaggatgacactagctgttttggcctagaagcaggaaaggtatggccaccgctcctccagacacactcagatggtctttcttggatttctttccttacaccccacccagctccagacagctacaaggctgtgcaaagaggacgtgccacttgcagctaccagtccctgttgcttgttgcacaaacccaaattcaaagcccactctgacccttttcctgttgcccatttcacaattctgctgtatccccgcttccctatccccacaccctctcctgcagccatgtcccaggcagcctgcagttagtgggagattctgcagcagggggactgcagacagacataccagaatggggtaagaccaggaaggggaaaaggatcctatctgatgaaatcaacccagtcctcactctccaacttctaaggtaagggagataggaagggccaggcccagcatccagaaggtccccggccaatgcttgctgctgagggaggctgggcatgcctggggttggcctcttgtaggctccccaggcaatgggcttggtgatgagaaccctgaacagatgctttctgacaacaaaaacagcagggacctgggcaagggaggggagggcccttcagcaatctcgaggggttggtactggaactgcctatcaccaccactgaagagttgagagacaggaggaaaaacccaggacacccatgggggtggaggagacatagcccctgctcactcctctctagctcggcccaggatcctcagggcccagtactggccagaggcaagcccactcttcaggaacctggcactgggaacccagacaccgttcctgatgggagggtcccacatttgctcacacaatttgatgactatggctgtctgtttagcctgccctctggtctccctagtcttctgggaatgggaaccctggagatattagggttaggaagagcagtctgtcaaaggaaaaaaggggggaggggctctgttcactacctattttaagccaccgagtgttgtctgactggtcattcccagtgcgagaaatctctctcattggatggaaaatggctttgctctcattacaaacccagcttccctggagtttgcaaagagggctctgggttggcaaaatgctcatttttataggcaggcaactaaggtaggcaaggaagggagataagtaggcggcagggcccagagaaagagagaatgagagaattaaacccagcttgaaaagtgtttcccagaccttcatcacaatctcatgcatcacgaaagcccagaggggcactagggaaccttaggaccttgacttaggtaaaggcatccctgatcccaaccctagaaacaaccaacaatccctctttttgcacaaatatgcccacaagctcccagtggtatctgctgttcagtggcatccgactcaagtgatgtggaagggggcagggtccctctccctgactggcagtcataccttgtttggggacccacgagtggcccatgagagaccaagcagatgctggagcttgggtctctggggtatggatgggccactggacaagcatgggacacaggacagctgctcatcagtcagaacaccaggcatcttcacccatcactatgagcaaggtcattcagccctgccgctctggatgccagctgcccagggtgcctgctcttggcccaccactcagcatgaggagctgagctcagggttacggtgggtgcagggggttttcatcccggcctgaggccccagtgacttcggtcctccagggacccggccgcagcttcccagggcaccagaaagcagacataaatgcctgctgtcagcacccaaggagctggcccgttgctaagaggtctgtctctcttcacggccctgctctgcaggctgaatgacccggagctgcctctaggatggccatcctgactctgcagccttgaagggggaggaggaatatgtggcttaaggtggcagagccctatcctggctgccggcaggggtaggccaggctcagaacaccttttcattctgtctccaatgcagcccagacccgagaagaccagtgactgaacccagaggaaagttcccccagcgcggtgcaggagggggcctgggggtgtctcggagcctagaggcgccctgcctctcttggagctcccagcgcaaggcaggaaagttaactccggctgggaggcagggtcaggaggaggcatgcctgccaccgcgcagggcacccacaggatcatcgctgtggccccttacctgaagtcactgtaggggtggataatccaaaatccggccgacttgaccctctcctgttcgcgctccacggctttctggctgccgaacatccttagggagaatttgttgaccccgggttggagcatggccccgaactggcgctgcatgaagccggcctggcccaggcgcacctcggcctccgggaggatctggtcgccggcagccgcgcctccctccactttgatagcggtgtccaccgagggctgctcgcaggaggcggaggccggctgcggtggctgctggggcggcggcggcgaggctgcgggctgcgccgaggcgccggggcgctcgggctcggccgccaggcctgggggcgtcctgtcctcgccgggggacgcgtcgccctcggcgatgagccgccgctcctccgcggagtcatgcaggtgtccgtgactgctgccgctccccgtgccgccgctgccgccgccccggctgcccagcgaggccaggctcccgcggaagcgcctgcagtcgccgttcgtgctggacttgcccgcgccgcgggccggcccttcgctgtccgctgccccgagggccgagctccgggactccgtgccacccgcggccgccgagggggagggcgagggcagtggccgcagccggatgctcctgcggctggggtcttggcggcccccggccccctcctcctcggcgtcctcttcctcgtccatgatccacgccttggcccccacctgctgcgggaggctgtagagccgcttgcgcatggacggcggcagcttgtccatggcgccaggggccggggtcggaccgggccgggggcaggagcgcggcgccgcggacgggctccaggtccgcccgccggtcagtccgcccgtggggacgcgtcctttgccgccggcgtgggggcagcctcaggcgcccatgcttgggcaggctgcgcgccgcggggaggatcctagtcccgctccgagtccccgggctcgccgcgctacacctcctcccgggcccggctgggcgcggggaccccgcgctcccttcttgcctccctccctccctctggcgttcaggggcgcggcgcgccgcccggctccaggcgccccgcccccgcggggaacaatgggcgccggccggagaggctctgcggccgcggcgctcagggaaccgctccggagtgcagagcgcacggcccgcgcgggtcccgggcgtgcgtcccgcgggagggctggctgtccgtctgtctcgccgcccgggctttgtggctggccacccgcgagctcgcctcgcctcctctgccccggcccgtccggcccgtcccggggctcccgccgcaaccgagcggagcccagcgacccgccgggcttacatcagcggccgcctcccccgaagcgccctccggcagcgctcgggctcccgcgccccggaatattcatgaagccgccgcagctcgcgggttgccataggagcggctccagcagccgggcctgcctacctgggcttcttaaaggggcagcggcgcacgggccgggggctggaaaggggcggggggcgggcctggcaaggggcccaggttagaccctcgctagaccttcggggccggggtgagaggtatccacactgctgcgcccttaaatctctttcctgggctaagctgggagtgcgccccaagtctgaagctccggcttcagttgcgaattccccatcctaagattgaagggtggggggtggcttcccaatttctccatcaccaagctctgggctcgcctttccctggcatttttgcccctcagctgggtctccgactttcctcttgggaggcgaccgggttcgtctggatgcagagtcccggccttcccgcaaccctcctggagagggggcttccggaaatgcgccgcgtcggggaggctcccacggttttcctgtgacatgggcagggtgcgaaccccgcgccagtctttcccctgcaaagcctcgcagcagccaggcaaggagggcgtggggaaacagggagacacgcacagggcgcgcgggtgggacccagcccttcgaggtaagacttcgaggaaatgcgccggcaacagtgacggatgcgagatccgaacgccgacctccgcacgcgcctctccctcggtagttccgagaaagggacaagccggctgcagcggggagcggttgggccggttcctcggacgccccagcactctggaactggctttggagccccttctccctgtgttcccatccacattatgacacctactatgtggacccacgctgggtgagttcctgttccacccagtcccctacctgcacccccaagcagctgcacagcccccactcccttccagtctgcagcccagcccccttccccccaacccccgccaaggatccaactgtgtgtcctctctcccagtctctcccagtgtacagtgtccgggcttatggacagatttcactagctcagcctaaggtatagccctaccccctccaacaccatggacagcctgataccccagattagctcagaaatggatagggggacagattgggcattaaggggaggggagttgtccagagaaggctggagccgaggttaatgctggagcggacacacagcaaagtctcacaggagggaggcaaaaaggtcccctggctctgccatctctctgaggaataacatcaagtttttcttcaaatgatttttttactctcattcttagcccaatgtgaccactttcgcctcctccatccagagtaggaatttggagagcaggatgcggggcgggcagcctagcaggggctcttctgctctacccactggaccacaggacctcccacagtgagaggaatgactagggtgatgacatcactggtagctggcatttttacttttgagcagctctgagctgacagttctctgcacagatgctggaagcctaatccctgagtgtccttgggtctccttgagaagaagtgttcttaaagagctgtgagcccagcctgccctggtctaccagccacaggagggaagacctccatttaacacacttctttgagcttctttgtctagctgggagttagtctgccttaaccccgctcaggaagtcagcccatataggcttccccatgacctatggtagagacatctcctcctctgggaaccctttcctaatcaccaaaaccttggtcatgtccctgcctttggttcccatggcccattagctcctgtgaccctgagcactgattacacagtgcagtctgtgccctgagggtggagcaggtccaccttatctcagggacctctccaccaacacaagggtggacagaaagcagattaataagtttcaactctacaaatgagtgagggaccctagaagttagctaatggcattggaggggatgcttggaggagatggaggataagaccaaaattctgcttcctgggatactgctgccacaggccggccaggggtcaggatctcttaattccaccctaccagcacctcactcgccctcaatttcattagtggcacccattcacgaccatctaggaccaactttaggtgcagcaatgactattagataaatcaggcccttgataaaccctgatgagatctggcttctcctgcctcctttatgtggaaaccctaatggaggacactggtggtgtgccaacagtccaggggacagaggaggagcagccccaggtcttgcccttgatgggcttcaagttgtgaggaagctagactcattctcaggaatagggcatgaaaatagagcaggaaaactgaagacaggaaagaaatgtatattaaatcatgtccccaaccatgagagatttcagagggagctattgctggccttggagtagctagggagggtttcctggaggagggggccagacttgatgagagacatatatctaacactttacagtttacacctttttgttgttaaaccacatgaaattttgatttttgtgagcccaatattgtcaaattttggcaatttcacgtgagtcaacctgacattcttactcccatttgcaggcaagagaactaaagcacagagaggtcaagaggcttgccaaatgccccatagcaagaaaatggtgaagctagaattcaagggctccacagggcaggctgtgctctactgcccatctgctcatgcaggtggggtagggggcaggcacagatggaggaaggagaaggagagagaaggtaaagaatggggagagaataaataggactcccacattctgtaatctccccattgctccacctgggtctcacaccctctcctttccagcactgcctagaaggcctggggtctgctctggttcctttgataacatggtagccaggccctggggaccccagcaaggggaaggccctgtctcaggactgaaatatatggagaagacctgctgctctcaccatgggtgggggactaggggactttggagacaaatgggctgctgcagtgctgcagcgggcctggatattcctggaatgcaaatgtagaaaacatctgagtctaagagagaaggggactggggaggatgggtttccttccctggaacggacactgaatatcagtgaaagttagaagacctgctgggagtagaagtggagaatgtagctgattgtataaatcaacctcagaccttatttgtgggggacctagatgggcagagggggatgggaaattctggaagcttatttgcttatgggcagagggcattgttcttgcttggagaggcagctctggggtagggcagtggctcccacagcctgcaatgccaaagttttggccagttctgcttgaaatgagatgaaaacacacacacacacacacacacacacacacacacacacacacacacacacacagaacaatgtaggatattttaggttaaggttgccaactgtcctttcttagaaggctgtctttattctaaggttatatccttgctacattctctgtgttaaaatgcccttttatgaaatcatggtgctggaagatgctgttttttcaatgtcgttggctaaataaaaagttggcactgggttctgtgtttgttccgaaaaatcatttttgaaatgttattgatctataagttccaaaagtctgggaacccctgttgtaaacaatagagcatgaaactgaaaaacaaaagctggagaattaagtacttctctgtcagttactgcctgtgtatgcctcgatcttcctcgtgtgtaaaatgggtttaatgatatgcacctcaaaagttattgctaagactacatgagaaaatgaatgcacctagcatagcatctcatttgtagtaagttctcagtaaacactgaatgatgaaatgatggaatgaaacctgcattacccaatggagaggaaggctcctggcctttggaatccaatttaggtcatatcatcttaaaactttctgttgggatgaaagggatgttttatacaagattccttcctttgaactctccatccctgacaagccctggctgggtctccagaaggcagacttccttctctctgggacaggaccttgctgtggccccaagctctacagcaagcttgttcaacccgcagcccacagaccacatgcagcccaggacagctttgaatgcagcccaacacaaacttgtaaactttcttaaaacattatgagatttttttgcgatttttttagctcatcagctattgttaatgttagtatattttatgtgtggcccaagacaattcttcttcctccagtgtggcccagggaagccaaaagattggacacccctgctatataggcagctgctaactcagagggccacatcgttgaccctgtgctcaaaaccctctgagaaggctgggggtggtggcaagtggtatccatacatacatgccacttcatctttttgctcagtgtagatacagtcctgcacttctgctctgccccaaggcaggtctgctctgtagggctggacagggatcagggacatatagacttcctgctgggagtcctgacctggagacaaggcctccaagaaagaatactggaatcagcaccatgccctcaggttttctgtcctgaggcttcctgataaagaagctggaaaaaaaaaagaaagaaagaaagaaagagagagagggagggagggagggaggcagggggagagagagagagagagagagggagggagggagggagagagagagatagagagagagaaagaaagaaagaaagaaagaaagaaagaaagaaagaaagaaagaaagaaagaaagaaaaagaaactaagaaactggaagggtggaaggggaggggacatgcagggagcaaccagactggatatagatgttccgggaaacaaaccaaccagccagagttgaccaagcccttgggtgcccaaccctgtgcacagctacacatggatggaggccaagaaggcagagatatgccctagcttgggcgatacctggtctggtcaaagcagcaaaagatcatcccagaggtttgtaatcaagagtcaaagggagtggttcagaagctcagggcaatgatcctcttgagtagagtcaagttgggttccctggaggaaatggaaagtggttagtgtgtgtgtgtgtgtgtgtgtgtgtgtgtgtgtgtgtgtgtggatgtgtgcacgcgcacatgcttattatggaggaaagagtgaatggagtagccgggcatggataaggcctgcagcattctcacagtggggtcatcaaggatagagctgggggcaggtgttcaattcacctgcaacagcctttgccctaagctagccctgagagaaagtcctgctgtattatactcagtccttctggtccccctcctcccagtaccctcaaccccagtaggtgacacttgctacaaaaaagcactgggagcccacatgcccatcacatcaaggtgttagtgaacaagagaccccctataggctcaacttcctattgggcttgccatctgctttctcttcagttctgcctggtttctttaggatctaggagcatgagctattgtattgtcctcttctctatcccctgcctctgtgcaggactccacctgtgagcccctggaccccagcagagcccaaagccctttcatctctaggccagccccagctgcattgcccttgatctgtctactccacaccaacccggatgctcgactgttccctggggactctgccagggcactgggtgggacctcttccccctcccacctcggggagcctggaggaagatgtgctgacagctcagccaggtctggactgtgtctctgtgtccttctggggctccaggacgtctgggccacctggactcagagccaggccagagagggaggcactgggagggggaggccctgaggtgccagctgagcagagctgccaagaaataagtaccacagactcctctgttcgaagtctggaattcacgatatatcagggatgaagtgggttcagacaggggcctctggggtggtttcacagcttgggctggaggcgccaggaagggaaagaaggaagagacagaatggactgggagaggggggaagagactctgaaaatggggctgggtgcggtggtagaaagagaggtggtggacagctggagagttggggcttttcctgggaccctgagatggcccagggactggacttggctcagtcccccactaacactgggctcctccgctccacccagccttgcccaggcagtcctccctgccatgccctcagtcctctccccgacttatctatgttttcttcctcccccaatttcacatgatcccttttctctgttcaacgtgtggagtacctgttatctgatgctacatgacccagtccctaatctccaggcatctccaggctatggcaaggataagacagactcaagacttcacataaggaagccagggacgaggagcacgtgatgtggacaagaggctagagggccgaggggggaggaggaaaagcgtgaggagggagcaggggagatgctcatgtctgaagtagttttgatgcaagcaggtgtgacttgtagaagtggaggcagggaggtggggcacgccaggtgcagggcccagtgtgagcaggagagcagcaaagggaagcccctgccctggagtgggtgagcaccctgggagaccacagtcctggggggtcaaggagtggggaacgcgaggacatgagggtgggtggctctggaagccgtgaggaatgctgagggcgactggagacaggcttttgcgaggaccattgggttgtgccctgggagcccagcgctgtgctcagctctgctcagagcgagcaggaaaagaacaagacacagtccctgcccctggaagctcacagtggggtggcgaagatgaaagtaatgctgtgaaacaagtcatcctgccagaagcaggggcctggacccctgactgctacagggacagggactgagcaacagccaggctggagtttaagagagctgctctctctggttccctgcaaagcacatctttgtacaagccccaaggcccagcctccctcccacaagccccatgcctcagggtaacctgctattacatgagccttctgctggatgccttccagaaagagacactccactgtgtaatgagagctgtgccccaggccaccctgcaggatccagagaagaggcagagccagggagagggcaatggagactgccacataatctatgacagatgtggtgacaggggctgtcatggaggctgtgacagagactgcggtgtggactgtgatacacaccgtgacaaggtctgtgatacagactgtgacagggactatgacagaggccgtgatagagactgtgacaggggctgtgacagagactctaacagacgctgtgatagagactgtgacagagactgtgatagaggctgtgatagatactgtgacaggctgtgatagaggctgtgacaggggctgtgacagaggttgtgatagaggctgtgacaggctgtgatagagactgtaatacacactgtgatagaggctgtgatagagactgtgatagagactgtgacagagactgtgacagaggctgtgatagaggctgtgacagaggctgtgacagaggctgtgacagagactgtgatagaggctgtgacagaggctgtgacagagactgtgatagaggctgtgacagaggctgtgacagaggctgtgacagaggctgtggtagaggctgtgacagagactgtgacagaggctgtgacagaggctgtgatagatactgtgacagaggctgtgatagagactgtaatgcagactgtgatagaggctgtgatagaggctgtgatagagactgtgatagaggctgtgacagaggctgtgatagaggctgtgagagaggctgtgacagaggctgtgatagagactgtgatagaggctgtgacagaggctgtgatagagactgtgacaggggctgtgacagaggctgtgatagagactgtgatagaggctgtgacagatgctgtgacagaggctgtgatagaggctgtgatagaggctgtgacagaggctgtgacagagactgtgatagaggctgtggtagaggctgtggtagaggctgtgacagaggctgtgacagagactgtgacagaggctgtgacagaggctgtgatagatactgtgacagaggctgtgatagagactgtaatacagactgtgatagaggctgtgatagaggctgtgatagagactgtgatagaggctgtgatacagactgtgacagaggctgtgatagaggctgtgacagagactgtgacagaggccgtgacagaggctgtgatagaggctgtgacagagactgtgatagaggctgtgacagaggctgtgacagaggttgtgatagaggctgtgacagaggctgtgacagaggctgtgatagaggctgtgacagaggctgtgacagaggctgtgacagagactgtgatagaggctgtgacagaggctgtgatagaggctgtgacagaggctgtgacagaggctgtgacagaggctgtgatagagactgtgacaggggctgcgacagaggctgtgatagaggctgcgacagaggccgtgatagaggctgtgatagaggctgtgacagaggctgtgatagaggctgtgacagaggctgtgacagaggctgtgatagaggctgtgacagaggctgtgatagaggctgtgacagaggctgtgacagagactgtgacagggactgtgacagaggctgtgagagaggctgtgacagaggctgtgacagaggctgtgatagagactgtgacaggggctgtgacagaggctgtgacagaggctgtgacagaggctgtgatagaggctgtgacagaggctgtgacagagactgcaacagagactgtgagagaggctgtgacagaggctgtgatagaggctgtgacaggggctgtgacagagactgtgatagaggctgtgacaggggctgtgatagaggctgtgacagaggctgtgacaagggctgtgacaagggctgtgacagagactctgacagcgactgtaacaggaattgtgacaggggctgtgacagaggctgtgttagaggctgggacagagactctgacagggacagggacaggcactgcgatggggactgggacagaaatgtgactaaatctggaaccacaatcagagttgggacaacagttcctggagcccgggcccacactcccacggtcgacagagcagttggcggtgacagcagcaacacagcaaacacagaggcccagccaggcccaggcatttgtggggacgccagcaggctgaagctgccgcgggaagacagcgagagggaggtgagtgaggctggcgcccacccagctctgcctcggatgtctgtgtgtccacaggcgagttcctggccctctctgggcctcagtttccttgatagtgcttaccatggggacagatcagattagagtgtggtaagtgcaaacgtgcactgactgagggtcccaagttactctcaggggtctctgaatctccagagtctccccaggcacagccagctgattgaatccgtaatgcgcctcccacacatatgaacaaccatctaccccatgtgtgcagtgctcttgtgaagaacgaaacacaaatttgttttaaaatgtaagataattcatagtcatgatcgtaactaacatttatggagcacttgctctgcgcaaggtaccacaccaaatacttagcatggattagctcatgtaatcctcactagagctctgtcaggtaagtggtattttccccattttacagatgattaaactgaggcttaaagaggctgaccgagttgcccaagttcccaaggctagaggaagagccagggtttgaagacacttctgtctgacccagtctgggctcctatcctcactcaccatgagcaactctcttaatcacaactgctattgtgtcagatacacttgaagttcaaagtcaaaaatgttttcattgaaaaaggggtcttcacacttgaattggctgggacctaccgggaagcgttccttcagtgcgtgggcacttctggtatttctggaactctatcttctctctgcccctgcctgaggcactaagttggggataagcaggatatgattttctgccctaagagagcacagaatagctgtaacgatttcaaggactgtgtttgtttttgcaccttgtgctcaggatctcactttgagctgtgcagagaaggccctcacaccctgctgtccttgagggttggatcctcattctcccagatgctccttggtttggaagtgaggtggggacccccatggctcctcccagaccatcactcttctaccttcccataaaactcctcacccagccgggcgcagtggctcatgcctgtaattccagcactttgggaggccaaggcaggcggatcacctaaggtcaggacttcaagaccagcctggccaacatggtgaaaccttgtctctactaaaaatacagaaattagctgggcatggtggtgggcacctgtaatcccagctactcaggaggctgaggcaggagaatcacttgaacctgggaggcagaggttgcagtgagccactgcactccggccactgcactctagcctgggggacagagcgagactcaatctcaaaaaatcaaacaaacaaacaaaatccctcttcacccacctgctcctcagaggctcccacagctggtcccctcatggctgtcaccaaggcatctttcccactgaatttccgccttcatggagggggctccccatgaaccttggccctggcttctgatttcagtggccttcttctcacccccagccatccactcccatggcctcaacctagagatgctctacctctacgatttaggctgacctcagcctctgctccttccacctgctctccgggccctccctttacacctgctcatcaagggcagtgagagctgcaaaagaactctcagcacataatgactccacctgaacccttgcacccagagacttaataaaactctagcatcgtttctaacagctcaaagcagcatcactagatgatgactccagtgctttaaagtccctgcctgggaaagctcaagatggccaaaagaatttattgtttgttccagtcgagggcccctgtctcccagtctctgtgggagggcacttaactttgataagtgccagtcaccaaacctagcttgcctggtcatatagagcaaactcctgtttttgcccttcaatgcctgttgcctggctcatcccactttaaaaaaaaagccttttggcctttgttttgaagaagttgagttcagttcatgctgaacccttttccctattgcaatagttatcattgaataaaatctgtccttaccattttaactagtgtctaggtttgtttacctttgacaatagcaagttctgtgcatccgccccttccgccttcagtcccttcccttcccagtttagataccaatatctaccaccacaagcttatcttgccagtgtcctcaatttctttgcctcttggttctttttgtctgtcaacctagaaactccagctctgaccttctctgcaggcacaccagctacagcaggcctgagaggcagccagagaaaatcacatagccgcacagatttgttcattgtctctgatgtgcctctatgcctggcaatctgactgtgttttccttatctgccatgtcttcattctgttccatcagtgtctgagtctgcacagtgttgctatgacagaataccacagactgggtaatttataaagaaaagagatttagttggctcatggttctgggggttgggaagtccaagagcatggcactagcatctggtaagggtcatcctgtggtggagggctggagggcaaaggcaagcatgtgaaacagagaggaaggggaccaaacatatcaggagcccaatcctgcaataatggcattaatccattcgtgagggagtagctcctatgacctaatcacctcttagaggccccaccttttaatacaatggcaattaagtttccaacacacaaacttcagggggacacattcaaacaatagcaaccagttaacacttctccccaaatctcagccttctgatcaaatctctgctatccaaaaaaaaaaaaaaagtgtcctccttgaacttcactgtccctttctctccttcccatcacatctaaacctctcaagagggtgggcttcatttgctttcctttctcaactcccactcattcctcagcccatgcagtcaggcttcactacccatggtgtcttcagcaagaccacaaatgtcctcctgagtacaaagtccacctttttttcctttccttattgaccttggagcaccatgccatgctgctgaccacctcccccttcttgaaatacccccttcccttgacttcagggacacacactcttctgattttctttctacatctctggccagttctcaggatcttttgtgtcccatcctcttctactggctcctcacatgtgggtgatatccctgactctattgtatgctctttttttcccccacggggtctctctccctgaacgccagacccttggcttcagttgccattcatgccttcagcccagacctctcctgtgggctccagacctgcttatttggcttcttggatgtgttacaagcagcacacactgaaaatgtctaaacattcacactcttctccaaagacccctgctcttcctgctcaatgaacgagaccaccatcatccggtggctgaagccagaaacactggcattattcctgactccttcctctgccccaacatcccatcagttcaaaagtcttatttctccttcataaatatctctcaaatatgtccacttcttaccatatgcactgacacaacttcagatgatttcttgcctaggctatggcaacagcctcctaactggcctctctgcctccagccttgctctactataatccattatccatgatgctaccagagtggtttttcaaatgtaaatctagccatatctgcttaaaactcctaacaaatatcactggccttaggataaagtccaaactccactggcaaataagcggctcggtggtctggctgctgttgctccctcagccttccctccaaccagtgccctcctgaccactgcactgtgtgctcatgcatgtccatgggctttctgctggtggtgatggtggcgatgtcattcatggcagtggaagcgatcagatgtcagttgttggtgattatggtggtaactttaaaccactgcccatcacattttcaaggcgatctttggaggctgacttcatccaacaaatattcctcgctcctatttcctgcagggttaattatgcatgcccatctcagatccacctccatccaggactgttttagggctctctgtttggggccctggcgagctcccacattgactcttggttatcagcctgaacctatgtccagcgttcatctctttctggccttcagttgagcccagcatgttggtgatgggacagtgatggcgataaacatgaagatcctgctgctatcagcactcactggggagacagacaaagttgcctggggaccctaggagaggagccactgggaggtccagccaggtggtgctggttccaagtcctgctgcgtccagcagtgatcagctgatggggctgctttgaccttctcagaggtttggctctgaaacactgaccttcaccgactttctctgtatacccagggctgatggtctgacccccaacacagggcacttggttgccaggctggagccctgacacttctgatacagacaacatctcttcccaataccagcatttatttgcatctatgaatatgcatggaggctgttttcctgaactggggaaggtagctgggagctgggaagactggatataagctgtctggggggtgatcacaaggcactgatctgcccctgtggtaggcagaatgacgggccccaaagataaccaggtcctaattcctggaacctatgaatgttactttgcctgacaaaaaaatatataaaagtttgccaaggtgattaaggatcttgagatgggaagattatcctggattatctgggtaggccctctgcaatcactggtgtccttataagagggagacagagggaggtttgacccagaacaagaagacaaagtacccacaaaagcatgatgatgcgctgagggctttgaagatggaggaaggggccatgagccaaggaatgcaaaggaaaacatctagaagtgggaagatacaaggaaacagattccgcactggagcctctggagggagcgtggctctgccaacaccttgatttcagcccagtgaaactgatttcaggcttctgacctccagaactataagagaataaatgtgtgttcttttatgccaccaagtttgtggcactttgttacagcagcaataggaaactaatacagtccccttccaccctccctctctgtcactcctcacttcctcttgagttgggttaagctgtgggtaagcagggtagctgagcgctgagtggtagagaagacagtcctcctcacctctccttggggcctggcaccctctggttccattgaatggtggctttggaaacattggaaggtgacacctcctcagagcagtagtcacacatgggtcactgtcagagtgacatgctcaggctacttccagtggctttgctggcagtaggtgttgagctggggcagagaggaaggattctagagaagccatatggggatcgtggctgacagagcgatgcttaagcatatgtgtgctcccttttttggaactcccagaaatacttgtggcagaggaggaagagggcagaggtcctgtaggcgcaagaagagaaacagcaggaactttgagttatggatgttaatggagctttatttatagccacagactgggagggtctgataacatttgtgtgatgttgctcctctcgctggctactcccccactgccttttcgcataggtggctgattaagcaaacaacgatgtccaaatgctttcatcccctttccctgttttcattcagtctccatctttttcttattgagttgaaggagcactttctgtactggggagagtattcccttctctatcacgtattgctacaaatacccatttcccctagtttcttatttcctttaacttttgttatgcggtgtttgccatgcagaagttttcttttttatagtaaagtataaaactaaaaagtaaaaaaagtatttttttttaatttatttatttttgagacagggtctcgctctgtcacccaggctggagtgcagtggcaccatctcggctcactgcaaggtccgcctcccgggttcacaccattctcctgcctcagcctccctagtagctgggactacgggcactcgccaccacccccagctaattttttgtatttttagtagagacagggtttcaccatgttagccaggatgttctcaatctcctaacctcctgatctgcccgcctcggcctcccaaagtgctgggattacaggcatgagccaccgcgcccggctgtaaaaaagtatttttacgatcaaacaatgccttttgatagtaaagtatatcaacatttccttttaccatctctgacttagataacacatttaaagagctcttccccatctcaagaaatactcacttaaattttctttctataaataaatgtttatatacatatataatccatatttctcccattaattagcaatgcctcctttcatcatatactaaatttctatacatacatggttatatatttctggattttatctctgttccatcgatttgcttctctattcttgttcctataccactctgcccccccaaattactgtaacatatattatctttaaataataagaggagtctctctcctgtgatacttatctcattcagaattctttcctgggtttcttaccagattaactatctagttaaaataatttgatcatattttaaaagatcataggctgggcaaggtggctcatgcccgtaatctcagcactttgggaggctgaggcaggcagatcacgaggtcaagagatcaagatcatcctggccagcgggattcccagagtcttcagatttgccctgaattgagggtgaaggcagggataatgggtgaagctgtgggtgtgggtgaaattcagaaggagattgaatactaaacaagaggaactgaaggtggaagaccgttggcatgtgtggggaaagtgaatgctgcgaatgtggataagagaaagcacacagaggggagaggtgagacaccagcagacgggtgtcaaataagccggaggaggaggaaagctcaagaccagcatagtcgacagagtgccatgttgcagggcggagggcggttgcagagaatgactgcaatggagctgtgggctgtgttggtcgtggctgattagcgatgaggtggttataacatttagtgtttaaactgggactgttggagaagactctgagacaacaggggtaaagcaggattcttcctggaaaactgagacacatggtaaccccagttagtggtgacctctgagaaagtggtctcgttggagggatggccaaggtgcctaggttacatgggttgatggtacactgtgctttgtagaagtttggcccaaaagataaggaaagagttggtggtagatggaggggaatcaaggttgaaaggggtgggtgtatttacttgtctgttttctaggcttgagagatttgtccatctagggaagggtaaggacttagtaaaaagggagagatagaagatacaagatatagaagggataattaacaaagagagaagatacaggagggcaagggcaagatcagcagtgtataaaggacatggggttaacctggaagaggaggacagttcctgataagaaggaaataaaagaatgcatggcaaatggaggaaagttgaggtgcagaaaagggaatttgagagaactaataatttctcaggaatggctgctgagaaggaggtgggcaatctctttggagtaaagagcccccaaaggaaaggagtagaagcctttaacccctttctttcagtaattaacacggctagattccctctaatggattgagatggttctgaatgagacccattagtggtagggacctggccagggtctaagctcagtgccaggcccaggctctaagctggtagggttctggctggtgtgtctgggctggaagcctctcccatcctaggcactttggcacattgggggtcttcctccattgaagaaggaccacaatccctgtagaaatctggaccagtgagaacatcactgtctcggtgggcaaggatgctcggactgtgcagggccaggttctactgtgacaccttggggtggcagcagaagccacagtgagtcggaggctccagcgctctcctcacctggctttggatggaggaaccagcccttcggattcaggaagtcctccaattcagggtggaggaagcccccaagagacagacactggatttcttgttacttcagacaggctcaaatggttaatatgaaatattagtctaatttataacccaatttcagtataatagaatggtatgcagccattcaaatatgttggaaaataacgtttgattacatgaaaaaaatattcaggaatattcatagaacaactagtatgaacacaataatctgatttttgaaaagaatatgtaatatatctatatagagacagatataagactgtaagaatatatgcaagttagcagtggttgtttctgggtgatggaattatgagaattatgagtgatttttcttttgacttacctttattttctacaaggtgcttatatggctttttagtaagttaaataacaaagtcattttttcaaaggattgccaagcagtaacaggaccccagctgagccgggagggggaatctgttgagaagccagtgcctgagcccgggttactctccccagctgcactcagcaggtacagctcatgactgtgtaaactgaagggaaaaacaacgtggccaaatttagcaatgcacctagcccatgggacacttccagggggagctgccctgcattccccacctggggctctgtagaccacctttgagctggcgacttcaatccagatggcatcggttacactttcgcccttctcttgactctgcacacaactatcctcagcccatctgtacccaaggccaaatgggagagatgaaggtgtaaaccaaaagtgactgagacaggtttccatcgagtaaaggtttatttagccaaggttaaggacaggccatgcgggctgtaggtagagggtgggagggaaggtagggaaattcaagccacaggagcatctgtgacccatgctttttccaaagggagtttttgggaactttcatatttaaagggggaagagcaaacaggagggaaaaaagagggagtgagggtaggccgtgaggcagatgattacggtcttgtgaggctctgattcaccccagtaaatctacattttacatgtgaaagagagcagaagaaaaagtcaatgatgctttatcctgcgctgagtaaatctgcatttgacataagagaaagtaaacatgtgaaaggagggagcagaggaaatgaggctctgacagggttgtgaaatcactgctgcctgtttgggaacaaaaggaaagcagttcttgtgtgactcagttccccagcttaacttcccctttggcatacagagtttggggtcttgagatctattttctttcacaagggtttaggaaggctgaaataagcaaggggttctcagaaggaatggactacggtggctacagctgtgattccggttatgtgcctgtcaaggtcaccgcgctgcacaaaactgtggtttttccaccctctggtgggaagaggggcaaggacactgccagccagtagggaaaggcgcaaatcagaccagaacccagcatctagagggaaggccttacagctctagccagagtccttgatgagtcctagacagcatccacccagggggcacggtcagctcgctcatcctggccggggctagtggcccatcctgagtgtcactgagaggggcccatgatacctcccacctatatttggtggatgtgtgcaagggggtcgctgaggggtgtggacaggtctccactggagggtgcggaaggggctgagcactagccctttcggctctttccagatccctgaatcagatatcaccacctgccccatgggaagcctgttagccagccggatctctctgcttagcacacagggctgtctctctcccaggagcaaggcctttgccaaacagcaggaggggtgagatggggcaggtgaagagggaggggcctcccctggcccacccccatgcctacgtgaagattctctaagtgaagcgccatccctggtacctaccactctcttgaagattcccacaatgatggtgaaggaaacgcagtttatctctgactcataacaggcattccataaatatttgttgaatgaacaagtaagtgagtgaagtaattaattgattttgtgggcacatggctagataaggagacagactctttttagacgagggacatatagataaaaatacccatggtgcctggccatgagtaaaagaaaggctaagttgccaaggtttgttgactatgagtcaaaatttttatgtattaatcatgatactttaaaaagtcttacattgaggccgggtgtggtggctcacgcctgcaatcccagcattttgggaggcagaggtgggctgatcacctgaggtcaggagttcaagaccagcctggccaacatggtgaaaccctgtctctactaaaaatacaaaaattagttgggtgtggtggcatacacctgtaatcccagctacttgggaggctgaggcaggggaattgcttgaacctgggaggcagacattgcagcgagccaggattgtgccactgcactctagcctgggagacagagcaagactctgtctcaaaaaaataaaataaaaaataaataaaattttaaaaataaaattaaaataaaaaggcttatattgggactagaaccacagagtatcaagtccaaccaagtccaagtttcagataagaaaacaggcctggaaggagaagggagtgtccaaagccacagctggtagaatttaagcaaactgcaggcctcttgcttcccggtcctgcaggggtcttgtgcctcatgctacttctgcaatgcagctgggggccttttccccaggtgcagggtgtatgtgatcagttttccttataaataaatattggttgggcatctactggatgcaatgtacctattatatgccaagcaagttgctagatactggtggtagaatggtggaccagatattaacttgacaggaaaggagatgggcgattaatctggcaatttcaataaggaaagtacacccagctttgggagcccaaaaaaggaatgcctagcccagacctagggtgaagggtcaggtgggagaagcttgaggtggagagcagacattccacacaggagcctttccaggggcattccctcaccctgctcccccaacccccgcattcctggctgatctgtctcctacttgcctgggagtgcctggctccagagtcccaggcactgcagataagagtcacacctcagaggccaaggggacaaatatgcaggacaggctgctcagatagagggagcctcaggaaggggtcaggctccagagggaggccctgggaaggaaaagctcttcggggggatgtggtgggatggtatgaactcaaaggcagaggcctgacctgcaggcccctctcagcaggcccttcccagccctgttgagttttgctcttcaaccatgaatctcagtcttatttggaggccaaagcttctctaggagaaggagacccctcatctttctggtctcctttccacctccctcctcccatctgccgatgggacaacttcatagacaactcacccctcttgcctcatcagcccatcctgagtcatttctttcatccctcttcattggatggctcctgaaactcaatctcttccagagaagtgtggaggcagagtcagaagtggagagagagagaaacaaccatgatcctcctcctctccatcatcctagtcctagtagttgggctaacatagacaggagcctatgtatcggtcagaaaccctgcaggaaatggaagcaggagagctgtgagttagcatgttgctgaggggcaaagtcctaagagaaagagggcaaagaaactccatctccttccccactggatgtgctggttaaaatcatcagctaaggtaggtctggcttctctgagatttcattgctactcctgattggcctgaggcagcccctgggcacttttcatgcttcttgatgaggagttcttaactgggctactggggttccatgcatggctccaggaggtctctggagcccccaaacttgtatgcaatacactgcatatttgcacgtgtccttgtttctagaaggctcacaggttccatcggattcccaaaggtgtccatgacacataaacggtacagaacccctcatccaggtctttggaggaagacacacctcctgctcacctgccctctcccgaaaggctcccctcccctcctctgggtttcttccactcttgtgcttctgtagacagcctgttcccagagccaactggggccatgtgcttctctgctcacctggacacagcaccacgcctctatcgactgccctatttaggagctgctgagctgacagcagaaaccaggactgcatttgccccctccagaggcatctaggctttgaggaagggtgtgggcgaagagcctctgaatctctggacttaaggagcaggagttctggagtcaaaaagacttgcacttcaccctggatctgtgccaccttgacaatttaatgaacctccctgagattctgtttcctcatctataaaatggggtgaatgcctccccacaggggtgttttgaggattgaggtaatggctataaaatgccaggcactcaataaatattagctgttatctggcataattggacccagaaattttctctccagtgtccctggctggaggttgtccagctctttctgggagctgccacctcccaaggcaacccagccccatttggacagctcccactgtgagaaacttcttacgtcagttgggaactctgagttgaagtgacagaaattcaactcactggctcaccaaaatagggaatgtattgggccaagaaattgggaagggtagcagcagaagtgacctcaaggactctggagacctaaacaatgttgtcaggacttttcttctctctccctgaaactcttggctctgtttctccgtgtgattggcacaaagtcaccaacaattcccagcatatctcatcccagcttggagaaccagaagatagagaatctttctcccagtgatcacacatacattctcagggaggattgagagaggccaggcgtggatcacatgcccatctctgagccaattaccatggacagggccatgggcgcttatgactggccaggtgttgtcccacgacctgaggctaggagatcgtatacactgagtggtagccacgttgaaaccatatggagtgtgggagggtaggttccccaaagaaaggaatgctgtttctagaagcctgggcaaacaaaacaagtggttgttcactgctctttttcaaattcagtccagcaccagtcctggctctgtccttctggcctacacaggacaaaatatgaagagtcattgtaacctcctcagtcttcatttctccaagctaagttcttccctctctctgaatacaatgggtttccagtgccccctccccagactcctgggcagaaggcagcagtctggttggaagttggaatggggactggatttgagaattatcaactgaaatgctgatgaaaatgatggggggctctagtatgccttggaggcagccactgatctggtgtttcctttagccaccaggggagttgacttgggaggaaggagaagtggtggtgagtgggaggaagagaaggggaaagaggaggaaggagagaagagagaagagtgggaggagcagggaggcagacgaagagggagaaataggagttaatgagaggaatgggaagaaagcttcagctctcaggctgggaagcacaatcaatacatcaaaaggtgcccagtgtgggccgggcacagtggctcaagcctgtaatcccagtactttgggaggccaaggtgggcagatcacttgaagtcaggagtttgagaccagcctggccaatatggtgaaaccctgtctctactaaaaatataaaaattagccgcgcatggtggcatacgcctgtaatcccagctactcaggagcctgaggcaggagaattgcttgaacctgggaggtggaaattgcagtgagccaagattgcaccactgcactccagcctgggcaacaagagcaagactccgagaaagaaagaaaagaaagaaagaaaggaaggaaggaaggaaggaaggaaggaaggaaggaaggaaggaaggaaggaaggaagagaaagaaagaaagaaagaaagagaaagaaagaaagaaaaaggaaggaaggaaggagagaaagaagagagagagagaagggagggagggaaggaaggaaggaaagaaggaaggaaggaaggagggaaggaagatgcagactatgtgcagaaggagctcgcggctgggaaccatgccccaggtgatcagggcaggtgtgttagtttgtttccactgctacaacaaactactacagactaggcagcttataaacaacagaagttcatacctcacagttctgggggctggaaagtgcaagatcagggtgccaccatggtcaagttctggcgagagctcttttccagtttgcagactgccaacgtctagctgtgtcctcacctggcaggagaggcaggcaagctccctagggcctcttctataaggacaccagtcccaatcactaagcctctgccctcatgacctaatcacctcccaaagcctcaccctaatactatcgcaatggggattcagtttcatcttatgaattttgaaggacaaacagtcagactatagcagcaggcttcctggaagagggagcttgaaggaagaagaggagtgcaaagctagagcctggctctgggaacccacagcaggaagcataggagcatctctgatggcccagctggagagtcgggggcaggctggcaagagaaggggcttctgcctccctccctccattcttcctttcccaattgggctgctctgcagaggtcacccctaggctaatgaggaatcttcctgaagtttaaaaccaattaagcaacaaatggtttctgattagttatttctcttgatgtgaattttaatgaacagcttcctctccccgccctaccttccaagcaccctgggagctagccagctttgggtctgccttgaagagccctcaggggtgtctcagaaggctgggagaggaaggggagagggactgggatgggggggatggtgagcaggtttgcacagcacagcaaaccctaccagtcagcctgcatttcccttgacattgcagggtgccgcttgtccctgaggcaggggctgtctcgaggggaatgaggagcagggagaggacagaaagcaagtggaacagagagatggtgacagcgactaggtgacagcctagtcaaacaggctgaagtagaaagtataaaaagttcacccaggacaaaagctagaagagctggaggaagcccaagctgcagggaggcacagaggtgggaccagggctacaggggaaggcagagtggtgcagtaagcagaaccaagttctatggggatgtgctgtggggctctcagtggatgggccccccactctggtgctcatccttccacgaatgctgagatggtggttatcattggccttcctctagggacacttatgacccttccatgagatgacgcaagggaaaggacactgggagtagggtaatgagtgtgggggagatggcagggcactgtcttctccacccctcaacaggagactccccgcacaacagctgttggaccttattcagttacacccctgtctcattccacgggcagcaaacgggggccagagtcctcagctgtgtctccattgcggacaggagggccagctgcacagtcacagggtccagctctctctaccctaaaatgagcatcctctaggatccttgcccaggactgagacacccctcgggagtagctgagacccagaagtgctgctcggaagctttgtggaatcttgctgatcagccctgcactcctgaccactccttccagctgagcagaaaagctttcttgaaaggagaatgaagtccagatctctgctggaagaaggaaagagggtgggggaagcaccttgtaggaactgctgacaaagaaataaggatggatttttctgcaggttcctcttcactgttcccctcctctccccctcctccccagtccctctacctcccaccttttcttccctccctaatccatgttggctctgagggacatctggcagaaggtttctggaatgatctgactaggctctggacttccaggaaaagcccagtggttcttatagtgattccctcagggtcagaggaaaggcaacatttctggcccaggcatctgagtgatgacaaattgagagcagccacctctaaacccaacctctttggcttctgttttgggtaccaggagccagcctggcccaaaagattggctcctgaccagggctctgcagcccagaactggggccagctgctccaggcctgagcctcccccacacttggcctcatgtcaccatcaggcacctgggcccctctggttggcttgactgccccagctttctggaacatgctggctgtgtcttcctcatggagcagtgacagatgacagattggactgattaggtctcttggtggcaagggacagaacccaattatgggtacaaaaaagaactttattggtagataatagtagtaccaggttgtcctttttgaggagccggccagagtcaggtatggggtactggcaaacacatcccaactagaagaagggttgaacagtcaatctagggaagagcagggctgctgctggatcccaggaacatctgaactcaagacttttttttttttcttttgagacggagtctcgctctattgcccaggctggagtgcagtggcatgatttcggctcactgcaaactccgcctctcggattccagtgattctcctgcctcagtctccctagtagcttggattacagacatgtgccaccacacctagctaatttttgtattttcagtagagacggggtttcaccatattggccaggctgttctcaaactcctgacctcaagtgatctacccgcctaggcctccaaaaatgctgggattataggcatgagccaccacgcccagctgagctccagtcttgaatgttgccaggaacctgtcttcttccttccgcctatatcccttgtctctgctcctctctgactgtagatcagcttcagatgcctcctgagcctcatccctcacagcttcagttcctaatgagaaatggactcatctcagtagcagctcaaaaaaatcccagggaggaagtcaatgggttcagcttgggtagaggccctgcccctggatcagtccatgattaactgaggatagagtaaaatggctctttccacgggaaccctgtaggtggaaaggaggaagaagcagcttactagaagaaaggggcctctccccagaatttgagaggagggctggagagacaaatcagtaagcctctatttcatctgctgtctcaccaagaggactgtgggactttttttgcaagtcccgctagagaagctttgtgagtgtgactctcatcatctctggctctcaagggggcacactgctagatgtatttctttccctcatccccagctccccgccggccaatcctgacccagagactgttctcatttgtcaccccagactctggccctggtgacccacacctgccatcttgtcctgcattctctctctctttttttttttttttttttttttttttgagatggaattttgctcttgtcgcccaggctggagcgcaatggtgcaatctcagctcactgcaacctccgcctcctgggttcaagtgattctcctgcctcagcctccggagtagctgggattacaggtacgcaccaccatgtccagctaatttctgtatttttgatagagacagggtttcaccatgttggccaggctggtcttgaattccagacttcaggtgatccgcctgcctcggcctcccaaagtgctggtattacaggcgtgagccaccatgcctggcctcgtcctgcattctcttgtcttggtcagctttacttagtggttgaaatagagcccaaagataagatcccaggatttggagtcaggtgtccctgggcttaaaagtgccaccatttatgacctgtctgagatcctgtttcttcacttgtaaaacggaaaagagtacctaaccgacagggttgtaatgagggttaaaagagacgggtggccggacgcagtggctcatgcctgtaatcccagcagtttgggaggccaaggtgggccgatcacttgaggctggaagtttgagaccagcctggccaacaaagtgaaaccccgtctctactaaaaatacaaaaactagcctggcgtggtggggcgtgcctgtaatcccatctactcgggaggcagaggcacgagaatcacttgaacctgggaggtggaggttgcaatgagctgcgatcgtacccattgcactccagcctgggcaacaaagcaagactccatctcaaaaaaaagagagagagagatggggaatataagctcttggcacatagtaggcactcaataaatggcagcctgaaaaattcctcatcaaaacatatagagtctccacggctcctttgtcaaacagcaagatccctgtatttgagcaggagctatttgtagcaggtgggggaagggcggtgaggatcgtcttcctgctgcaggctgaaggagaaaacctcagtctcccctccccagctaagctcacatatataccttttggccaactctggggagctgtctgttttctgggaaaatgtctccgtggcttcagggaaaaggtcagctacactggagtgcatcacaagagcagagtggagagggagatgaagaccctgcaagggaccctggacatatctatcctggggaaactccagcttctaaatgtttcaggccgtagggaaaacccagacactgggtccctcagggccacggtctgcatctgtgcccaaatcagccttgtgtatctgcacaggctgtccttcctgaggagctggctgtgactggtacaggatattggcaaacacatgtcagctttactcccccttgtttgggtcggcaaccctgagctgcaggctggtgggcctagcagtgatagggaggggcaggggaaaaatagggaacaaggacaacccaagatacaggtacatgcatgcaagcaccctcagacacacaccagccggccctgtgtgtagagggaaacagatggccaggatcagaagccctacctgaggcctcccagatgtttaataatagtaatcgagcctgcatttacaaagcacttaccatgggccaggcactgggataacctcttccagttcattatttcgttaaatcctttccagaatccctggaagtgggcagtagtacccctgttttacacatgagggactggaagcccaaagagttaagtaacttgctaaagaccacatcatctgatttcaaagccctgtcatcctgctgcccacatgggtactacaacagacccagttttcctacgaagacattcacagaggacagaagattctccaggcaaatgcactggttcttgcaggcaggcctggagtggcccagtgttagaatctcctggggaagttgctgaaagtgcaacttcctgggttccactcccccttcaggcaccctttcttctccatactgattcaatggggttgagggcctaggaatatgcattttaacaagctgcctatctcccatgaaaatagcttcccgccccattattaaaaatatatactgtctgtaatcccagcactttgggagaccgaggcggggtggatcatgaggtcaggagatcgagaccatcctggctaacaaggtgaaaccccgtctctactaaaaatacaaaaaattagccgggcgtggtggcgggcttatatactgtctgggcatggtggctcacgcctgtaatcccagcactttgagaggccaaggtgggtggatcacctgaggccaggagttcaagaccagcctggccaacatggcgaaaccccgtctctactaaaaatacaaaaattagccaggcatggtggctcatgcctgtagtcccagttactcagtagactgaggcaggagaattgctcaaacccgggaggtggaggttgcagtgagctgagatcgcgccattgcactccagcctggacaacagagcaagactccgtgaaaaaaccaaaccaaaccaaaccaaaccaaaacaaaaaacatatatatactgtttatcgtaagatctttgactcccaattgctacacatggggctcaggtgcaaatctacatttttcatatatttgtgggaaagaactaggttcactaacgttggaaatgtctgctcaggattttgaacacatggcctggcccggaatgcagttgctgggcttccccaggtcagtgtcagtcccagggatctgcacagaggaagctgggaactccacagtctggagtgtgggaggagggtgcatcccctccagctttctcctggctccctaggctcctgcaacccctatcgactcagcctcacaagcaggggtggaggaggcagcaagcactgcttggagtaggcaactctaccaggccttctccgtccacaggagaatgcatcaataacttctgcaaaagcctctttcctctgcccaggaccctctctcttggaagcctgggaccatccttggttccctacttcctaagctcctcccacaccattctgccagacttgtaaagctcctcttccaagaatgtcctcccctgggtaattggacccacaggccattgacatttaaagaaatgttcctgaccttttcagcagttccataaaatcgcaaaataggtctctaaatattactgcagactcctacttgcccagaccctggcagagactcattttcccggctaactcaggaataagagaaaaatagcaatattgctagcaaaaagagggctattctcaaacatcttttggtaatcattccgttatagatggctgttatctgcatcaggactccaccatcaccacccaccaccaccattacacatttcgccatcatcaccttaattacttgattatataaaatgtgcaggatttgtgctcttaaatcttcacagtgcaaaaagtctacttgcgttttagctatttgatccagctatgtgagaacgtttatcttcttctccccttcctccattggtgtgggaccagatggaacaatggatatagaaggaccaaaggctatggagagagacataagagaagacagaactctgggaggaggggcagtgaatgtgtaaagagacattctgagaaatttgaaaatagattagatattagatcaggactatcccttgcattaacagagcttgggttaagagtagaaatttacattttcctcccacatgtttcccaaaacagccttatcacttaaaacaggagttgggcaaactccactctgcaggccaaatgcagcctttggctttttgtacgactcttgagctaaaaatgttttcactttttttttttttttttgagatggagtcttgctctgttgcccaggctggagtggagtggtgcaatctcggctcactgcaacctccaccttccaggttcaagcaattctccctgcctcagcctcctaagtagctgggattacaggcacacgctaccatactcagctaatttttgtatttttagtagagacgggtttttgccatgttggccaggctggtctcaaactcctgacctcgggtgattcacctgccttggcctcccaaagtgctaggattacaggcgtgagccactgcacccggcccacttttttaaaatatacaattcagtggttttcagaatattcacagaattgtgcaaccatcaccacaatctaatcctggaacacttttcatcaccccaaaatgaaacatgacccattagcaatcacttcccattctcctagcccccagtccctcaaaaccacaaatctactttctgtctctatgaatttgctttttctcgacatttcatataaataaaatcatataatatatgacctgttatatccaaatttttttacttagcataatgttttcaaggttattcatgttgtagcatatactatatataagtaatatttcattgtatggctatatgtgtagtactttctgataacactctggcaccaaatgtgttttttttcactgacaccaaatacctgctgtttttccacaccaacaaccaattctccagcatgactctgtgtcctacaattcaattcagttctaacactaactatccagagttagcacagaccccacaggttaagggctcagtcccacaagagtgctcccacttcaggtgtcagccataaatggggttccaaggctactaacacttctgtccgtctgactccaaattcgtgaccccacccccaccccgaccctcaggttcagtaattctctagaataactcacagaactcaggaaagtgctttacttacaattattggtgtattataaaggatacaaatgaatagccaaatggaagagatgcgtagggcaagggatgtggggtggggcacagagcttccatgccctccttggacacaccaccctccagaagctcgttgttcaagagtttttataactcaatctccagctcccctgctcttcctggagatagggaagggggttaggggagggcattgaaagttcccatcctctaatcacatgttgggtctttctgatgaccagcatcctgaagctatcaaggggctccaccatgagtcaccccattaacaaaactaaaatgtatgccagcgctgggcgcggtggctcacacctataatcccagcactttgggaggccaaggtgggtggattacctgaggttaggaattcgagactagcctggccaacgtggtgaagccccgtctctaataaaaatacaaaaattagcctggcgtggtggcacatgcctgtaatcccagctacccgggaggctgaggcaggagaatcgctcgaacctggaaggtggaggttgcagtgagctgagatcagctgttgcactccagcctgggtgacagagcgagactctgtctcaaaaataaataaataaataaaaatgtatgccaggccccgtggtgtgcacctgtagtcccagctacttgggaggcctcatgaggcaggaagattgcttgagtccagtttgaaaccagccccagccaaaatagcaaaacaccatctcaatgcccccacccaaaacaaaacacaaaaaaacctcaggtgtagtcaaaggggcttgaaatgaataactagatgctcctatcactcaggaaactcccagagtttcaggagctctgggccaggaactgcagacaaagatcaaatacattttttattataccacaatgtaccacattttgtttatccactcatcagttggtggacatttaggttgtttctactttagggctattacgaataatgctgctatgaatatacatgtacaggtttttgtgtgaacacatgttcttaattctcttgggtgtatacctaggcgtggaattgctgggtcgtgggtttcaccatgtgatgaaccgccaagcttttttttcaaagaggctgtaccttctatattcccaccagcaatgtgtgatgctttcaatttctccacatccttgctaacacttgttattgtctgtctttcttactttaaccatcctagtggctatgaagtggtatctcattgtggttggtattaacatttttaaaggattgtaaaaacaaacaaacacacaaaaaaatatagcacagagactgtatgccatacatggtctgcaaaacctcaaatatttactacgtggacccttacagaaaatgtttgaaatattcttaattacccattgaattaaaaggcaaaatacaaataataaggaatgattatcaaaagtttaaatccaaattatttgactaaagctgaaatttttacttttaaaaaatttaattacatcttaagtatttttattaaaaataatcacaatgttagcatttattgtctatcttttttttttttgaaacagtgtctcactctgtcacccaagttggagcgtagtggcatgatctcggctcactgcaaccttcgcctcctgggttcaagcgattcccctgcctcagcctcccaagtagctgggattacaggcgtgtgccaccacacctgactaaattttgtatttttagtagagacagggttttaccatgttggccaggctggtcttgaacttctgacctcaggtgatccaccggccttggcctcccaaagtgctgggattacaggcatgagccacagcacccggcctcatttattgtctatctaattgctaatgtaaagaatcagcattatacttcagggacaggacatctagatctagcagatacaaatttaaaagtagtatgaattgtttacttttgcaaaatgttcctcagttaccatatacagctattgcaaattttttgctaattcactagtgtgcccagaactctgaactagaatatgaagagaagcaaggaaatggtctcttggcactactgaggcagacatttatcatgcaagaatgtactgcattcacatcacactctctaagaggaatgatttgacaagttaattaatttgtctttctctgcttaagtgcttctgctgctaaaatccacaggctcccagaagtggacccatctctaacctcaaaaactgcccagctctgatgcttactcagtatttggaggcaggcacctcttactcagaggctggtggggcattgggggaacaagagcatttcccagaggcctgaatggtgtgagtcacaagagtagatgttaggctatgggtcatttgtgctagggctgtatgcttaatccagggtgatagaggtacccacatattctttaatacttatgtatttatttatttatttgttggtgttagaaatatgtaagaaccttggccaggtgtgatggcgcacccctatagtcccagctactcagcaggctaaggtgggagaattgcttgagcttcaggagttcgagaccagcctgggtgacatagcaaaaccctgtctctaaaatatatttatattatttatttatatatataaatgtatataaatatatatattatatattatataaatatattttataatatataatataaatatattttatattatatatataatatatataaaatataaaatatacatatatatatatgaacctctaaagaatggggtctggcccaggtctaagagtaatactgtattactgtgttggtaagatgttgagggattactctttattttgttagatgtgataatagtgttatggtaattttattttatttcgagacagagttttgctcttgtttcccaggctagagtgcaatggcacgatctcggttcaccacaacctctgcctcccgggttcaagtgattctcctgcctcagcctcctgagtagctgggattacaggcatgcaccaccatgcccagctaattttgtatttttagtagagatggggtttctccacgttggtcaagctgatctcgcactcccgacctcaggtcatccgtccgccttgacctcccaaagtgttgggattacaggcgtgagccaccgcgcccggcccggtaattggaaaaagtcatctgttaacactgaagtatttatgaatgaaataaaatgacatctgggattggctttacaatactgcagacaaaaaaggaaaacatcaggaagatttatgaaataagattggcaagtattaatattaataactcgtgaaactgggagatgatctatcacccagttcattttaccattttcttgactttttgtatgtttaaaatttttcatactacaaagttaaaaataatgaaatgaaaaaagacagaggactgtgggggaaggggaggtacagtgagcgaatgagggagagaatcctgcttcctgggacggcggccacattcttctctctgacagtgaaggaagaaggaaggacgcccaggaagcaggctgcagcccacatgtaagaacctttactagcaaccagatccatgaaaatggagtgatagcatttgggctggaagtaaaggactaatgaaaccttctccagctgacagtatggctattttggtatggactgttccaaccctcccttctgtaaggaagcattcctggaataatgaaagagttcttgagacagacagctgacctccaaggtagctcttttccatatcatttttaaagttaggagatagttcaggcaccaaaaaaaggtatatgtgaccagcccagccaacatggtgaaaccacatctctactaaaaatacaattgttagctgggcgtggtggcgtatgcctgtaattccagctactcgggaggctgaggcaggagaatcactggaacccaggagatggagcttgcagtgagctgagatagcaccactgcactccagcttgggtgacagagtgagaccctatctcaaaaacaaaaaaagtttatgtatgtacctatcactcaccttgtcaaatcttagcattttgccacctttgcttccaacctttaaaaacaaattttttaattttaatttttgtgagtacatggtaggtgtatatatttatgggatgcatgaaatgttttgatataggcatgcaatgtgtattaattgcatcatgtagaatgggatatctattatatcaagcatttatcctttgtgtcacaatccaatcatactctttcagttatttttaagtgtacaattaaattgttattcactacagttactctattgtgctatcaaatactaggtcttgctcattttttctgctttttggtacccattaagcaaccccactttcccccaaccttccctatccttcccagcctctggccaccattcttctactctctatctccatcagttcaattgttttgatttttagatcccacaaataagtgaaaacatgtgatgtgtctttctgtgtctggcttatttcacttaacataatgacctccagttccatccatcttgttgtaaataacagaatctcattcttttttatggctgaatagtactccattgtgcgaagtaccacattttctttatccattcagcttctgacccttttatttataaattgaaataaaatattacagatagagttgaagcccttgtaaaccagtctgcaattctcttctctttgccctcagagataacaactagcttgaatttggtgttcatcattcctacccaaactacatgtataggtatctatcaataatatatagcattgtgttgcctatttttaaactttatataaattgtatcatacttaagtgccccataattttattttttcactcacattttttgaatatttatctgtgttgatcctaattatatcacaattgatttattcattcattctcttattgatggacattcaggttgattacaatatttttctattgtaaactatactgacatgaaaattttgtacatgttttctcatgtataagtatgacagttcctatttagctggtagtaattaattgttgatttctagtgtatataatcttatatttagtagctcctccccaaattggttgtatgagagtccatgtggcaccacagttattaatttttgccagtctgttgagtgtgaaatggtatatcatattctcttaattttgcatatctgactgcttatgcagctgtgcagtttttctcccttactggccacttagattttccttttctgtgaattccttgtttgaccatattttctcctttgcattgttagttttttcctcaatgcttcatagttctttatatattctacatactgaccctttgtaggtttaatgcagtgcatagatcatctcccaatcaataacttgatttctcaattgtgatttttttgtacaaacttttttttttttgagacaaagtctcactctgttgcccaggctggcgtgtagaggcgcgatctcagctcactgcaacctctgcctcctgggttcaagtgattctcctgcctcagcctcctgagtggctgggataacaggcacgcaccaccccatctggctaatttttgtatttttgaagagacaggctttcgccatgttggcagggctggtcttgaactcctgacctcaagtgatccgcccaccttggcctcccaaagtgctgggattacaggcgtgagccaccgtgcctgacctatacaaactttttatttttaatgtagttgaatttattttccattgttgttgatgtttttttttcttaatttaagacatcctttcctactccaaggtcatatgaatatgctcttatattttcctctaaaaggttttaagttttgctttttcataattaggtcttcaatctgtccagaatttattttgtgtgtggcatgagctacagatctaactttttatgtgtgaataaccaatgttttcaacatttcttacttctgactcaaaattctacctctatcatgtatcagacatccatatagacttagacatgtttgtggcctctctacccattaggtttttctatttgtcaatgtttattccaatatcacactcccttagctaccatagctttatatgagattttaatatctggctgggaagtctctcctcctatcatcttcaaaattgtgttggctgtttttaattcttcactgttccatatgaacgttaggatcaaatttttcatttccacaaaaaccctattgcccaaaactatactgatttcatatattaatttggagataactgccatagttacaattttgggtttcatcacatatgaaactaagagatatataaaatccacacttacttagatctgttttaaaatcttctaatagtgttgtataattttctccattaaattttctcctgggatatgttggttgggtttattcttagtgaacttaagctttgttttgttttgctattttgacagtattttaaattatattttacaagtatttcttgttgccatatatgaatgcaattaatgttttcaccttctcctactctttgttttaataattttactatagattattttggatttttctatgcattgttgtacaaataatgatggtttactttatttccaatacattttttgacatctttgtactaattgatttatgctttaatagagatatgtatgggttttgtttgtttgtttgtttgagatggaattttgctcttgttgcccaggctggagtgcaatggcacaatctcggctcactgcaacctctgcctcccaggttcaagccattctcttgcctcagcctcccgagtagctgggattacagacgccccctcaccacgcccagctgatttttgtatttttagtagaaacagggtttcaccgtgatggccaggctggtcttgatctcttgacctcagatgatccacctgcctcagcctcccaaagtgctgggattacagatgtgagccattgcacccagcctgtttttgtttgtttgtttgtttgtttaccagtatctttttttttcctagcatggctaggctctcccttagcttattgaaaagaagcgccattgtcttattctggcctttaaagggaataggaagatgctaatagtattttatttttatttttttttatgaatggatattgaatcaactgcattttctgcatctctgaaggtctcctttagtgtgttgatgtttctgagttttggcatcagcttgtagggcaggctggatttatctagagaggctgtcgcagagtggccaccgctactggtagaaccgggtgcatttgctctatgtcctgctgagtcagaatccctggtgatggcaatcaggccccagtaaggcagtgtccttaggctttgcagctgcttctccagtgagccattttccctctcactcagaaaaatgggagaatttctttgaggaacattcacacaagcagaagactctcatctgggagtcttcctgcaagtggaggatgctactatgtcatgggagcatctacctctgagacattagggaaacttgagttggaggaaagctagaatggcacaagagtggtgtcgaaagataggatgactgtgatgggtaaatcagtagcccaccaagaacagcagtgcatgagaggtagggaggactggcaatggacagcaaaagatgcaagaacagtattaaccacatagggctaaggaccaggccccagggatctaagtatgactcagtagtgggggaaaaggaacatagcactggcatggaaggtcagggctgctttagatgttaaagggccagggttctcagagctgatctattttggcctacaaagataatgtgaaattcctacaactgagggatcatggctgtcattcatacctctatatgggcacaaatttttatgtcctttcttcacctagaacccagcttaatacacaaaaagtattgtacctttccaatatttgttaaatgagtatttgttgactgtcgaacccacacacaaaacaattagcacagggcctgtcacacagtgatgtggaaaccataatgctggctctgagtgttggttggagagatgctgggtgaatagaggccttcatggacttacaacccaagtctcagacagacagtgtctccctgaccaagcctggaatgagagagcagaatgacagtacctctagcctccctcctcttcactggccccctctctaaagtgcagtggagccagacagaagaaaaatgacccaagcatgtcaactcacagaggctgctccccttggtatgtcttcctcagctcatcgttgtctgtctacttcactaagagaatgggacacatatgagcatgtggtctgctttactccttccccaggagctgtctgcatgcctgtcagaatttatatttgcaaaaccatcagtgatcagaaaatactatggttgattctctgtccttgctgcctccaacagaaccacaggaaaggtacaggttccatcttttcctccctccccttctattatccatctcctctcctctccatgtccctactgcaaaaattggcctctcaatctccattctaccttctcttagttagaggcattgaaaagctacacactaggtttctggattcaaagcagcttttaccaaataaacagtcaggtggcatttggaagtaagaagtgagaagaagaccatcttcctgctgttgctgataaacaaagtaaagagtacgaaggctgtggcagcatctggactcagagttccaatgtctagtgtcttgctttgtgggatgagggtcagctgtggtgttcacagaggtagtagcagtagtgggttcctaacagtttcagtggtataattatgtatttgatagcctggttgcagaaccttgacttccacatcacaaatttcttccaaaaattttttgtattacatccctttccgcataaaataattagagtgatttctgcttacttcagtaaactgattgatgcatctatcctctgctgggtcacctaaatagataacagtttgcccaggagggaattcagtttcggttcaggtcaacccagttagtactgacctccactatatgcctagttcattttctaggcttttgccttcaggaagttcctagtctgtctgggtaaatggactcacacaaaagggtctgtaatcatagatactatttattgaacaatcaccaagcaccaaggtactattgggactttacatttgctgtctttctcatcataaccctgtacgtatgtgtatcaagaatgcttttggtcataagcattagaaaatcctatcacatacttaaacaagtaaggggtttatttttctcacataaacagatgttcaggctaggaaattcagaactgtatggcttgccgaagccattatgaagaactgggcttcttttatctacctgccttaccatcgttagtgtgtttttacttctacaatagaatagaatagaacagactagaatagaatagatgctgtacctccagacatgtcatccaagttcaaggcagaaaggaagatgattgaggaaggcaaaaagcaaatagcaggctgggcatggtggctcatacctgtaatctcagcactttgggaggctgaggcaggtggattgcttgaggccaaaagttcaagaccagcctggccaacatggtgaaaccccatctctactaaaaatacaaaaattaaccttgcatggtggcacatgtctgtagttccagctacttgagagtgggaggctgagtgaggcacaaaaattgcttgaacccaggaggcagaggttgccatgagccaagatcgcaccactgcactccagcctgggtgacagagtgagaccctgcctcaaaaaaaaaaaaaaaaaaaaaaaaaagcaaatagcaacattcagtaacctcttccttgtcagacattgactttttattctggaatggaaggcctccctggggtcttctgtctgcatctgattagttagagctgtgtggtatcatggccacctttttctacaacagagagtggagatgtgagcatgtcacttgccagccttttttaaagtaagacagtagacaatatggttgaaatagaggctaaatcatctaatctacagaatctgccaaggcaagtgttatctcagttttacagatgaggaatctaaggttgagagaagtcacacgatgtgcctgaattagctaagggaatgtggaccacagataatacggtcgtctgtcctgtggagcatctatgcactgcactgaggtgaaggggtgcttttcctcagtgtccatcagagtctccttggcctcaatgcctgctacagatgtcccctgatcttggacgaggagtgtagacttggggaagtatagagtttttgacaccattaaacctagagattgagaaacctaccttaacatgttaggagcatttctagagctgaagcactaccatggggatgtacaggctactgtgagaagacaggactcaagggaagtttccacagcaagaaccaccaactcatgaaggccacttgccagcaatttgtgtggcaccagcagggaacatcagggctaacagggagctgtgttcactgttaggttgttatagaggtgagtagtaacatttgagatagcttaaaaaagaaatggtgaacaggcttaggaaggtaaaggtagaggtctctgtccccttgaattggtgtaggcttgaagagaaagtggaattgtggacagggagatctgggtgaatggtggcaccagagagaagcactgagaaggtcctgagggcagtggctgctgtggatggtctaatttcaagatctcaataaaggtaactataaaattggagagatttaaagaaggccaaaaaaaaaaaaaaaatgaggtaccatgttcatggatcagaagccaatattgtaaatatgtaaaatgtctctaaattgatcaatagactcaatacagtctcaattaaaatcacaagattcttctaggaaacaaatgagcagattctaaaatttatatggaaatgtaaaaggtaaagcttatccaaggtagaagaagaggtaagaggacttgttctagcagatatcaggatttactatgaagtagagtaactaagtcagtgtggtattggtacaaagataaaaaattaaaccattgaactgatggaatagaatagaggatctagaaataaattgcgcatagacagacagtcgatatatgacaaaaaaacaacgctgtacactgggaaaagattgtctttctaataagaggttatcaatgtggaaaaaaatgactcttattccataccatcaacaaaaatcaaatttcagatggatcggaaaattctcaatagattggagtcctaaaaattaaagacagaatagtaagaaatgtataagagaagataggggaatattttcatgaccttaggataggtaaagatttcataagatgcacaacagtaccaaccgtaaaaaagaagattgttctacattaagacctttgtttttagttaagagctttgttcaaaagataccagtaagagagtaaaaagataagccatggaatgaggcaagatgtgttccacacatataaccgacaagaaagagcacctagaaatcaataagaaaaagacaacataatttaaataatggttaagtaattgaacagacacatcacaaaaagggaagtccaaatggtgaatacatttaaggaaagtggttcaattttattaattaaggaaaagtacaagattctattacatacccatcagatgggtaaagttttccttaaacatctggcagcactaggcattggctagggtgtagtgcaaggggaactctcttatactgttgatgggagtgtcaattggcataaccatcttggaaaaatggcatttgttactaaagtttaagatatgcatactcataccataacccagaaattcctgtacaagaatgtacatgggcaagaatgttcatagcagtattgtccacaatagcctcaaactagaaacaatccacatgtccatcaaccatagtttatttattcatataatagattatatggcaacaaaaatgaacccagctacgtgcagcaacataaacaaatctcacaaacacaattttgagcaaagaagtcatatacaaaagaataaacactacatgattccatctatatgatatttaagaaatcagcagccaaactacctagcctagacttgcatacttaggtaggatgtgactactattattttcagcatagtgtattcctcttggggaggaagagggctgtgactaggaagaggcaactgggggtgcttcagtggtgctagaaataatctctttctggctgggcacggtggctcacacctgtaatcccagcactttgggaggccgggaggctgagaagccgaggtgggtggatcaagaggtcattagttcaagaccattctggctaacacagtgaaaccccatctctactaaaaatacaaaaaaaaaaaaaaaaattaaccaggcatggtgggacacacctgtagtcccagctactcgggaggctgaggcaggagaatagcttgaatccaggaggcagaagttgcagtgagccaagatcgtgccactacactccagcctgggcgacagagtgagagtcctccatctcaaaataataataataataataataataataataataatgtctttcttgaactgtgctgattacccaggtggtcagtaagaaggattaaactctacattcatctggaaccatcagttttatgtactttcctgggtataatattgcagaataaaaagatgaaatataatatatattagatctggaaataaattcaagagtccctctggtttaggtccactccaacaagcagatcagacgtcctttatccccattttcaggtgaggcaattgaatttgagagctttaaatgacttgtccgaagccattcaatggtaacgaatcgaaaccagaaatagaacccaggcctcctgcctcccaggttaagactctttccggtctactttgcatttctctcaacccaaacagcagtagttaagttcacaaagagttaagcaacatcattgagggaagaatttcccaggtggcctggatcatcctggatcctggcctccttttccccagggtcccagccctaccttgatgacccaggcagtgtgaggagctgggactggagggttaaccctgaagcctccaacagctgcctgggtgcatctgaggctttgcattgctcttatttccctgttctgctccacatttcctggctggcccttctggacctacaagccctggctgatgtgaccagctctttgagatttgtatgttttattgcctctcagtcaagaagagaactacctaaaagatatacagtttgagctctgtgagggcaagaaccatatgggcacaggcactatactccaagagaggtggagctgaataaaggtctggttccttatccaaggaagtcggtgaccaatccatggactttgtaagtcattgatggttggggaagggagagatcaatgtgggctaactggtccaagaggtcacatttgtagtgagtcttcagtgataaatggaaattgatacatgaaaaaagaatggaggatgttccagcatgggaaacttcaggccagttttgagaagggtgatcaagttgaccacagcaaatcattcatgtgggagtgtaaggtttgatcagtttgtttcactgccctttcagttacagcattctgcagggcttgtcatcaaacttgtgaagctattttgtggcccatggctcttcctcatcacagtggaggctcctgcagggcaggcctatgcctcccctatggggctcagccagagcgccatgctctgcagctttgccaaatccccttctgaccatcaggctatcagcagtgttcctcccgtgaccatctgggttccaggtgatgcttctcccagacgttctggtttgcattttttacaggttgaagtaagtgcattatttcattctggctgtcccacagccccaacccttatgcagttgtcccccctggtcccccatatttttagcaaccaatgtaattaatatgctgtgtaatgtgttttcctggaactatgattatgctcaaggtatctcaaacctttttacagtaattactgagaaaaagcttggagagtattaaccatgcatgtggagtgagctgtaatctgaccttggacacttagatattaaaaatctctctgactgtgtctgccttcatttgcatttccaaattttcaggttagagggcctttcagttgattgaataatgggttaatggaatcctctttctaattaaatccagattgtctctttgtgaaattgcacacttgacagtctatctggatcattctaattgcattctaaagttgccatgggggctgtcttgaagaagctactgtcctgtctgagggtagaaactgcacacaggagagtagcaggtccaggaacactcagaggctatccagttccacacagtgctgtaatataagatttgggagaacagggacccactttgccttgttgaccatcatgtatgctgtgcctagagcaattatggccactgttctcaatgctaggctcttgatactggataactattgcttgaacacatgaatgaatgaatgatttgcagctgtgttgtcatactgacaacccagtggggcgggctgaatggccacttggatgtagttttaatcccatgttttaaattatgggactaggatatattgaacccagagcatgagaagattctgaatacaggagaagctaggcttgagcaattcccatatctccccaatatatgcccccataatgagccttctgcagggactgggtggcccatttctttaacaaactctatgacttgctaatagccatctaatttcaaatttctatgacagttatgccatatgataaaaactttaatatgaaatgttcttctaataccaatcctagctaatctaaaacatactgcttcctctagccatggatttctatgcttaattctaatcttttttttttttttttttttttttttgagacagagtcttgctctgtcgcccagactagagtgcagtggcacaatctcagctcactgcaacctccatctcccaagttcaagcgattttcatgtctcagcctcctgagtagctgggattacaggcacgcaccaccaggcccagctaatttttgtgtttttagtacagacagggtttcaccgtgttgaacaggctggtctcgaactcctgacctcaagtgatctgcccaccttggcctcccaaagtgctgggattacaggtgtgagccaccacacctggccaattctaatcttttaaaaactcaatattaatccttgattgcagagaaagtagtggggaaagtattctgggtctgcctattacaaacagtaatataaccagcttttttttttttttttttttaaatgcgtggttggctgggtgtggtggctcacacctgtaatcccagcactttgagaggctgggcaggcagatcacttgagcccaggagttcaagaccagcctgggcaacatggtgaaaccccatctgtacaaaaaatattaaagaaaactagccaggcatggtgtctcacacctgtagttccagctactcaagaggctgaggtggaaggattgcttgagctcaggaggtagaggctgcagtaagccctgtttgcaccactgtactccagcctgagcaaaagattgagaccctgtcttaaataaacaaataaataaaaattaaaaaataaagtgcatggttaagcttataagaaagaaaagtgaatctttcattggccaccaggaaaattaaaacctaaaccactatgagataccatgttacacccattaggataggtgtaataatttaaaaaaaaaaccataaaataaccaaccttggtgagggtgtgaagaaattgaaacctttctacatgactggtaataatgtaaaattgttttttaaaaaaaaaactccaggccaggtatggtgcctcatgcctgtaatcctagcactttgggaggccgaggaggacaggtcacttgaggtcaggagttttgagactagcctggccaacatggtgaaaccctgtctcaactaaatatacaaaaattagccaagtgtggtggcaggcacctgtaatcccagttactccggaggctgaggcaggataatcacttgaatctggaatgcagaagttgcggtgagccgagatcttgccattgaacttcagcctgggcaacagagagagactctctcaaaaaaattttttttaactccaaaaagttttttttttcttttcctttttttttttttttgagacagggtctttgcactattgcccaggccggaacacagtggtatggtcatggatcactacagcctcaacctcaccaggttcaagtgatcctcccacatcagtctcccaagcaacggggtctacacgcgtgagccaccatcccttgctaagttttgtatttttggtagagatggggtttcaccatgttgcccaggctggttttgaactcttgggctcaagaaatccacccaccttggtctcccaaagtgctgggattatagacgtgagccaccatgcctggcccaaaaagttaaacatagtattatcatatgatccaacaattccacacaagagaattaaaaacttgtacataaacatttataacagcattatttatacagttggttctccatatccacaggtcccacatccttggattcagccaactgtggctgaataaaaaagtatttttggggctgggcatggtgactcacgcctgtaatcccagcactttgggaagccgaggtgggtggatcacaaggtcaggagatcgagaccatcctggccaacgtggtgaaaccccatctctactaaaaacacaaaaattagctgggcatggtggagcatgcctgtaatcccacctactcaggaggctgaggcaggagaatcccttgaaccagggagtcggagtttgcagtgagccgagatcgcaccactgcactccagcctggtgacagagtgagactccatctcaaaaaatatatatgtatgtatatttttaagaaatatatatttttaaaaacaataatacaacaataaaaataatacaaataaaaaacaacacagaactaccatttacatagcatttacattgcattaggtattataagtaatctacagatgatttaaagtatgcaggaggatgtacacaggttatatgcaaatagtgtgtcattttatgtcagagacttgagcatgtggattttggtacgggtgggtatcttggaaccaatcccccttggatatcgaaggacaagtgtaatagtgcatatcttggtataaacaacccaagtgtttatcaactgatgcatggataaataaaaggtaatatagccatacaatggaatattaatacacttatcccaggccacttttccctccacaaaagttgatggccagatatcctacatagagctctgccttccaggaggatcacagccatgggtggagtcataggggggcggcagaccatttttgacgcacagcaacaaatcaaggcattccattcatggaccagacccagttttttcctgctcacagtagctggttgtatggaactctccacgaggccttaggtttgagctgagacaaaggtattggtacaacagaggtgggcggcatggggatttgggatacctgacagtgtaaattatttgagctcttcagttttatttgggcctaatctcaaacataccgattccaccatatgatggattgctactgtgttctcaaatttgtgacttggtggatgtgacaggacccaacttataaggttagctccactcaaacagtcacctagcaccccatggtcatgcactcagtttcagccagggttctggtctaccagggactgatgtttaaataatggctatctctctgctgcaggtagcaaatcctttctccaggaccttagggatttgtgctatgactctcctaaaataatttttcagagatgccacatagcacccttatctatcacaggtacctatagccccattgtgctggattatatgacctccccaccctctgccccatggcagggctgcttttgctgaagcctggacctgctgaagagctcacttttaccctaggcccaattcaaaatcagctgccttccaatgcatctgataaatgggactgaataatattcccaaccatggtatgtgctatttccaaaattcaaagagagcttccaagtactctgccactttttcagtgctaggaggtacaaggtacaatcgtttgtcttttacttgaagatattccagcataccccagaccactgggcccctgaaaacctcactggtatggtattctccctaaatttttatgggatttatctgttaccctctggccctcaagtgtcttgccagggcttccagaatacttatcatttcctccttaccaagtctgactaatgtgatttaatcaatatggtaaaccagcatgaagttcttcagaatatcaagataatcaaggtccctttagactatattgtaacggggagcaggagagttaatcaagctctaggcaagacaagtgaatgtgtacagctctgtgtcttaggtaaatgcaaactactactaacctcctttcctaatggaggttaaaaataacacattcaccagcttaatagatgcagactcagtatcatacactgtgttgatctagtcagtaaagatagcaaatttcatatagtagctgggattgggactaccacttgcttaaatttatgggaatccaccatcatttgtcttggtcaatctgatttgtaggtccttaagaaagaatggtggtaatctctgctattccacccagtatgcagtacaactacttctaatttactatcttggttggtaggaggaatagtttaaggggcttctgtctggcctttcatactacaatgactcttaccccacaggccagggaaccaactactaagtgtatctatctcaataatgcaatcgggactgagaaaattgacttataccaggactccatgtaatacccagcctgcatatacccctactctaagtatggggaccatgatgacattttgggtctttgtggtatcaaatgtcagctcatttaaaggctctatatccaatagcctttaaaagatctggacagccctgtgcatcattaccgtgctaaacgactataggtccctttgggataagggttgagggaacacctacttgcatacacttgatgtaacattatagggtccttcttcaagggagtatagcccccttcaagcaagtgctctaaaaactggctcatgtctggaaaacagtgagagatcatgatgtttttccattgcaatcaactttctgctcaccctctcttgatctattttgatcttgtaagttaagccacatcctcattgacccaccatttatcttgtgcctagaaacatcattgtttattagccgttgctctgaagccatgtgggttaggactcttgattttcttctggccttgctgttcatcatggtaattacacccacattttctctggcagttaagtgctgccccatggctgtgctattcctgaatcctatcatctcattgatattagggactccagttccatagcacatcttttacctttaaccctggcccacacaggacagccaccacggaacccctcactagcttattccttattattttaatgaaggaagtgtcttcttggcctttccagggaatatagtcagctggagtgttctctaaaattgcataataaatgcgttctaacacactcatttttctgaggcttcttttttttttctttttttttgacaagagtgcagtggcacaataatagctcgctgcaacctcgaactcctgggctcaagcgaccctcttgcctcaacctctagagcagctgggactataggtgcatgccacctcacccagctattttttttaagaggcggggtcttgctatgttgcccaggctggtcttgaacccctggcctcaagtgatcttcccgcctcagcctcccaaagtgctgggattacaggcatgagccactgtgtttggcttttctgaggcttttgacctcctcctcagtactctgctaagccatctcccctttctttcctacagactatcactgattccaagcttcaaggagccattccatattaggatcagctccaggcatcctcattgggatgttaaatccaaagccacaagtgtgtctccatatcattaaatcttccatgtccagccttatctttcaacctcattagtccagcaatcttggaatccattcccacatatgttttcccacagctcttttggtgaataatcccttatctttaatggcaacaatcatacttttcaactgaaagcacgctgagacctgaccgtacttatcaatctagaagtggccaggtgtggtggctcacgcctgtaatcacagtactttgggaggctgaggcgggtgatcacttgaggtcaggagtttgagaccagcctggccaacacaatgaaaccctgtctctactaaaagtacaaaaattaaccgggtgtggtggcatgcccttgtaatcccagctactcgggaggctgaggcaggagaatcacttgaacccgggaggtggaggttacggttagccaagatcatgccactgcactcagcttaggcaacagagtgagactctgcctaaaaaaaaaagaaagaaagaaagaaagaaaaaatagagaagcaaggagggtggcaatgggaggttgccctcctaacaagtggtggtggaggtgagaagggcacacctactggctcagaagggtctagattcttaaaggcatctacccaaatatcccatgtatcagtgtcctgacctcaccttatcagtgctgtgattttggcataggagatttgttagggctattaattcatcttcctctgtaactccaccacccttgcaatcaaatcttgtccttatttttagtacaatcgtctttcagctgcaggagatgcaggtcactaacattgccaccaggccgtgtggtcttcacattgtatccagacttaacaggacgctgacatgaatttggtatttttttcccctgctgagctttcattttatttcaagacagggtctctctctgttgcccaggctggagtgcaagtgttgcaatctctgctcactgcaacctccgcctcctgggctcaggtgattcttccacctcagcctcccgagtagctgggactacaggtgcatgccaccatgactgggtaatttttttattttttgtagacacgggctgtcactacgttgcccaggctggtctcgaactcctgagctcaagtgacccacctgtctcagtctcccaaagtgcggggattacaggcatgagccaccgcactgggccccctcttggtttttatggcagttaacaacagccaaccaattctgccttctctgtaattaccattgcgcccttatctttcaagtgccagagctattgaataagcattgcattccattccacctgtattccgccccaatctataggcaagttttattcattgcaactagcatgagagctaatattaccaccccagtcgctttttttttttttttttttttttttttttttgagacggagtctcgctctgtcgcccaggctggagcgcggtggtgcgatctcggctcactgcaaactccgcctccctggtttgagcaattcttctgcctcagcctccggagtagctgggactacaggggcctgccaccatgccaggctaatttttttgtattttttagtagagatagggtttcaccgtgttagccaggatggccttgatttcctgacctcatgatccacccaccttggcctcccaaagtgctgggattacaggcgtaagccactgcgcccgggccaccccagtcacttcttactgatatctggttggcaaatgatacaatttcagaaccccatattgagggtctgcttcataggatcacttttggcaccacccttcttaggatgagaaaaggatttgaatgcaaggagcttatttggaaggtgttcccagaccgcactggtatgaagctagagaagagagaaaagtagaagaaggaagtcaagagaggctctactaatgagcagattttcaccatggacacctcctcctcccattcatcactgactaagaatcactccccaggatttgcactccccagtacttctggttcaacccatggcatggaccatgtaaaagcccacaggtagagaatcacaggtttacaatgggatactattagtgtgtatggtaatgatgaatgctggtggggtatgtgtgtgtccttaactgtatatactatcgtaggctagaaaaaaaattgtccaccttaaccacctcacacaaaaggagatatcaagaaagcttatcttttttttttttgcttgggcaaatgtgtgtgtgtgtgtgtgtgtgtttgtatgtgtatgtgtgtgtcccctttgagaatctgcaaccatagatctttacttgacataggcttgctatttgaatttatactccttgatggtccagaaacccaaggtaagaaattaatgtaaaatttatccctggctaagtgatacccatggaatgctcagcaaatgtgcatgaaaaaataaaaaaaattatatgactttaaacacccaataaaaggagaaatgatttttgataaagccaaatgatgttacataatgcagccattaaaatgatgcttagaaccgggagcttgggggagagagataaagagaagttgtttaatacttgcagagattccgttctgcaagatggaaaagttctggagatctgttccacaggaatgtgaatatacttaacactactgaagtggatactcaataatggctaagatggtgaatttagtgttatgtgtttttttaccgcacaggaaaaaagagaaacaaagagttcttaatggtgaggagaaatgcttatggtagaatgctagagagaagggggacacaaaattgtatagaccatcttatccatcttatctcatctgtgaacaattacatataatagtaattatatattttatatataatatattatatatatacatatatatgtatatataactacagtggagggaaaaggtttaagaaaatattttaaaatactaataaaactgcctggcagaattatgggtgattaatttcattttatcttcctttctaaaaaaatctatttcagtaatgtatcacttaggatgctttcagttgcaagaaatggaaaatccaatttgaaatgacttaaaaaatgaaggggatttattggcttatgtaactgaaaaggccagaggtggggtaagcttcagggctgatttggttcagatgttctagtgatgtcatcaggaacccatttccttccctctttctgccctgccatctctggctccagctttaccccaaggctgactcccttcatggtaccagaatagctgtagcagtcccaggctgtgcacccacacaccatgctgtcccagggaaaggacccctctcttggcggctttcaaaagaagaggaaatttctttctcataagccacagataactgatgcttaagtctctttggccatattgcatcacatttccacctccgatcatattatcctgatcgatcttagcttaagcagataggctacaaggtgcagaagatacctgaaaaaatgtctgggcattgttaggaaggggagagaagagaatgaatgctggctggacagctaacaaatacatgtatttaagcctattccaaaattttagaataaatttgtatttctctgggaagttcaaaaaccacaagtgtaaaaatgctcttttatagaatattatatatagtatactatagcatgtattacataagtttatataatataaacatacaatatgtaagttataagtttgttatataaatatatatttattataatatatgatatatattatatattttgtacataatatatatcataagtttctataatacatactatagtatactatacataatatatttatatatgtactataatagactattatattacaaatataatataaataccataataataatgttctttatgcagaaaaagtaacaaaccacctttaccagccttttacatagactctatagaacgaggctagcattctgaaatcagctttaacctgacattacaattaagggtgacattaaaaatatttaatgagcagtatggcacagttatcaatcaatctgagtgggcacccaaacaatgggggagaggatgtcactggccattccactgcgttggtgacctcagccacaatcacagtcattattacttagcagtcaccattagctcagagtatgacataaaactgtccagtttaccttcagccaccagtgctggacacccactagccaagggattctcactcacacccagtccaacactgccaggacagagggatccccatcaccagacacacagtctcaagggagactaggattatcattgtcaaacaccagtggaagcatgggctaaagagaataaaaataaaatccagcaaaagcctccctagtcttctgttgcatttaatgaagagatacgacattgaagtcaagacaaaccaatgtcaaaatgagctcaatcatttacagctgtgtctactccacctggccaagcttcaatgttcaatctacaaaaatgagtaatacaagaattacctccaaaattggttatgaacacgtagaggtagtgtaaataaagtcattaatgcgggtgcagcacatactagggagttaatcaatggtaagtatcttttattaccatctcaagaggctggttgaaaaacctcagagaactgagaggcttataaatgcccttgtagggagattagctctctgatttctgaagtaaggaaacagccactggcctctccgtaatttaaccctcattttgggcttgaaccatccattcatccacactgcccctgtctctataaatataatgggctgacagcctctagtgctggaaacagctcttcctgagctgggatttctgacagctcaacttccacaagctgttcatgagttatttcaagggacattttactgtcaatcacttacccccgaagtggactgcacagtcctgccatgtgaccaggattctgaaaggggcgagaacaacatttgcttcctggaaatcagcatactggttcacgacccataaaaggaagctgagaaaaggaatgtgatgctaaacaaggaaaggaagctattcttaccaacaactccatatatgtcaaccactgtgctatcttgctgaatccccacaagaaccccgggaggcaggtgttagatgcccaccttacaggtgaacaaactaaggcttaaagatgctaactaacttgcccaggctggtatggggaggagctgagtttcacatctagggctctttgaccgcaaatttctttcagaatttctcagaggtgatgctgctgacattttgggcagggaagtttttttttattatatgatgtttagcaactctggttcctgagcattaaaggtcaacagcatgcccaggtcattgtaacagctaaactgcctccacacagtttcaaaccttctatatctataataaatagatcttttagatctataataaatctatttgtaatagataaaaaaacatcttatttcagaacaggattctggcacagagtaagaagagaaaaggaggctgggcacggtggctcatgcttgtagtcccagcactttgggaggccaaggtgggtggatcccttgagcccaggagtttgagaccagcctgggcaatgtgacaaaaccctgcctctacaaaaatacaaaagttagccagccatagtggcacacacctgtggccccagctactcaggaggctgaggtgggaggattgcttgaactgggagggtcgagctgcagtgagctgtgattgcactactgcacttcagcctgggtgacagagtgagaccatgtctcagaaaaataaaaataatttaaaaataaaaataaattaaaaaaatttaaaaataagtaaaaaagaagagaaaagaagcttcacagatgtggccatgggtgatattggaaatgcatttgtgaatccaagtgtgtgtgttcctgtctagagttaataatgcatctctgtgcatagagtgtgcatgccacactatcactgcacacgtgcatgagatgtgctcttgtgtatgcacaggcatgcaaggccctaagtcatctgggaccctttcttctcaatcagctcccacattcaatcagtctcttcagtcctgttgattccccctcgtaaatatatctcacacccatttctgctctccatcactgctacattggtctatatcaaacttcttcatctctcatctggaccactgcactgaccctatatctgatcacaggtactaccaattcattctccacaccactgaccaccagcattatctgtctgtaaggcaaatcagaccacatctccctctagctcaaaattcctcagtcgttgccattgcctatagcaattttagaagcagaaccttgtatctaaatgaagtcttcaaacacaagtgcaatacgtaaagcagataaatgcagaaatgctcttttggattatgcagactcctcagcaaggcatacaaggtcttttatgatctgtcctccagccaactactacagcaacttctctggcttggtggtcatgtttgagggctctagaattccctacctgcattcaaattctttgccacttactaactgtgcaacttgggcacattgctttacttctctgtgcctgagtttcttgtagataaagtgggactaactgcacttaatggagttcttttgaagattagattcattcatatttgtgaaacacttagaacagttcctgtggttcccaaaggaatctgtggtgggattgaggcccactagagttgcctacaatgtgaccagttaaatacacatccttggattagctttcctctttctctctttcatttcaattttttttttttttttttcagatcgagtctggctctgtcgcccaggctggagtgcagtggtgcgatctcagctcactgcaatccctgcctcctgggttcaagcaattctcctgccttagcctcccaagtagctgggactacaggcttatgccacaatacccagctaatttttgtatatttagtaagacagggtttcactacgttgaccaggctggtctcgaactcctgacctcaagtgatccacccgcctcagcctcccaaagttgagggattacaggcataagccactgcgcccggccctctctttcactctttagtccccccacctctatttcctcagaccacttccccaaataaactatttgcacacaagatcctgtcttgacctctgcttttgtagggaatctaagccaagacaaaaaaaggttcccaaatttttcactattacaaaaaaatcctgctttatgtttttatgtttccttgtgaccatgtgtgagttattctctgaggtataaatctaaaagtagaactgctgagttacatgatgtgtgcattttcgattttattagaaattgccaagttactttcccatatggtggaactaatttacattgttgtccacactgctgaaaattcccattttcccacattctcttcaatattaatgttgtctggttttaatttttgccagtaacatacagcctcattattgtttttaatatgtatctccttgaccgctaacgaagttgagcatctcttcttaagttcattgctcattttgttttccttttatgtattttgcttattcacatcttttgcccattttctattgggtttctttgtctttttgttattgatttatggaacttcttcatacattctagatacaaatcctttatctgttaactaggttgtgaatattttctctgaatgtttcacttgtcttcaaattttgcctatgatacttagtttttacttttaatgtaatcaaatatatttttccctttattgtttgttattttttatgtcttgttttaaaaaatcttctttttatgttactttatgataatatttacttctttcctttcataattttacattttggtttagggctttaatacatctggaatttatttttatacatggtataaagaataactctttttgagctaacaggcattgagaagttttactttgcattaaaaaatgtttcttgcagagacatcttggcattttgcataatgtatatctgacagacctagaaatggcagaaaggtagaaaagaaggcgaaagcactgagaaactagggatggtaaagaaatttcaatttcacattttatccaatgtgagtactgtgaccttgtttgggcaatcacataaaaaccactttgaaaaggtttacattggttcttaattatctagaggtgtcatattattgaacattttttgattccctcacttccattagtcagctggaatatgctcagagaaattgcaaaagctatgaagtgggaaaataagtagcttcagtctgaaccaaacacaatgagaaaaggaggcctgcaggaagaaaattacatttcaaagcctaagctaaaaagtttggggattttctgctattttggaatagttactcactttatattcgttcactcagcaagcatgtattgagcatctactccattccaaggactatcctgggtgtagggagctgtagagataaataagtccctccccttgctctcaacaatttctcttttaggcaaaaagacaactatgtaagaaaataaattttcattataggtgataaatatatgaaatgcctaccatacaccatttaaacataataccgagcaggaggaattagttatctacactggggaggaggaggtggtcaaggagatgttcctggagctaacatgtgaggaactattcagcggtgaacaatggttgaccaggtagacaaggaggtaggtatgagatgacttcaaaggacattccaatcagagggagtagagaaagcagacatgtgagaggcaactgtgcctgtaggtggtgggaagggtctaaaaatgtcacacaaacaggatctattttcccaattttctatttctcctcttcagtttgagcttgtcttagttctgaagaaaaggcccatttcatcaaagtaaacaaatatgggctgaaattgaccttcttttgcatatatatctagatttcttttatttatctaacaatttttgttcagcacctactacaggtgctagcaatacttaaggaattcttgtgaaaagacatacagaaatacagacattagtaagacagatctgctaatggaaggttgtacccaggtcctggatgtgaaaacagggcacctaattctgcctgggagagtcaggaaagagagacagaggaagtggtccttgagttgaaatttgacaggtaaataaagtttgccaggcagagaagtaggaaggagacaattctaggtggaggctgcaggatgttacggtaccaacgtggtcactacacccctttcacctgcaactgtctcacccacaatgccctgctcaaggaagagaagcaaagccatcctttgaaggatggtggctgctgattggacctcctcacaggcagacagtgtcctatgacgtatccagatgcaagggctttacccaattaggaagcattggtaactggtcaatcaggctgcatcccctaagaatttagagaatacaaattggactgtctggtaacagcagaaggatgatgatgccagctctcagagaaaagaagaaacctggctagagcaccaattgtctgtgattatttcccccaaggatagaagattaattcatttatccataggctcccagcttccagtcatcaaggattgccctatgggatgttaactccttcacgtttccaggttgcatgtaggtcagaatggctgagtaggaccccactggagttgccagattgttatgttttctttcatgggctctgtctctttggcctttttttcccctccctccctccctccgtcctttcctcctttcctcctttcctctttcctttcttccttccttccttccttccttccttccttccttccttccttccttcctttctttcttctctctttctttcttttctttctctctctctccctgtctctctctctctctctttcttttttagatggagtttcgctcttgtcacccagtctggagtgcaatggcgcaatctcggctcactgcaacctccgcctcccaggttcacaagcgattctcctgcctcagcctcctgagtagctgggattacaggtgcccactaccatgcccagataattttcatatttttagtagagacagggtttcgccagttagccaggctggtctcgaactcctgacctcaggtgatcggcctgcctcggcctgccaaggtgctgggattacaggcgttaaccactgcacctggccgaccttttgttctactttctaggagagctcctcaactttatttttcaactcctgtgctttcttttatatttgtccagcatattttaaaatttttagagcactcttttttctctaattatttgtcttttctgtagcgacctgttcttgttttatagatataatagcttctcatgtctctctggggattttaattatcttcttcttctctctgtgtcatctctgttctctctggttatttatcctttcttctactctcttttatatgttggagatttttctcagaagtctgataatattaattgctggtttttatttaagagtgaggtaactaaaaagctgattggaactataatattctgattgggctttagaattggggaaatttgctttaggtaagttaggaaataagaagtttccttctattctgagtggcccccaaatgccagataaatggaagttattccatttctctatggaagaaccctctgcctggggggagatgtcctgtgggtaggtgttttacactcaagttttgagaatgtgttccacttatagactttctttctttctttttttttttttgagaccgagtctcgctctgtcacccaggctggagtgcagaggcgcgatctcggctcactgcagcctcggcctcccgggttcaagcgattctcctgcctcagcctcctgagtagctgggattataggtgcctgccaccatgcccagctaatttttgtatttttagtagagacggggtttcaccatgttggccaggctggtcttgaactcctgacctagtgatctgcccgccttggcctcccaaagtgatgggattacaggcgtgagccactgtgcctggctccacttatagactttcaattagtccatccatttgcagcctcacgtctcagtcacgtgtaccctctggggacacatgccatctctgccagacatgatggctttcttctattttacattctccttctagtatgctccaggctgcaacttcccctgccctactaacagttacccttccttctgtagttttttcctccttagaaacttgttgaaatctctccttcaccttgctttttgatcatagtctttttttctagtcatctacatttattaatatgacggtacatttggtcttcttagttattccttggttttaaatacttttttgatgttctgttatattaatgtttcactttataatctgtgattacttttctgggacgtgcatgctgtttttgtctgataataaggattttttttatagtctgatatttttctagttgatcactttttagctatgattttgaataacataactgattctagcatacagctagatttaaaagtccaatctgatgatttatgtttttaatttgtgagtagagtttatttacatttttgtaaatatatatatatttgaagttttaggaccaccttatgcatgatttctgcttattattctttctttattccttctctttgttgatagacttttctttataccaacactcttttttagtttactcatttggaagctatagattgttctatatttttagtggtttctttcattttttgacatatgcacacttaactcctcattttctaacaaaactactgttattaaatatttcaatcctaactttggacattgtcacaatttaactacttgttgaatacctctctccctccatctttttactctttagagttttaaaaatagtcaatagtttttttgatagtcaataattttctctacatttaaaatcaatttctgtgctatcattaaatacatcctctaatagttattttagtgagtgtctagaagtatcaactctcagttattacactgaaaattcattgtttaaatttttaaatgggcaactttttaattgaagtgtaatatacataaagaaacctacaaaaattatatacaattgattctcattatttgtgaaaatcatgttccataaaatcaccatgaacactgaattaataaatactgaaccattgctcccaggggaaatacagagttaggctcccgtgagcctctggtcacaacattttcgtcagccgatcaatgtgtaatcttgttttatgtgtgtttctattgaaagacaccttatttaatatgtatggttgattcattaacattgaacttactgccaacagcactgcaactcatgcctgaatgaagcttactaacacatgtattttctctataaggcataccacaggcttatgataacactaggtaacacttcagctgtatgcttccaggccattttaaacagcaaaatcaccatcagaaagcacaaaaatgcagaaaaacgtgcactaagtagcctgtgaaaaggacacttgaggccaggcgcggtggctcacgcctgtaatcccagcactttgggaggccgaggcaggcggatcacaaggtcaggagatcgagatcatcctggctaacacggggaaaccccgtctctactaaaagtccaaaaaaaaaaaaaaaaaaaaaaaaaaaaaagcccgggcgtggtggcgggcgcctgtggtcccagctactcgggaggctgaggcaagagaacggcgtgaacccgggaggcggagcttgcagtgagccgagatcgcgccactgcactccagcctgggtgacggagactctgtctcaaaaaaaaaaaaaaaaagaaaagaaaagaaaagaaaagaaaaaaaagaagaggacacttgcttctaacatgagagctgaaacaagtaagcagagagttgctttgtccgacttcagcttggaacatatgcatccagtgactcaaatttttcccctcaatgcgtatatctgcaaacgaccacaaagctcagcaagtattgattttggggttgcaaataaatttgagtgagtaggtaaattaacaaatacagaatcagtgaataaatgaggatggattgtatggacacacaatgacttttcataaagtgaaagcacccatgtaacaagcatctgagtcaagaaataaagcgtttccagcattctctttggcctttttccaagggtaaccatttttctggcttctgacaccatagattggtttgcctgctttttcacattacctcatgtaagcatgtgttatgtacttttttgtgtctagcttcttttgttcaatattatgttattcatccacgtcacaggttgtaataaatagtattgatcattctaaagcatttttgtcagtctgttctatacaattagttttgtcagaagtgagtttgtattcctagtgttgattttgttgattgtctttcctagaattgtattccctgatgtgttttagacttttgattttcagggtcattttaagcaagaagcttcttgcttttcttcatgtttctcttgctttctagtaattgagtggtgtgctactgccttccctttgtcccccaggctccagtccaaaactaggtcttacagggatgttgatgtgctgcaacattggagatacccagttccagagtctgcacgagccttggctcaggtcctgctcatgaggctgtgtctgtccacctgcctcctttgggccccatgttgctgggaacagttacaccgggcagcagagtggcagtctttttgagcccctttcaatggagtagcatcccactccagctcctggcttcatgcagggagcctgactctattctgtgccttgtgtggagatgtttggtcctgattccctgctaccgctgtctgggtccagacctggagcccagcatgccctggctttatccttgctcactgctggagatttatggtcccagagatgcttgtcttctctttgatcccagctatccattttcagtcatctcttcttatatttgacctgtcattactgtgtctggacatgggtgaagttgtcgaggagtgaatttaactgtactatgctgcctgggagtctgtattgtttgttttatcagagaattaacaagccatttttatcttgaaatacataaagtattcaagagtttcctctcaggtggaaacaattcaaatatctgtcaactgatgagtggataaacaacatgggtatatctatacaatggaatattagtcatccattaaaaagaatgaagtattcatacatgctataacatggacgaatcttgaaaacattacgccaagtaaaagaagccaaacataaaaggccatatattgtataatttcatttatatgaaatatacagaatagacaaattcatagagacaaagagtggattggtgctttccaggggcttgggggaggggagcgtggagctgataactaatgggtatggggtttccttttggggtgatgagaatgttctggaactaaagagtggtgatggttgcacaacacatgccttctaactgctctcatttgaaggtatcactccttcgcaccaacacaaggccaggtcctgtctttattgaacatctttcacaatatattgtgaattacttgtctttgggtctgtccctctaccagactataaacattttcaagagaagcgttttttcctattcagatttgtatctctgttactttgcttagtgcctggcacagagtaaatccaagtaacactgctgaataaatgaatgaacaaattagttgaactgacatgaccacttcaaaaaaagtcattctttttctgggtccctcagtttattgtcagaatcatttcccagggaaagattttcattcagagacactgtgatgccctcagagttaaagcatttgatgtgaggaagcagtgcaagcagcccttaccattcccagggtccccctaaaactttgacctcccagcctcagccagtcctaacctaacatctgctggaggtgcagttgcaatggctgaattattcaaaatattcccaacaactaagcacaaaaatgctgttgctgagtcactcccagcacaaagcattttctttatgatgtctgccctctgaggtgtaaattgcaagtctcacagcctcactctatagaggtgagctaaatgacttctccagggtcagggaacaaatgatggaataagcgatgcatcaaattggaagcgatttctagggatctatgcttctgtatttgactatgtatatgtaggtgtcagggttggaaagtccccaaatatatcacctattagattaagatcttgagatacaaaaatttattcttgaatgttagtgccaattcttcatgacgtggttgaaggtgatttcttcttgttccaacagtgtggaggtaaggaagggaaagggttattaaccatttccccccatgttaaccctttatacactcacagtgatttttaaattatccctttcttccatattaaaatttgcagtccattcattaaaaaaaaattaagaacctattatgtgccagcaattctggatttcaacataaagtatggtccctttctttaaggtctgagttcatagtcttcctttagggtttgctttaaattcttatttctgacgctaatccagctttgtaaaatatgctcccaaatctaccacctggcaaacgttttgtagtaatttattattctctgtgcttttaacacacgggaaaatcagtgttaatctctctccatgttatgccaatgaccagcagcctgtagacaagttaggattgtctgcgcctggtcacattgaaatactttcaatgacctgcgatggaggagttgatttttgcttgtggaagatacagagtagcaacttgaaaataattgctttttagcagtgagtgtaaagtaccatgggaacatccccttctcacacagtatacacaggtctgtcataatgtagacagttcatctggcttgactgatgcaaacagggcttttctgggaaatctcacagccatcaacattgttctgcagttctcaatcactttgtgtgtccccagagctgttgctgagggacacagcaggcagagcagaggtgcagcttttcctgtcgtcttgtcatctaggggacccaaggagactgaagccatcatttcctttgctgactcaatatcctgggcaaaacggatgtatggggtccctggtctgctctgaaagacacatgctagggttccaaaaccagtccttcagcctgcctccaacagtgatgctgacttactcacacagcatctctctgtgctatttatgccacctgcaaaatagagttacacagtaaaagaatttggaatgaaaacactgttcagtgaaataaatgactttttctctttttttaaaacttcaggggctaggtttttctaactggtaatagtcttctaagagggggatgtagggatccagtggctcatgcgagtaaccccagaggctgaggcaggagaattgcttgaagccaggagtttgagaccaacttgggcaacaaagcgggaccccatctctacagaaaaaaaaaaagaaggggatgttttaactcatagtaacctgtcatttattagttctgccttcaaatgctgtcattctgctgcttctagtcagcgaggcattggagggtctactttcatttgagaatgacttctccctcctctgaatgctggttgtagcatcttcctatatgcaactatattaaagctaaatacatgagggtagggacggtctgtcttgtttgttactgtcttggtttgagtttccacagaagcagaccctgggataagcagaccctcgagtgcaagcaatttatttgagaggcgatcccaggaaacactgatagcagagggagacagggtagggaagttagcccaaaatgaatcattactaaacaagttagcatcgtgggtaagtggaacttaattccactggaaaacttagggaacagggtattacacacatctcagagctgtcccaactgaggagtaagggaacttgggtatttatatgacagtttccattagtcattggtttagggctgcccccatttaacataacagtacatccacatggaaaagaatgatccttaatccctacttcacttcacacaaacaatataatgcaagaaggatcatatacctagttgtaaaagttagaaccataaagtttctggaagaaaatgtgggaggatatgtgtgcaaccttagggtaagcaaagttttcttgtgcaggacagagaaaacactattaaaaacacccgaaaaattaattaaaaagtacttaatcaaaattaaatacatctgctctttacaaaaacattgttaagaaaatgaaaaggcaagtaatggaatgggaaaatattttcattacatatatctgacaaaggactggtgcccagaatatataaagaactcctacaaatcaacaacgttcaacgatttgaacagacacttcacacataatgtatacaaatggccaataagccaatatcattcatcatcagggaaatgtaaattaaaatcccaatgagaaaccactagacatcaaccagaatggctcaaactaaatacttggtaaggcgaatgtcagcaaggatgtggtcatgtcagcaactggaactcttatattttgctgatgggagtgcaaagtagcacaatcactatggagaactctttggcagttttttacaaagttaaacatacatctctctaagacccagaaattatatttctaggtatttatttatttattactgtttttttgagatggagtctcgctctgtcacccaggctggagtgcagtggtgcgatcttggctcaccgcaacctccgcctcccaggttcaagtgattctcctgcctcagcctccggagtaactgggattacaggtgcccaccaccacgcccagctaatttttgtatttttagtagagagagggtttcaccatgttggccaggctggtcttgaactcctgacctcaggtgatccacccgccttggccttccaaagcgctggaattacagacgtgagctactgcacctggccctctaggtatttattattgaagataaatgacaacacacatctacaaaaaataaaaataaaaagcttgtacaaaaatgttcataacagcaaaaacaaacaaacaaaaaactagaaagtatcccaaatgtccaccaacaggtgaaaaaaagcaagctgtgaagtagtcatataatagaatgctatttagcactaaaaaggaatgaattattggtacatgcaacaacatggatggagctaaaaaaacaaaattacactgaatgaaataagcatatataaaagaatatattctgttttatttcatgtatataaagtccacgaacaggaaagctaaggtgataaatcgaccagtggttgtccttgcagggtggtctgatttgagtaatggaaaggaggcactcacaagggaacctggtggttttgaaagtgttctatattttgttttggatggtggttacatgagtatatataggtgccaaaactcgcctaattggatatgtgagatctgtgctttttattatctaaaattataccttaataaagattacagacttatcttttaaaaagaaaacacattagccattaacaatagtgggtgatttgctcagtgttctgccctctactagactgtgagcttcaagagagcagaagccccatttgttttgctctctactatatgctcagcacctatcatagcacctgggaccacttgagtgctcaagtcatatttgttaatattataagtttgtaagaacctctgtgcattgagctgtggctttatcctatctccctttgcagacatgatctgttcttggcagatgctggtggccccagaagctcgagcacaggtgcactgtctaggaagggagcttgcaggtgggaacccagcagggccctgggtgtccttgggcactgacagggtcccaactgtgagcaccatctgctcctgtgaagggtgtctgacagtagccgcagccctggacctggaaggtgagtacctctgagacccaaagtcaggctcccattcccatcctccctgcctgtagggagtccacggaaagtcactttaaccctggaaatagaaagcaccaacatatgtaccactttgtaatttaccaagtgttttcccacatatgttcttattttatcttctccatgaccctgtaaagtagttgtctaataaccttattttacagagaggttaactgacttcaacaagctcacgcagctggcaactgacaaacctgggattcaaaccaagtttttaaccatttattcctatattaaatgcagtactgctgtgtcatttatggatcttcagaagcaatttctgaaacctgaccccttcagtaagctttactggactgctggaaagataagtagcaggccccgcttgccttttatccaatttatcccatatgcttccgagatattaacctgcctggaccactactaggatagtgtcattctcccatgcaaatttttcatattcctcatcacctaccaagtaaaattcacattccttagctgctgttcaatgctcttttgccccaactcacctctgtagcctcattttccttaaaaaacaacttcgcattctagctggtcatgtcattatcctcatttccacaactttactcctcaacttctccttcgtatggaacaacagttccttccatcttccctcgggaaatttttctcacccttcaagtcctcactcaaataccactgccactccctattgggaagatttttacttcatttgaaccctgagagtacatggtttgtacctttcctgtggcattaactgtcaggtgtcatgggtatatttgcatcttgcttgttttccttattagatcctgtgatcccagaaggttagatacatgccttatccgtttctgtagcccctatggtgactagcatagctgtttgcccattgtagatatttaattgatactttgtagagtgaatacattaccacctctccaaccattgtctatgaattgaatatcctttggtatgcatagctttaaacattgtttgcgttttaattctattttatgtatttggttagcatagtctctaccctctgtatactttgcttctaacttgacatagattgtatgaatatctaaattctttgcaaatgaggtggacacgtggagattgtggagtccacagctctactctggctctgccgttcactggctgtgtaaccttggacaaaccacatctactctctggattattttatttattttattttattttatgagacagagtcttactctgtagccccagctggagtgcagtgcgacaatctcggctcactgcaacctccgcctccggggctcaagcaattcttgtgcctcagcctcccaagtagctggggttacaggagcctgccaccatgcctggctaattttttgtattttagtagcgatggggttcaccatattgcccagggtggtctcgaactcctgagctcaggcgacccgcccacctcggcgtcccaaagtgctgggattacaggcatgagccactgcgcctggtcactggaccttattttgcctccatctattagatgggggtaataatccctgctttacttctttaattcactgcaagtttgttgggaggataaaggaaataacagatgtgtaagtgctttgccgcctataaatcacccagaaatgtcgtttcattgcatctgctgttaaatgcaggcacatcttttgctgctggcagcccccacccatctgctcctctttcggtgaaaaattgactgtcgggtggcagggaatgtcgagcgggcggcaggatggatgatgaagaagcaaccatgtctcctgaatggcgtgtggcactggggctttgttgtggtgggtgttaggtgaagcggggacattgtcttctgaaaggccgctatgaggaagggaaaagcctgtgtccaggcagcctcgactaccagcctagtcccagggtgtacgctacagggagtcaggcagtttgggaaacttctcagactcagagcttcagaagttgacatgggctgcctgagggaaggtgtgggcccgaatgctgtgcaagtgcgacatcaacttccactaataagggtcacaaccgcccttcaacgtagaagcaaccatctcggtgcccaaggtcaagagagacaccgaagcccggaaatgccctaagcgggaatcttcggagcctgcccattggcttctgctgaacgggagggtgggccctggggcgctccgcttactgattggttcgatgccagattggcaggtccccgccggcagtgcgtgtggtgaggcaggacatggcggaggcaggaaaagtgcccttgagcctcgggcttaccggaggagaagcggcagagtggcctctgcagcggtacgcccgctgcataccctcaaacaccagagacccacctgggccatgcctggaagctgggacagccccctgccccacatggaaggtgaggcccgaaggcaggaatatccctgaggtgcccacagccctcaggaggggaggctccgcgaatacactgggccagtgccccgaaagcaatgccgaggggacaccgagtgactgccaggcctgttggggaatggacaggccgacaactaagataggaaatacatacatagcagtaggagacatggttggaaccctttacagtctcaaaataattatgcaagggagtagtaaacattcatatattcaatgtgtatttattgagcgtcaagtatgtgctagactctattcagggtgctagggatggagcagtgagcaagatataaacgctccccacccttattgatgtttttagtttagtggaggatatactatttatccaaataactaattacagaagggacaactgagtcatcccgtaaccaagcattcacacaggactaaatttgaatcctcgcgttgccagtgaatttctgggaccttgctttagttacttaacctctctgtaccttatttactttgtcttaaaatagagataataatataatagtacaggccctcagaaatattgggattcggttccagaccatcacaataaagcaagttacgacctttttggcttctcagtgcatataaaacctgtgtttgcactgtactgtagtctattaacttgtctaaaacaattatgtctaaaagaacaacgtacccaccttgattcgagaatactttattgctaaaaaatgctaacactcacctgagccttcagcaggtcagtctttttgctgctggagggtcttgcttcatgctggtggctgctgactgatcagagtggtggtttcccaagattggggttgctgtggcaatttcttaaaataagacaacaatgcagtttgtcacatggattgcctctaactttcaggaaagattgctctgtagcatgcaatgctgtttaatggcatttttacccacagtagaactcctttcaaaattggagttaatcctctcacattttgctgctgctttatcaactaagtttatgtgatattctaaatactttgctgtcatttcagcaatgttcacggcatcttcaccaggagtagatgccatcttaggaaaccactttctttgctcatccataaaaagcaactcgtcatctcttcaagttttatcgtaaaattatagcaattcagtcccatcttcaggcttcacttccaattctagttctcttgctctttcaacacatctgcagtcccttcctccattgaaatcttgaactcctcaaaagtcatccgtgagggttggaatcaacttcttccaaattcctgttaatgttgatatgttgacctccgtccatgaatcacaaatgttcttaatggtatctagaatggtgaatccttttcagatgttttctattaactgcccagatccatcagaggaatcactatctacagaagctatagccttataaaatatatttcttaaataataagacttgaaagcagacaattactccttgatcatgggctgcagaatgaatgttgtgttagcaggcatgcaaacaacattcatctctttgtacatctctaaccaagctcttgggtgaccaggtgccttgtcaatgaacaataatattttgacaagaatctttttttctgaggagttggtctcaacagtgggcttaaaatattcagtaaaccatgctataaacaaatgtgctatcatccaggctttgttgttctatttatagagcacaggcagagtagatttagtacagttcctaagggccctaggactttcagaatggtaaatgagcattggcttcaatttagagtcaccagtgggattagcccctaatgcaagagtcagcctgccctttgaagctttgaagccaggcattgacttctcctctttagctatgaacgtcctagatggcctcttcttctaagaaaaggctgttttgaatacgttaaaaaatcagatcagactttggcttaagggaatgttgtgactggtttgatcttctatgcagaccattacaactttttccatttcagcaataaggctattccacttatcattcctgtgttcactggaatagcatttttaatttcctttaagaacttttcctttgcatttacaacctggctaactggcataagaggtctagcttttgacctattttggctttcaacatgccttcctcactaagcttaatcatttctagcttttcatttaaaatgagagatatgtgatttttcctttcaccttaacactttgaggccattgtagggttattagttggctggatttcaatattgttgtgtctcagaatagtgaggactgaggagagggagagagacagagcaaaggctggtggatggagcagttggaatatacataccatttattaagttcactgtcttctatgggcatggtttgtggcactccagaacaattacaatagtaacatcagagatcactgatcacagatcaccatcatatataataataataataatgaaaaagcttgaaatattgtgaaaattaccaaaatgtgatacagagacatgaagtgaacacatgctattagaaaaatggcactgagagacttgattgatgtggggttgccacaaaccttcaatgtgtaaaaaatgtaatatctgtgaagtgcaataaagcaaagtgcagtaaagggaagtgtgcctgtacctacttcataggattattttgaccattgcataagctaatacatgtcaatcacctaaaatagtgcctagtatatattaagttaggggtttgctcttattatcattttgttctagtggtatgctttaacaccatgggttgccagtcattcagttcccttttgtctggtttgactattggatgaggaacctgggattttggattatacacatacatgtacgtcacatgtgtgcacacatgcatacatgtttgtgtattttgggcagcagtagataggagaagaattaaagagaataaaggtcccaggtagctgggtgtggtggctcatgcctgtaatcccagcactttgggaggctgaggcaggcggatcacctgaggtcaggagtttgagaccagcctggccaacatggcaaaaccccgtctctacaaaaaatgcaaaaattagccgggtgtagtggtgcctgcctgcagtcccagctactcaggaggctgaggtgggagaatcacttgaacctgggaggctgaggttgcagtgagctgagatcgtggcactgcactccaacctgagtgacagagcaagactctgtctcaaaaaaaaaaaaaattcccacaacatgtacagaggccacaacatacctgaaaaaacctcagcatgtaatgtatagtgagaaggctagcaaatctggtgcttagagaataagggaaatggtagcttgagataagcctgtctgaagatgtaggcaggtgccttgtgaacattattataaatccagtgggaagccaccgaacagttttaagcagaggcattttcatctttgaaagatcactctggctgtggtgtgaagatggaattggaggggaatatgagtggattcagaaagatcatttagaatgctattgcagtgttataggcaagagatgatgatggcttagactcagggcatggcagtagagatagggatattgggaatatattttggagaccaaaatgaaaaggcttggtgattgattgtatatgggtggtgagagtaaaggacttctgggtttctagcagaagcaactgagtagatggttgaagaatgggaaacactggaggaggaacagtgagggaaaaatccaagatgtcagttttggatgtattgaatttcataagattgtgaagcatccaagtggagatactgaataggtggttgggtatattggtctagactcagaaggaagatctgggctagagatgtaaaggtgtgagtcatcagcataaaggtgatatttatagtcatgggattaggtgagattcgggaccaagcttaaacgtaatccaacatttgtaagttgggtagaggggacagagccccaaagaagactgataagaggcctggcacagtggcttatccctgtaatcccagcactttgggaggccaagatgggtggatcacttgaggtcagaagttcagaccagactggccaacatggtgaaacccgaggctacttgggaggctgaggcaggagaatcccttgagcctaggagacagaggttgcagtgagccaagattgtgccactgcactccagcctgggcaacagagtgagactctgtctcaaaataaataaataaataaataaataaataaataaataaataggaaaatacaacaagatagccgaataggaacagctccgatctgcagctcccagcaagatcaacacagaaggcgggtgatttctgcatttccaactgaggtacctggttcatctcattgggactggttggacagtgggtgcaggccatggggggtgagccgaagcagggtggggcatcacctcacctgggaagtacaagggttggggaatctccctcccccagccaagggaagccgtgagagactgtactgggaggaatggtgcacagatactgtgcttttcccatggtctttgcaatcagcaggccaggagattccctctggtgcctacaccaccgagggccctgggtttcaagcacaaaactgggtggccatttgggcagacactgagctagctgcaggagtttgtttgttttttttttttcacacgccagtggctactggaaagccagtgagacagaactgttcactcccctgaaaagggggctgaagccagggagccaagtggtctggctcagcgggtcccaccccaacagagcccagcaacctaagatccactggcttgcaattctcactgctagcacagcagtctgaggttgacctgggatgctgtatcttggtggggggaagggcatccgccattgctgaggcttgagtaggtggttttacccttacagtgtaaacaaagccaccaggaagtttgaactgggtggagcccaagacagctcagcaaggctgctgcagccacactgcctctctagattcctcctctctgggcagggcatctctgaaaaaaaggcagcagcccagtcagggacttatagataaaacccgcatctccctgggacagagcacctggaggaaggggtggctgtgggcacagcttcagcagacttaaatgtccctgcctgacagctctgaagagagcagtggatctcccagcatagtgttcgaactctgataaggaacagactgcctcctaaagtgggtccctgacctttgtgtctcctgactgggagacacctcccagtaggggccgacagacacctcatataggagagctctggctggcatctggggggtgcccctctgggacaaagcttccagagtaaggaacaggcagcagcctgttctgcagcctccgctggtgatacccaggcaaacagggtctggagtggacctccagcaaattccagcagacctgcagaagaggggcctgactgttagaaggaaaacaaacaaacagaaaggaatagtatcaacatcaacaaaaaggatgtctactcagagaccccacccaaaggtcaccaacatcaaagaccgaagatagataaatccacgaagatgaggagaaaccagtgcaaaaaggctgaaaattccaaaaaccagaaaacctcttcacctccaaaagatcacaacgcctcgccagcaagggaacaaaactggatggacaatgagtttgatgaactgacagaagcaggcttcagaaggtgggtaataacaaactcctctgagctaaaggagcatgttctaacccaatgcaaggaagctaagaactttgaaaaaaggttagatgaattgctaactagaataacctgtttagaaaagaacagaaatgacctgatggagctgaaaaacacagcacgagaacttcatgaagcatacacaagtatcagtagctgaattgatcaagcagaagaaaggatgtcagagactgaagatcaactcaaagaaataaagcaagaagacaaggttagagaaaagagtgaaaagaaacgaacaaagcctccaagaaatatgggactatgtgaaaagaccaaatctatgtatgattggtgtacctgaaagtgatggggagaatggaaccaagttggaaaacactcttcaggatattatccaggagaacttccccaatctagcaaggccggccaacattcaaattcaggaaatacagagaacaccagaaagatactcctcgagaagggcaaccctaagacatataatcgtcagatacacaccaaggttgaaatgaaggaaaaaatgttaagggcagccagagagaaaggttgggtaacccacaaagtgaagcccatcagactaatagcagatctttcggcagaacccctacaatccagaagaaagtgagggccagtattcaatattcttaaagagaagaattttcaatccagaatttcatatccagccaaactaagcttcataagcaaaggagaaataaaatcctttacagacaagcaaatgctgagagatcttgtcaccaccaggcctgccttacaagagctcctgaaggaagcactaaacatgaaccagtaccagccactgcaaaaacataccaaattgtaaagaccatcgatgctatgaagaaactgcatcaactaactggcaaaataaccagctaacatcataacgacaggatcaaattcatgcaacaatatgaaccttaaatgtaaatgggctaaatgccccaattaaaagacacagactggcaaattggataaagagtcaagacccatcagtgtgctgtattcaggagacccatctcacgtgcaaagatacacataggctcaaaataaagggatggaggaatatttaccaagcaaatggaaagaaaaaaaaaagcaggagttgcaatcctagtttctgataaaacagactttaaaccagcaaagataaaaagagacaagagcgttacataatggtaaagggatcaatgcaacaagaagagctaactatcctaaatatatatgcacccaatacaggagcacccagattcataaagcaagttcttagcgacctacaaagagacttagacttccacacaataatagtgggagactttaacaccccactgtcaatattagacagatcaatgagacggaaaattaacaaggatatccaggacttgaactcagctctggaccaagtgaacctaatagacatctacagaactctccaccccaaatcgagagaatatacattcttctcagcaccacatcacacttattctaaaattgaccacataattggaagtaaaacacttcttagcgaatgcaaaagaacggaaatcataacaaacaatctctcagtccacagtgcaataaaattagaactcaggattaagacactcactcaaaaccgcacaactacatggaaactgaacaacctgctcttgaatgactactgggtaaataaagaaatgaaggcagaaataaagatgttctttgaaagcaatgaaaacaaagacaaaacataccagaatctctgggacacctttaaagcagtgtgtagagggaaatttatagtactaaatgcccacaagagaaagcaggaaagacctaaggttggcaccctaacatcacaattaaaagaactagagaagcaagagcaaacaaattcaaaagctagcagaagacaagaagtaactaagatcagagcagaactgaaggagacagacacttgaaaaacccttcaaaagtcagtgaatctgggagctggttttttgaaaagatcaacaaaataggctgctagccagactaataaaaaagcaaaaggagtagaattaaatagatgcaataaaaaatgataaaggggctgtcatcactgatccctcagaaatgcaaactgccatcagagaatactataaacacctctacacaaataaactagaaaatctagaagaaatggataaattcctcaagacatacaccctcccaagactaaaccaggaagaagttgaatccctgaatagaccaataataagttctgaaattgaggcagtaatgaatagcctaccaactaaaaaaagtccagaaccagatggattcacagctgaattatactagaggtacaaagaggagctggtaccattccttgtgaaactattctaaacaatataaaaagagggaatcctccctaactcatttgacaaggccagcatcatcctgatatcaaaacctggcagagacacaacaaaaaaaacgaaaatttcaggccaatatccctgatgaacattgatgcgaaaatcctccataaaatgctggcaaaccaaattcagcagcacatcaaaaagcttatccaccacgatcaagtcagcttcatccctggcatgcaaggctggttcaatgtacacaaatcaataaatgtaatccatcacataaacagaaccaatgacaaaaaccacatgattatctcaatagatgcagaaaaggcctttgacaaaattcaacagcacttcatgctaaaaactcttaataaactaggtattgatagactgtatctccaaataataagggctatttatgataaacccacagccaatatcatactgaatgggcaaaaactggaagcgttccctttgataactggtacaagacaaggatgccctctctcaccacccctattcaccatagtattggaagttctggccagggcaatcgggcaagagaaagaaataaagggtattcagataggaaaagaggaagtcaaaatgtctctgtttgcagatgacatggttgtatatttagaaaacccaatcgtctcagcccaaaatctccttaagctgataagcaacttcagcaaagtctcaggatataaaatcagtgtgcaaaaatcacaagcattcctatacaccaataacagacaaacagagagccaaatcatgagtgaactcccattcagaattgctacaaagagaataaaatacctaggaatccaacttacaagggatgtgaaggacctcttcaaggagaactacaaaccacggctcaaggcaataagagaggacaaaaacaaatgggaaaacattccatgctcatggataggcagaatcaatatcatgaaaatggccattctgccccaagtaatttacagattcaatgctatccccatcaagctaccatgactttcttcacagaattggaaaaaactactttaaatttcatgtggaaccaaaaaagagcctgcatagccaagacaatcctaagcaaaaagaacaaagctggaggcatcagctacctgacttcaaactatactacaagtctacagtaaccaaaacagcatggtactggtaccaaaacagatatatagaccaatggaacagaacagaggcctcagaaataacaccacacatctacaaccatctgatctttgacaaacctgacaaaaacaagcaatgggaaaaggattccctatttaataaatggtgttgggaaaactggctagccatatgcagaaagctgaaactggatcccttccttacatcttatacaaaaatcaactcaagatggattaaagacttaaatataagacctaaaacgatgaaaaccctagaagaagacctaggcaataccattcaggacataggcatgggcaaagacttcatgactaaaacaccaaaagcaatggcaacaaaagccaaaattgacaaatgggatctaattaaactaaagagcttctgcacagcaaaagaaactatcatcagagtgaacaggcaatctacagtatgggagaaaacttttgcaatctatccagctgacagagggctaatatccagaatctacaaagaatttaaacaaatttacaagaaaaagtcaaccccatcaaaaagtgggcgaaggatatgtacaaaagaagacatttatgcagccaacaaatatatgtaaaaaagctcgtcatcactggtcattagagcaatgcaaatgaaaaccacaatgagataccatctcatgcctgttagaatgatgatcattaaaaagtcaggaaacaacaggtgctggagaggatgtggagaaataggaacgcttttatactgtttgtaagagtgtaaattagttcaaccattgtggaagacagtgtggcaattcctcaaggatctagaactagaaataccatttgacccagcaatcccattgctgggtatatacccaaaggattataaatcattctgctataaagacacatgcacatgtatgtttattgcagcactgttcacaatagcaaagacttggaaccaacccaaatgcccatcaatgatagactggataaagaaaatgtggcacatatacatcatggaatactatgcagccataaaaaaggatgagttcatgtcctttgcagggacatggatgaagctggaaaccatcattctcagcaaactaacacaagaacagaaaaccaaacactgcatgttctcactaataagtgggaattgaacaatgagaacacatggacatgggtggggggcatcacacaccggggtctgtaggggagtggggggctgggggagggatagcattaggataaatacctaatgtagaccacaggttaatgggtgcagcaaaccaccatagcacgtgtatacctatgtaacaaacctgcacattctgcacatgtaccccagaacttaaagtataataaagaaaacacaaacaaaaataaattaaataaataaataaataaaagattgacaagggacagagagttgagaagcacccaagagaatggaggtttatcagtgctaaagagagttatttccaggggaaagagtgattgattaactttgttgaatgatgctgcaaaatgaagaaacatgatgactaagggatatctattccattcagcagtgtgaacgtccttaatggtctttaccaagagaaatttaagtggagtgaagggagtggaagccagataggagtagggtaaagaatggctgatgggtgaggaagtgtagccaatgtgcacagacagttcttctgagaggcttggctgtgagtatgattagagaaagggcacaatgaattattcaccacattctagaatattagagccaggggcactccttcaagattgaaatcagtatatctaggaccataaaaaagacattaaattcctagttgtactgttctgaaaccctgtatcctgagaaatgatataggctgaaatacaaaatgaggtgaagaagagttaaatataaggatgactgacctataattggatcttataaaaagctgggaatgtttggtgacatatttaatttttgagactgctccacaggttccttgataccttctcataaaacactttaaaccctttctcctaaagcatctgtgttgggtgcagctgaataattcttaaattcttatcctgcaacccagaggccaggacatttgaccattctaaggagttgattgttattacaatttttttacttctctttgcaaagctcttcataattgcttataaggaacagtgcttttaacagttttcaaatgtttggcataaagccacagctacagtgacaagagatgaggttggcttttgcagtggttttgaaaactgaacatttgtaccttcctttgaatctgtgccgaaccatcctacccgctgtgatcagtttcagcctaggtctgtcattttttttttggaaaaaacgaaagagaaaacaagatttgttctattttatgggcactgggactattgtgcagtaataataataaaagatgagccatctaaagaactgtactctctaagtctcatgtgaattttttattttaaaaatatgtggtacctgcagtaaaaaaagaggttaggtaaagcataaaaatatattattgtggaggatagagtcattctagttgttttttctttagggaactttcagattcaatcttggttgaacctattttgagttctttgattttttctgattataggagaatctgttctcctggtactgttctctatagctgtttaattacagagaaaactttcatcacaatggctctatatgctgagacaaaaatgtcaactcaagagaaaaaatgaatagtacaacaagactcctaagactcgaagtcctagttgagagggaagatcaattctgagacagaaagaatgttatgtataaaatatctaatatattttatagaataatatgcttcattatgtatactgatttgatttacttctttgaactgaattaatcttgttaaaagacactgtctagagataaacacaattcggaagcaaataaactttgtaaaacacgcatgcacactgaaaacccaatggtttagagctgtgctacccagaccttaatgtgcatagaaatcatctgagggttttgttaaaaatgcaaattctgactcagtcagaataggtctggtatggggaatgagattctagttctaacaagctcccaggtgacacagatgctgttggttcaaggaccacactttgagaggcaggggtttagaatatcttgaatgaaatgatagccatatagtaaaattgataaaatgaatttatagagttatgaggtaaggcaatcagattcataatgactgtgcaaatgttttattaatagggttaatatttaagccatctgtcgtcatttaagtggaatgagcaaatgttagttccttagatctgttggctcagcctttctgaaaagatataataacagattggtccattttatgtattttatgtctgaatataatttagtctactaataagtagactaatttgaaaggtgatgttaattgcaggttgcttttaaagttttaccatgtttttcagatttcaaggatttctcagacatgccctaattggttgaacctgacaacttcttagactttttttttttcctttcaaagggaaaaaaatcctttttttataggaggaacttaaaataattgccctacttagaaattaagaaatagaatgtgaagtttgtacttgaaatgaacttttaaatgtggattcaacataagatatattttggatcttctcaacagtgttcttttttctttcatattcctagtgcctacataataccaagtatatgatagatgctcagtaaatgtttgaatgtatggtgtggtaattttccttatgataatgtgttaattattaaatgatagctattatttatcatttgctttggtgtattttttacaagagccctatgaagcaaatattattatacccattttatagataagtgaactgaaactcaggttcagtggctttcccaggaacacaaagataagttgaaaagaaagaatttagacactccttttcttgtctgtaaaatctgtgcttctaagctctatgctgtttgccttaaaactgttaatatcttatatggaatgtagcaattcaattatgtggatgaagaattttgagattaacacacaggataaaaataacaaaaataacagttttttaatttgtttttaaggaaaatttaaaatagtaaaatagttctttgtatgcttgataattttttattgcaggcctaatgttgtgaattttactttgttgggtacagggtatctttgtatttctgtatttctgagcttttttttttttttttttttttccagataagttatttggaaacagtttgatcctttcaagttttgcttttaagctttgtcagctgggacaagagtggctgggactagggctaatttttcccacttctgaggcaaagctcttgaatattctactcaatgtaaattgttttctctactaagaacaggcactattccctgtcctgtgtgagctctggggattattcccttaaattctttcaggtggtcctttccccaccctctggcagtttccttacgcatatatatatgttgatcagtactcagctgaagcagaggaggaggttctgcaagtgtctggagttcttcccttcgtacaggtctctcttctctggtgttttgtcttgcaaactgtagctgcactgacctcctaggactcgaagcttcatctcctcaactcaattatcaccaggctctgcctgggtttatcatccttgcactctgacctggaaactcgtgccaagaagtaacctggggcagtggtaagggctcacttccttcattttctgtcatttctcaggaattaacatcctttattacgtgatacctattgacttgagagctgttgcttcctttgatttgttcagttttttatttcatttaggaggtatgaaataacctgttaaggaggtacttgttaattcccgttggccagaagaggaagtctatagtgagtcttttgattcagttccactttgtttttctactgcaggtcatcaaacaaagcattattaaattatctgctaagtacttgacattcaactaggcattagagattctatggaactgtgtgcttcacacagtcttaaaatgttatgttacttgagtacaggattacaaggataggtggggcttgatcactggagccaagattcctcctggtgagcagacaactttcatcagtcttttggggtgcttcttgaaaatgcagcttcattgttcctgtgctaggcctactgaatcaacttctggggtggctctctaattgattctatgagttgtaatcagtcttcatggcccaattctgaagaaagggtggtagggaagaggggacaattcactaagtggtactgatactatatggaactttcaatttacaaagtattttcataaacctttttccatttaattctcacattaagacttcctgggtctcattaccatcttatagacaaaaagctgaggcctaattagggtaaatagtttgccaaagggtaacataggaagtggaagaacgaattctaaaactcaggttttcctcaagccattgcttcttctgccatacaccgacacttactgcattagttatcttctcatatgcagatgtaggagtatcatcaagagttattatcctttcatgtagcatgctttttttgaagagttaacaggtaacattttgtattaggattaagataggctctgagtgacatataacagtggattaaataagatgaaagtttatgattttccgcataaaagtccacagctggtgtggcactatagtgataggtactgaggctccttctttgttctctgctgtgcatggccatggtctcacagtctgagatagaatcagtatcctagacagcttgtggaggaggggataaagaaatggacaaaggtatatgattgctgtctcttaaggaagtttcctgtaagccaccatgacactttcctagagcacagtggccagaacttagacctgtggccatcctagctgcacgggcagctggtatatatggtctgtattccacaagttcatatgtctagctaaaaaaactaagggttctattaccccataagaaggaaaaatggatattggagggtaactggcagtctgccacacagttctcttctgatctagagactgctaagaaatgaagacttattctttgagcccctggttggaataacaaaaacaactacttaatgagtaattattgtatgttaatacctagaacactgcttggcagatgcccccaaaatattaattgaaggaatgaaggccagacattctgctaagcatctgatctcacataccatttaatctttcagatgatcctataaggtagtattacaatttttattttacattttacagatgcggtaattaaatatactttttcttttttctttttttttttttggagacagagtctcactctggcactcagactggagtacagtggtgcaatcttggtttaccacaatctccacctcgcagggtcaagcgattctcctgccccagcctcctgagtagctgagattacagttgcctgccactaccgcccggctaatttttgtgtttttttcagtagagacggtttcaccatgctggccaggctgtttttgagctcctgacctcagatgatccacccgccttagcctcccaaagtgttgggattacaggcatgagccaccgcgcccggccctaattaaatatgcttctaaatggcaaaactggaatttgatcctagctgtaattccagatattgtcttttataaagtagtagtcattagtgctgttcaccaaatatgctcagattgtatattcctggcctcttgaagttaagttttttatatgactggttttggccaatgaaatgtgagcagaaccaactgtcatgggcagaagctttaagaaccagtgcatgattcatcttattctttttctttgccagtgttgcagatattggcttctctcttagcctaggtcctacagtgaaaacataggcagtgtgaggtagagtgtgaagacaggtagaataagggtggataggtaatgtaagtgagaaacctttgcttttgggggttaatttctgcagcatactgtaagctacacctgactgatatggaaatttttttttcttttggttatgtttaattgaattatgtcatgtacattgtagagtgcatgggcttttgaggaagaaccttataactgatgttctaacattttttttctatgacaaaattattagttgttctaaagcattagtttataaatgtttccaacttgggaccagtctttgttctctttcttcagtaaacaaaatcttaattttattgtgtaacagacatagttttcatagaggctatggattgtttatgaaacatgatttaaggtagaatttatttggacaaataactgaagtttttttcagcttagtggtttaaggagtctaagaagttacagtttagaatgaggcccaagagtattaaaattcattcatttttaggatttattctttatccactatgtgccagacactatgcaaggctctgtttagagatggttaaagcatctctacttaaagagctagccaattaagctcaagtacctgcttatttcaatataggtgtttttgacttcacaaatgacagcactgtatctgagaaataaagtaaggtgtttccttaactcaaatttgaaatataatttgattactggaactgttatgagcttaagtgtgctttgtgaatgaatagaagagcatgcctatgaagataccaaaggtgagtgagagttgcagagacctaggataggtttgataatgggaagtaccactttctggtatagttagtgattttatcagatttagtagtctgggaaatgtttaaaggatactttaaacatgtgggagaaatgttgtgggagtatttgttatagaaataaccagagtggccttgactggtaatttcaaagacataaggaacttattcttctgttacatggaaagtgttttgagtaaatgtagtctatttatggctactgataattcttctgttacatggaaagtgttttgagtaaatgtagtctatttatggctactgatagaggtgatgaagttaattctagtaattgggtttaaaaagactggataatttcatgatcaataatcttagggatatgtggtaaaaggggaattacatctcatgctttgatacatgagataatttttgtacattgtaaaagaaaaagttctctatatatatgattacttttttggtggtggggaaggtctgcgtgttattgctattgttttttttttattgttacagttaaaactttgtatttctgtgaaacaccaaaaaatgctgaattttattgtctggtaattggtatttggcaggaccacttttattagcataatacactctacaagtttgttgaaataatttatgagactcttgctaccaagagtcagtgggaaggcagttgatagcctacttagcaattttgcacacttttcatattttatagtgcataaaatagcaacttgagccaatatataaagctgtgacactttttgaggggtcttaaaagcagaaaacaaaacccctgatctagtacataatttaattcatcacaatctgaataatactattttcacctttcatgtagatataatttagggtaagcacatttggaatacttttctgtattttcatactcttttgacttttttctacctgatgttagatttttcttatagtactgacttgcacaaacacatgcatgtaaattttgagaagattctctgtttaaccaatatataggttgtgctattgttatttaactgatgtataagcttgtgatagggaggttccaaataaagctgtgtgtgctgctgtgttgatggcaacatactgccataggcggaggtcatattgatgtcaatgttaagctacgtttagattggcaactggaacgaagagaagatgtaaactttatgtatgttctctgtgaccccttaacattaatgtcttctgttatgatttggtcattagagataacatttttctttttctttttcttttcttttttttttttttttttttttttttaaagacagagtcttactctgtcacccaggctggagtgcggtggtgcgatctcggctcactgcaacctctgccgcccgagttcaagcgattttcctgcctcggcctccttagtagctgggattacaggcacctaccaccatgcccggctaatttttgtattttttgtagagatggggtttcaccatcttggccaggctggtctggaactcctgaccttgtgatccacccacctcagcctcccaaaattctgggattacaggtgtgagccatcgtgcccagccaacatttttctttaagctttccatattgtgttaatgtgaacatgccagtagtataaagttatcagtcattaaaggtatttcccaagggccagaaataagcaatttttttttctcagatacctggattatgttaggtgttatgatattggaatgtctcggtagaattaggacattatattcaaatcctaaatacagtatcgttgtcctttgtggtaagctgaatgcttttcttaaccttgattctacctagtcgacaaagaacatggaagcctctaacaacttgtattctaaagcatttcaaacataatcaaaggtagacagaataatatagtgatacacgtatgcatcatctagctttaagaattaccaactcgggccaggtgcggtggctcacgcctgtaatcccagcactttgggaggccgaggcaggcggatcatgaggtcaggagattgagaccatcctggctaacacggtgaaaccgcatctccactaaaaatacaaaaaattagccgggcatggtagcgggcacctgtagtcacagctactccagaggctgaggcaggagaatggcgtggacctgggaggcggagcttgccctgagccgagatcgtgccattgcactccagcctgggcaacagagtgagactccgtctcaaaaaaaaaaaaaaaaaaaaaaattaccacttacagctagtctaatttcatctacaccctatccacttccttctcatcatgttattttgaagcaaatcccagacatgatatcatttcatcagtaattatttcggttcatatctctaaaagaaaaaggactttaaaaaagcataaccataataccccaaaattaacaatttcataatattatcagtgttcaaatttcaagtagtcttacaagtgtcataattcttttaaacatggccaaaaattgtgattgattggtgtatcttttaatttttaggtttctctgcagtatttccttgacctcacctctctctcttccttgcggtttaagaaatcaggttgttctacagagtttctcagtctggattttgctgaccgccatctctgtggtgcagtttaatgtgatcctttgtgctctgtatttcttgtgaactggtcattgaatctagaggctttgtcaaattcaggttggattttcttgtattttctttatatatcatctagaatatttctgtaaagaaaaacatccccttatctattagaggttacccggtggttggtttttatagcagagctaggataaattcttgatgttttctcttcatttaccacttaaaaaatgagttaagctgggcgctgtgcttcacacctgtaattctagcactttgggaggcccaggtgggtgaatcacttgaggtcaagaatttgagaccagcttggccaacatagtgaaaccccatctctactaaaaatacaaaacttagctgggtatggtggcgcatgcctgtagtcccagctacttgggatgctgaggcaggagaatcacttgaacccacgagacagaggtttcagtgagccaagatcgtgccactgcactccagcctgggtgacaggaaaaggaaaaaaaaaaaagagttggttccctagactccttcggtgttggaggatgtttttgtttttaactagaagcttttaagatcttcttctatccatggaattcaggaatttaatcaggatatgtctagttattgattttttaaaacccccatccccattaatgcctggaacttaaaccgtttgtatcttcagtctcacttctttctgcagttgtagaatatttcattctattattttttcaatcagttcctttcctcagtctttttttctccctctactttagaccctctcactaacattttttctcctggatctgaatctttgctccgtgtatcttgttacacatgatttctttctcctagttttgctctatttttctcctgcttgctcttttaaactattaatttggcctcaatagtgtccatccaattcttcaattagctattgaaatttgtattcataaaatagttttagcttcaagattctcaagtgtgaataataattatatttatcattatttaataagaaatacagaaatatatatttattattattacagttattatttagttcaagctgttgtcagtctcctctagcagcttgttcccccgggagcctcgtgttttgggttttctgttgttcttcattgctttagcccattgggtatgtagctattttcctttgtctaacttatgggtcttttcactcctgggtgtcatctccaagagtggacactttaaggtgctgagtgttgggagatgcagaagtcacagtgctgtgggcctcctgtagagaagtaggaaggattgagttaagttggccaactcctttgtgactccttggaggttgagagaccgctaggaacttcagagcacatagtctggtctgcccatcttcatgaggtccaccaatttctagggactaggctctctcacaagaactgcagcattgtctttgcctcagggctccttgcttagtacctcctttctcctgtagggggaaaacgtcctactagctctttttttgtggaccctgagacctcaatccacccttctggctgtcttggatgatgtgttttttgtttgtttgtttgtttgttttgagatggagtctcactgtgttgcccagtctggagtgcaatattgcaatctcagctcactgcaacctctgcctcccaggttcaagagattcacctgcctcagcctcctgagtagctgggattacaggtacccaccaccacgcccagctaatttttgtatttttagtagagacagggttttgccatcttggccagactggtttcaaactcctgacctcatgtgatctgcctgcttcggcctcccaaagtgctgggcttacaggtgtgagtcactgtcccctgccagatgctggtcttaataattgcttaaggaaaggtaaatggcatttggattggatttggaaagagaagacttcagggatgcaatgaagctaccattttttcttgaaccccttggaagttcttaaaatggatattttctaactatatgagcacattatgtagaccttttggatgagggattgcaacagacatctgaaaaatcataagcctggaattctcctcccccagctacctggttaactttcatacctttggtctttgctcaagcctcaccttctcagatgcctaccttaacctctctatttatattgtaacatctgtgtcctgtctttgcactttgattccacttgtcctgctctatttcttccctagctcttagcattatctcatatactagataatttttttatttgctatgttcagtgatgtgcctagaacatctgacacctagaatgaatatttttttaacatcttcttcccctgaatgataaaattattttctgaaataatcaagttaaatgaaaaatattatgcagcggacattctctcttactgagttttgttataataattatgccaaataaataggaaaaatacagtataaggcaggaaaaaaaatccacaactatttagcccattgtttttattttattttatattgtgttattttattttattttgagacggagtctcgctctgtcacccaggctggagtgcagtggcgcgatctcagctcattgcaacctctgccttccgggttcaagcgattcttctgcctcagcttcctgagtagctgggactacaggtgcacaccaccacgcctggctaattttttcatttttttagtagagacggggtttcaccagttggtcaggctggtctcaatctcctgacctcatgatctgcccacctcggcctcccaaagtgctgggattacaggcatgagccaccgcacccggccaccaattgtttttatatctagttaactgtttgaacttggattctgcagttacagactgatattttatgaaattgttcattaactaataagtgaagtttttttaagtaaaattaagcatttccgactgggttcggtggtgcatgcctgtaatcccaacactttgggagtctgaggcaggtggatcacgaggtcaggagtttgagaccagcctggccaacatggtgaaaccccatctctaccaaaaatacaaaaaattagccaagtgtggtggtatgcacctgtaatcctagctactcaggaggctgaggcaggagaatcacttgaacctgggaggcagaggttgcagtgagccaagatggtgccattgcactctagcctgggtgacagagcaagactcccgctgggggaaggaaaacaacaacaacaaaaacctaagcatttccaaaaggtacaatttacgcaactattaataaaattgttgatatgttttatcccctcttaacgttctttagtttcaaaacacttaatttgaagagaataaatttcaatgttaaagatattgttcaaatttagtaaaatattttgtgaactaaaatttgcacttattaaataagttacatcttgctatttacacttgcaacagtgttttaaattttagacaaataccaaaaggtcccataaaaatgacagaattggagtgcctcaagttgtttcttggtctttacaatcactgtgctatctttgttttattttgaatctatcatttaaatgcacaagaatgtagtaccacagggagggaaaagccaactgcatcctaagaaagggttggattaagaacttcatgttaagcagtcttcaggtttaagaaagcctggtgcactgcttttgaaacaagtgtatgtgcctaagtttgcatggatgggggttagctgtaactgggagtttccccaatgaacttatatgtagacaacaatttaagaataaataacaaatctgatattttgaagcttacatatatattatttaaactcagcagtaactgcagtaattatttggaacttagaccaacaaaatgtttttttcaggaaggagtatttttatcactgacattgattagaattactggcacatggtggtaataaactgattttagtcagctttttaattgtttataaattctctacagaccaagcattgctttattgccagcacctgcagtgtactgctcccaacatcccacctttggtatgtcactaattatatttgttgtgtattgtctgtactcttgctctgcatcaccatttcacacttgctccattaggattaggatctgtgttttgttcagtgatactgcaatcatatatttgttgaatgaagaattaatgaagttcaagttcagagactttctatgtcttttttcttctccatattataagagggatcagtacatagtggatactttgctattgttaactcactgacttaaatgcttggcatatagtctctttggactcttgcatttcttgaaaaatttggaattttgattgggattggatagatcaacttggagaattagtgtctgtactaatttcttagtgctgctgtaacaagctataaacttagtggcttaaaacaacgcaaacattagcttatagttctagaggtcagaaatttgaaatgggtttattgagctaaaatcaaagtgtcaggaggactgcattccttctggaggctcaagaatctttttttttttttcctggccttctctaacacgtagaggttgcctgcattccttagtttgttacccaccttccatcctcaatgccagcaatcacattccttctgactctttctgcctccctctttctcttgtaaggatgcttctgattacaataggttcacctggataattcagggctatccctccagctcaagatattttaacttaatcacatatgcaaaatccctttgctatgtaagataacatattacaggttccgggtattaggacatagacatctttagggggaccgttgttctgcctattacagcattttaataatattaaatcttcctatctgtgaacaaaatatttctctccatatatttaagtgttcttaaatttctctcaattttcaatgtgctggtcttcttttgtcatatttatcccttagtattttatatttttgatgttgtaaattttgatgcttttaaaatttcaggttctagttcttcattagtgtatgtaaatgcaattggtttttatttattgatcttctattctgtaacctttctaaaattcacttattctagtaaaatcaactggattttctacatagatgatcatgttgtctgtgaataaagacagttttacttctttccaatctggatgctttttcattctttttcctgtctgattacagtggtaagaacttgcggtaacaatgttgaatagaagtggtgaaagtggacatcttgtcttgtttcttatcttagggagaaagctttcagtatgaagttagctgtagttttttttttttttttaatagatgccctttatcagcttgaggaagttacttctattcctggtttgctgagttttaaaatcaggaatagatgttggattttgtcaaatgttttttctgcattctctcatattgaggtgatcatatggtttttcttttttaatatgttaacatggtgaataactttgagttcacaatatttctgatttcccttttaatttcttatttacccatgagtaaataagaatatttggggctttttttcagagacctgtttttgatttctaatttaattcatctgtgctcaggtaacattctcttaaatcaaccagaacttgttctgtggcttagaatatagtctttgtgaatgctctgtgtatacttgagaagaatgtgttttgtgttggtgttagatggagtgttcaataaatgtcgatcaatcatgttggttgacagttgctcaagtctgctatatacttggtgatttgctatgtgctttttctatcagttattgagagaggggtattaaaatctgactgtaattgtgaacttgtctgtttccccttacagttctatcacttactgcttcgtgtatttttaagctctgtattggaggaatacatgtttgggatgattatctttcttgattaattgacccttttattatttgaaatgaccttctttgtaaccttttgatattcttgtctaatattaataaaaccactccagtttttattttttatttttatctttttagtgaaagagtctcactctgttacccaggcctctgggtgcagtgtgcagagtgcagtggtgcaatcatagcttacagcagcctcgaactcctgagctcaagtgatccttctgcttcagcctcccaagcagctgggactacaggcgtgtaccaccgtgcctggctaatttttacattttctgtagagatcaagtcttgccatgttgcccaggctgatctcaaattcctggccttaggcaagccttagactcttttttttttttttttttttttaagactccgtctccctcctttgcccaggctggagtgcagtggcgcgatcttggctcactgcaagctccacctcctgggttcacgccattctcctgcctcagcctcccgagtagctgggactacaggtgcccgccaccatgcccggctaattttttgtatttttagtagagatggggtttcactgtgttagccagggcaagcctgtgctgagattgtaggagtgagccactgtgcctggccttactctagcttttgactagcattagcttggtatatattttttctatccttttgtttttaacctgtttgtttttatatttaaagtgcatttcttgtaggcagcatatagcttgttttgtcttttttatccaatctgacaacctctgcctttaattgaggtgtttacatttaaatgtactattatatttaatatgattattgatagggttgggtttcagtctgttatcttgctatttgttttataattttcccatctgttctttgttcccttttaattttgatcttgcctttcgtttggataaattgaatattgtttatcaatataatcccatttatcagttatcttttaaagatatttaggtaaaatttttatgcatttgcccatgtaattattatttcctgcactcttcattcttttgtggagatcttagtttttatctgataacattttctttcttcctgaaggacttcctttcacatttctttcagtgcagatctgctggtgatgaattctttctgaagacatctttatttcctttgaaaattttgcatcttaatatggtgccttcatttaaaagttcttatttacttaaccatccaacaaaatattgggtgtctattgtgtgccaggtactatcctaggcatttgaatataacagtgtccaaaacggggaaaaaaaaatctctatcttcatggagcttaatttctgctcagggaagactagtaacaagtaaatataacaaagtggtaagagctatggataaaaataaagctggagaagggaataggagtagtgtggtttagataacatgggggagttttcagatggatggttaggaaaagttttacctgaaaacatgatatttaagctaaggtttgaagatggagtgagtcgtggtatctagaagaagagaatttcagatagaacagcaattgtagaagccctgaggtttataataatcagtgtgcctagtgggttcagggagcaggaaggaggctagtgtggctgatgagagtgcacagtaggtgggtgctacaggacaagagcagagaggcagtggagggcctagaccgtggagtgcgttgcaggagcttctgaatgagatagggagctattgcagggctgtaagctggaaatgacatgatctgacttatatttttaaaggatcactctggctactgtattgagaataaactctgtgttggagaagggaagcaagaacagaaattgaaaagccagttaggagattattataataatccaactagagagaatgataatttagacaagacctataagaagtggttgaattatggatattttgaagatagacatgaaggatttgctgatggattggatatgggtgtgagaaaaggagtcaagaatgattccatggtttagccaaagaaatggaaggaaagaattaatttcttaagtgttgcatatagaaacctgaaaaagaagaaaattattttctgaggtgaaaatgttgtgatgtcaaatgtctacaacagcctagcacagggtaggtactttgtaaatagtgaatgagaaggttaggagttcaagttaggggctgttaattttgagataactattaaacctttacatggagatgttgattgggtgattaaatgtagcaatttggagggcaagagagtagtctaaactggggctctcctggaagttgttggctatgatttgaaaaaaaaataatttgggaaaaatagaaatctttatagtgagtgtttctatccaacaagagacatatgtaagaatgttcataacagtattatttgtagtgaacctaaactggaaaaaatacccatcagcaaacaaacaaacaaacaaaaaaagggtggtatcatcatagaaggtattcaagaatcatgaaaatgaatacacatgcaacaacattgatggagccaaatgtcaaataattctttatgattccactcatataattaaaactaaagtatagtgttagaagtcaggatgggagattattttaagggaaaaagaagcagatagtgattttaagacagcaaacactagaggaccttctggaaatctggtaatgttctatttcttcatctgggtgatgtatttgctttgtcattgttcattgagctgtacacttatatttcggatgctttttggtatatatgttacatttcttaaaacaaaacattaaactatcatgttaacacattgccttccaaataattcattgaccagactgtagttgtgaaagctgtacttgactcctagctatgcttctggttctaactagtcattaaaacacacaggataattcatttaaactgtgacaagaagagtgttgtgccactgaccaagttccaaatactgggaaagagggagaattacaaccactgaaggaattagtgcaggtcttattgtatcccctttgatatctaaaatgttattcactttttaagtttggaatttaaaatgaattagagaaaacacagtagaaatcttggatttaaatatagcattaaaactccaaaccccacgtatgaaactataagagcattgttagtagaatgcagtaacctcataaaaacatatctaagttgaattaggtatgtgttaattattttgaactttgggcattaagatgagtctataacatcttattgtttatgtaaggatgtttaccttacggtgtttattaaggatatgaaagccacctatatagtatagtcacttaagacccagatcccactctaatgtatctatcagtcatgtccttccctgacattttgatttaatttcttcggttcctcactatatctcgataggttggaactatagatccaatctaacaagataaaatataatggggctaatccaaggttttatgtttaggttcaagatgaataaagggaagtatgatttaccaacataggtaatgaagtgtcaggaggttatattgatttaagatcaaactcttcagtgtactaccctctcaaaaagttaatgtgattataggcaatagtattgcaagtaatgggaaataattagactacaccaagcagattatggtaagtttatggcaccatattttaagagtgacactgacaaactagagctcatccaaaggaaagcaccagatgttaaggggttatgaaaaatggagggctgggtgcgatggctcacgcctgtaatcccagcactttgggaggctgaggtgggcagatacttgaggtcaggaattcgagaccagcctgacgaacatggtgaaaccccatctccactaaaaatacaaaaattaaccgggcatggtggcgcatgcctgtaatcccagctactcgcgaggctgaggcaggagaatcgcttgaacacaggaggcagaggttgctgtgagccgagatcacaccattgcactccagcctgggcaacaagagtgaaactctgtctcaaaaaaaaaacaaaaaagaaaagaaaaatggattacatggctgaagaaattgggactgtgaagtcttacagcaactctgtaaggtgctatctccattttacagaaagaatactgaggctcagagagaataaattatttattaaaatgtaactaaaaagtggttggctcaggacccacaactcatgattcttaatctgatattctttctgtttcaaaatattggcttttaattttattttttaaaagtctggctgttagcctatatatatggagaagcttaaagttgtaagggaagggttacagattaaatgaatggaaaagcaaagagaatgctcggagtaaaaagatcaatatgagaaaacacttggtcatcagtattgtaagtttatcagttatagaaatgtattatcttttacatatttttctccttctccctttcaaggtttttgattccaatgaagaatctggatatcttgttctcaccatagttatatcaggtcatttcttcattttccaaggacagacactactggtaggttttatgcataacagtttaatatggaaatacatctttgtcttcttagctttacatgaatttttgtatcctcaagcttcttcagtctcactgtaattcatcaaggtcaacacattaagcatttatcgaatgtgccataatagtgggaaatacagaaacgtactgaatattgcctgccctaaaggggtttaggattttgttgggagtcagagtggatcaaaagattgaaattaaccagtatgataaaggattctgtagtaagggagattgagttaagataggcttgttaacaaagacaagtgtggagggttttccagatagggaaaacagcatatgcagagggatagatttgcagaaataaagaaaacaaaaaggtgttactgttaattgatagcgtcctctataaaactctaattttatggtgatacatgtgttctttattctgaatatatgtacactttaggaaattttggaatgaagaaatatgtaaagaaaataagaatcaacttggttgaaagtttaggttttatttggtacatagaaaccaaatgaaagaaaaaaaacaattggtaacttccaatcaaaggaattgtacaagaaaggaacatataagggaaagttattatatcatttagctgtgaatggggtctacattgacataaattcatacaacaaatatttactatctacatgggcataatttaacaaatatttattgagtaattgtatatgctaggcattttaggggatgctagggatatagcagtgaacagtgaagacagaaatctctttcattatgggatatcatcattctagtgggggaaaaacagcaataagcaaataggtcaagtacatttaaaagacattaattctttttggatcacttacatgttctatcataatatggtaggatctcacatgtgtatgttgtgatgattcatatttccgcttaaatatagccttctcattgaacgtgagatgacctgcaaagtcatctttgtattcctcgtgacttttaaaactgcagcatgcgttgtactattttgctttatctgctactgtcagggtctgcatcagttgcaagagataaaggtttcttcagctgctaatgagtgttgcaaatggtagacttgaagaatacctagtgcacagttagttctccctgccaatatcatgggtctttgctgaatggtgacattaatgcagtttggcttcctcgggcatattagaccaccccatactgtgtctctgctccatctttttgccccagtggtgactattatgaacaaatggatagaaatttctttgtatcacacatagaatgatttttgcactgtagtcacaaaaccaagttatcaaattccaagatacccactacagagaaatgtaaggataactctgcaatttggtgcatgttgcatatacagtcatgtgtctcatcacaacatattagtcaagagaggaccacagatatgatagtgatcccattagattataagggggctgaaaaattcctatcacctgtgatgtcttgatgatactggcccttgtaggcataggctaatgtgcatgtttgtgtcttagtttttaacaaaaggtttttaaaatacaatgattttaaaaatgtaaaactagaaaaaatattgtatatgttttaagttattgtaaaacagtccaaatgttttttaaaatttttttgaagtttataatgtaaaaatgttacagtaagctaaggttaatttgtgattgaagaaagatactttttaaaataaatttatttataaaaaatagtcattaaggaaatgcaaattaaaaccaccatgagataacaatacacacttaattaggatagttaactgagtgtacagtgtttataaagtctacagtagtgtacagtaatgtcctaggccatcacattcattcaccactcactcacccagagcaattttcaccttgcaagctacattcatggtaagtgccctatacaggtgtaatgtttactgtaccttctctatgcttagatatacacatatttagcattgtgttagtgttacggttgcctacagggttcagtacggtaacatgctttacaggtttgtagcctaggagcaataggctatcccacgtgacccacatatgtagtaggctgtaccatcgaggtttgcataagtgtactctatgatagtcacacaatgacaagatcacctaatgacacatttcttagaacatatcctcattgttaagtgacatatgactatacatatataacttaaatattgtaatttgtttaatcttttttaaaattatttttaaaaatcacttttattgaggtataatttacataaaattcactgactttaagtgttcaatttgaagtgttttaataaatctatagtcatgtaaccatcgccacaatcatgatacagaacatttcaattaacccaatttccttgtggctctttgcagtgagcttctctgcccaccctcagcacctagaaaccattgatctgctgtcactctagttttgccttttttaaaataatttttgtttatatatatctttaattgacagataaaattgtatatatttactgtgtacgttattttgaagtatatatacattgtaaaatgactaaatctagctaattaacatatgcattacctcactgtagttttgccttttctagaattcatgtaatggaatcatatgatatgtagtcttttcagttgggcttcttccattcagtataatttgagattcatctctgttgttccatgttatcagtagtttattccttttcattaatgaagaatattccattgcataggtaaacctattttgcttatccattcaacttttgatagacattggggtggttttcattttttcagctgttatgaataacactactgaatatttgtatacgagcctttgggcatgttttcatttttcatcgttaaatgtccaagagaagaaccgctgagtcatatggtgtgtctgtgtttaactttataggaaactgcaaaactgttttccaaagttgcattctcataagcaacgtatgagggttccacatgttccacatcctcaccaacacttggtattgtcagtctttttaacttatctatcctaataagtgtgtagtattatctcatggtggttttaatttgcatttctttagtgactaatactgttgagcatcttttcacgtatttgccatttgtatgtctcattggtgaagtgtctgttcgtgtcttttaaccattgagttgtttgccttcttatattcgaatttaaaaattcttactctggttacaactcttttatcagaaatgtgttcttcaaatatttctaccagtttatagcttaccttttcatttctttgtgtcttttgaagagcagaagttaaaaattttgaagttcaatatttttttctcttatggtttatcctttttgtatactacttaggaaatttttacctatgccaagattgcaaagtcattttttttgagtcaggatcttgccctgttacctaggctggagtacagtggtgtgatcatagctcactgcagccttgacctcccaggctcaagtagtcctcccatctcagcctcctgagtagctgggactgtaggcatacaccaccatgcctggctaatttgttatagtttttgtagagacaggatctcactatgttgcctaggctgctctcaaactcctggactcaggcgatcctctcacctcagcttcccaaagtgttgggattataggcatgagtcactgtgcctggctgcaaagatttttaaaaatgttttcttctagaagctttatgctttcagctcttatatttaggcctctagttcattatgaatttttttagtattaatatttttatttttatttcatgtagtggtccttctttcccacaattaaagcaatgtggtattgataaaaattactatattatggaatgtaatcatggatcttaggcaatttacttctggaaccattgaattaattttaatatatggtgacagttaagaatttgggtttattggccgggcgtggtggctcacgcctgtaatcccagcactttgtgaggccaaggtgggtggatcacctgagatcaggagttcgagaccagcctggccaacatggtgaaaccccatctctactaaaaatataaaaactagcctggtgtggtggtgggcacctgtaatcccagtgactcgggaggctgaggtgggacaattgcttgaacccaggagacagaggttgcagtgacccgacacggtgccactgcactccagcctcagtgacagagtgagactctgtctcaaaaaaaaaaaaaaaaaaaaaaaagaatttgggtttattttttgcacgtggatatcgattattttagtaccattaattgaaaagactagctttctctcattgaattacctgggtatcattgtttaaaattaatttgctaagtatgtgttagtctatttctggactcttttttgttctgttgatctatatgtctatccttactccaataacacactgtcttctgctttgttgtaatttttgaaatcaggtagtttaattcttccaactgtgttctttttcaaagttgttttgactattataggtcatttgcatttccatataaattttagaatgacatttcctacaaaaaagcttgctgggattgtgatgggactgatttgaatctataaatcaatttgagaagaattgatttcttttaccatcttctaagtagtgagcatatttaaaactctccatttattgatttctctcatcaatgttttgtagttttcataatacaggtcttgcacatactttgctaaatttatccacaaatatttcatattttttatgttcttgtaggtaggattttaaaatttcaatatctaatagtttgttgctgatgtttagaaacataattgatttttaaatattgaccttgtatcctgtgatgatcttgctgaactcattagttctgcagcttttttgtaaattctttagggttttctacatacatgatctgtgttctgtaaataaagatgttttacattcttcctttcaatctgtatactctccctgcctgcctcacccgcttcccacagattatgctggctaggatgtccttttcaatgttgaatagcaatggtgagagttgatgtccttgccttgtttccccatcttagggggaaagcatttagtcttttcaccattaaatataatgttagctgtaggtttttttttttgtagatccaattcataaaaccagggaagttcccttctattcctagtttgctaagggacttgttttttccctttgagcttctggtatttatctatttttaaataaaaattatatatattaatatacatataattaaggtatacaatgtaatgttttgatatacattgtaaaacaatgactgtagtcaaacgaattaacatatcgttacctcacaattaccattttatatatgtatggtgagaatatttaagatctattctagcagatttcaaatatacaatatagtgctattatctatatttatgctgtacattagatctctagaatttattcatcctatataactgaagcttcataccctttgaccaacatctcatttcctctaccttccctggcccacccctagtaaccactattctattctctgcttctatgaattttactattttagatctcatatataagtgagatcatgtaatttttgtgtgtgtctggcttatttcacttagcataatgtattccaggttcatccatgttgttgaaaatggtaggatgccttcttttttaaggctgaataatattcatgtgtgtatatgtacctatatacataacaattttttatccacttatccactgatggacccttaggttatttctgtatctcgactattgttaataatgctgcagtgaatgtggagtacagatacctcttcaaaatactaatttcatttcctttgggtatatacctggaagtgggattgctggatcatatggtaattctatttataattttttgaggaaactccatactatttcccaaaatggctataccaatttacattaccaccaacattgtacaaggattgctttttctccatattctcaccaatacctcttgtcttctgtctctttaatagtagccatcctaagaagtatgagggaataatgtcattgtggtattaatttgcatttccctgatgattagtaatgttgaacactttttcttatacctgttggccatttatgtcatttgtggaaaatgcttattcaggtcttttgctaattttttttatttttatttttttgaaatggagtttcgttctgtcacccaggcttaataataaataaattatttaaataaacaaatttatttaaaatttttaaattttataataaaaattttcaattactgaatcaacctttattgtagaagtatttgattttttaaattatgtacatatgtaagtgtgataaaaataagaatacatatttaaaatatattttgccccctaaattacagaataattttcatcagttcatgccatttattcataatctttcttggcctccacagaaagcaacacgtagaagagcaaacacatttggattataacgcatttataacatgtgtaattttatgttggtattacatttacacaccctctcctttcatactaatctgggtcatgatacatttttagaacttttttttgagatggagtctcactctttcgcccaggctgggatgcagtggtatgatctcagctcactgcaacctccgcctcctgggttcaagcgattctcctgcctcagtcttctgagtagctgggattacaggtgcccaccaccacacccagctaacttttgtatttttagtggagatggggtttcaccatgttggccaggctggtctcgaactcctgacctcaggtgattcacccaccttggcctcccaaagtgctgggattacaggccaccgcacctggccttagaacttttttcataaaaggtagagacaggacagccatagaaagttttagccatttctgtcttagtacaattattcaatcactggcgtgaatctaaatatcatatatttatattttcaaagttgtgtggaagctgcatccataaaacccctccaaaaagtagtaacagcctagtaacagcttcatgtgtgtgatatgtttatgtaaaactcaaaacacgtcaacatggttttgggctttctgcttggtcctgggaagttatttaaatttaatttcctttaaccatcataggtctttgattgccactccctgtgagatccatgggaacttaatgcttcagattaaactgcatgcatggtatctagtaatactacagatttccatcttgcttgttcatatagcacctgcattcaactggggacatcactgccagagggctccatggagacataccactagactgttctattgtcatttatgtcaaagggttaatatagcaagaaggctgagatatcttgaccccatcctcagtttaccttggacttgggctcaactgactttcccttgctagtcttgagagtttgaacagattctcccttggccgttttgggtttcacattttttttttccctaattgtggtaaatacatgtaacataaaatttaccatcttaactcccttttttttttttttttttttttttttgaggcggagtctcactctgtcgcctaggctggagtgcagtggaacagtctcggctcaccgcaacctctgcctcccaggttcaagcaattctcctacctcagcctcctgagtagctggaattacagctgcacaccaccacgccaggggctaatgtttgtatttttagtagagatggggtttcaccatgttggtcaggctggtctcaaactcctgagcttgtgatctgcccacctcggcctcccaaagtgctgggattacaggcgtgagccactgcgcctggcctatcttaaccatttttaagtgtacatgtcattgacattaagtacattcctatcattgtgccaccagcagcaccatctatctccagaactcttcatcttgcaaaacgaaaactctgtacccattaaacaactgcccattatttttcccccaagcccttggtaaccaccattctactttcagtttctatgaatttgactattgtaggtacctcatataatggtgatatagtttggatgtttgtcccctccaaatcttgtgttgaaatgtaatccccagtgttgaaggtggggcctgtaggaggtgtatccctcatgaatggcttggtgctgtcctcacgataataagtgagttcttgctctgagttcatgcaagatctggttgtttaaaatagtgaggcacttcccccttctcttgttcctgttcttgccatgcgacatgcctcttccccctttgccttctgccatgattgggagcttccgaggcctcaccagaagctgagtagatggtggtgccatgctttctatatggcctgcagaactgtgaaacaaataaacctcttttcttcataaattacccagcctcaggtattcctttatagcaatgtaaaaacagcctctaatacaagaggaatcatacagtatttgtcattttggactgtttcacttagcataatgttatcaagattgctccatgctatagcatatcatagattccttcctttttaaacagaataatattctactataggtatatactacattttgtttactgatttatctaccaatggatgttcagttgttaataccttttgcctattgtgaataatgctgctgtgaacatgagtttacaaatatccctttgaaaccctgctttcaattaatttggatatgtactcataagtagaattgctggattatatggtaattctatttttgatttttttttttttttgaggaactgccatactcatttccacaggggctgtaccattttacattcctagcaatagtgcatgacagttccagtttctccacatccttgccaatgcttattattttctgttttttaaaatagtattgatcttagcgggtgtaaggtggtatctccttatggttttgatttgtgtttctctaatgattagtgagattgagcgtcttttatgtatttgttgcccatttttgtatcttgtttagagaatgtctattcagttttctttttcaaaaaaatatttaacagtttattttctttgagtacttctggtcaggctttggcagggctctctggattcctctggtcatgttttgagctgccgctgctgctgctgctgctgctgcaacttttaaaggctgtttttgcttcttcagcttttgagtctcttggaacatccagaacgcacagtcttctcagtcaggacttggcaatgggctgctccatcaaaaagatgtgctcagtccccagtgtgtcttctcagagacatcatattggtctaacgaaggtttttgagcatctttttcctctggacagtgcccatcaccaatagtatttgtgggttttgttatttcagtgtttctgctgtgttcttcataattgtgggctttggtcaagggaataattcgagcctccaggaagctggtgtccttagggtttgccacgactttgttcatcagatgttcttacttgatatttagcttctccttttggttggtcatttccaaagacaaggatcttttcactgtatcattgcccttctcaattccagggatggtctggtggtctttgagcagcatggaaaggggaaggtcatggtcctgtctaggccagactggtttctggatggtgtatctgctgcagcctggaggaggagactgcaggccccttcagttggaaggaagcctggcattccctcagcccagcagcccaaggactggggtctgggtcactgcctgggtccaatagaactcggcactctctatgtggccctcagcatggtgacttctgacccccaccaactcccctggggcctactccacagcctccagccccttcactgtagggactgggttacacaggcctcttcaattttctgattggggttttgttgttgttgtgttgtggaattggtgttgtttttttaaaatgataattcccctttacacacacacatgcatacacatcctccacctagtgaatgtagcttttaaaacatttttggccagatctcatgtgatcttctccactcctgtttcttctttcagcttggatgaggtgtaggataagcactatgagccctttttagggtagggactagaaagtgtggcttttcttggagcacagagctctgtgccatgctgtgccctctccccagtcacccttatatatcaagttgcttctgccacctgcttctttgttgcctgctcaatcctcctcggcttcttctgtcctggagctggagcttctgattattagcaggaggtacacttactcttcagtgggctgccatcttttcctggatctcaaattcattctttaaaaaagtggaattcgtaactcctttggggatatttctccaaatttaaaaacacattctcttacatatcattgtaaacctctaaagatctaccttttgtcagcatcttccttctcaatccagaagttgcagaagccaaagtttcaagccaggttctaaatatatccaaatgggagaagttatttcccaaggctttagcctctatttccagccattcctttttatctcagttggctttggtccagcatgagtgtctttacctagatataattatgcctgaaacacagaatggttttgagacaattttaattctgtttgtctggaaaacatgggtcattctagaaatgatagagttcagcaaattttggttttagtttcctttttatttttcacacccggcccaaatgttcttccaacaggaattgtctttctgtttaccagtgaaaatgctatattcctatttaagtgaactctgaaacctttaaacactaattttaacccaattagtttttaaaaatgtccaaagcagtcttaactacagaatcttctaaaaggaaagatttagcataaacttttaaagtcaagttattcataccattaaactatttatttaatatttattttgagatggagtctcactctgtctccactgcagtggcacgatccctgctcactgcaacctctgcctcccaggttcaagcgattctcctgcctcagcctcccgagtagctgggactacaggtgtgcgccactacgcccagctaagttttgtatttttagtagagacagggtttcaccgtgttggccaggatggtctcgatctcttgacctcgtgatctgcctgcttcagcctcccaaagttctgggattacaggtgtgagccaccgtgcccggccaactgtttaaatcagaacctgtctattctttggccactgatatggtttggatctgagtcctacccaaacctcatgttaaattgtaatccccagtgttgtaggtggggcgtggtggaagatgattagatcatgggggtggtatctcataaatggcttagtactaacctcttggtactgtccttgagatattgagtgagttctcgtgagatctggttacataaagtgtgtggcgcttgctcaccaccttgctcctgctcttgccatgagataagctcctgcttcaccttctttaagctcccagaggcctccccagaagcagacgctggtgctgtgcttcctgtacagcctgcagaactgtgatctagttaaacctcttttctttataaattacccagtctcagatattctttatagtaatgtaggaatagcctactacagccactttttcaggaaagaatgagggaaacaaagctcttcataactttatcaccccctcccacatttaaaaccactgtgatcaatttaattccacttttgtgtgttttgttatttctcttataaagacagttgggttagcaagagttaaagcattttactgttctacgtttatactgtcctacatctaaataaacttcagctcttatgcaatacttgcttgcaaatttgctgattactcaactggaagaaatatgaggcgaggcaatcttccaccataccttttttcctttttttttggaaatggaatctcgctctgtcaccaggctgaagtgcgatggcgcaatctcggctcactgcaacctccatctcctgggttcaagcgattctcctgcctcagcctcctgagtagctgggattgcaggcacgcaccaccatgcccagctaatttttgtatttttggtagagacagggtttcaccatgttggtcaggctggtctcgagctcctgaccgcgtgatctgcccgtcttggcctcccaaagtgcttggattacaggcatgagccactgtacccggccaccatacctttcttatcttcctggcttttcagctccctttgggaatctgcgatgtgaaaaaccagggaataacgccttaagctatcttacctttccctcttttacccattgggctcaatttgtcagcagggagttcttagtccatttgtactgctataacaaaataccatagactgagcattttataagcaatgcaaatttatatcttacagttttagaagctgggaagtctgaggtgccagcaggattcgtgtctgaggtatctctacttccaaatggtgccttgttgctgcatcctccataggggaggactgcggtatccttacatacagaagaacataagagaggtactctattctggctgggcgcagtggctcatgcctgtaatcccagcactttgggagactgaggtgggcggatcacctgaggttgggagttcgcaaccagcctgaccaacatggagaaaccccatctctgctaagaatacaaaattagccaggtgtggtggcacatgcctgtaatcccaggtacaggagaatcgcttgaacccaagaggtggaggttgcggtgagccgagatcgcaccattgcactccagcctggacaacaagagcgaaactctgtctcaaaaaaaaaaaatactctattccctgaagcccttttctaaggaccctaatcccatttatgagggccctgccctcatgacttaatcacctcttaaaggttctacttctgtatactatcatattggcaattaagtttcaacatattacttttgaggaatacattcagaccatcaattccacccctgttcccaaaattcttgttctcacatgcagaatatattcattgcatcccagtacccccaaaagtcttaacttgttccagcaccatttcaaaagtcttcaaagtccagagtctcatctctaaatcagatgtgggtgagactcaaggtaagattcatcctgaggtaaatttcttttcagctgtgagcctgtgatatcaaacaggttatatccttccaaagtacaatggtgagatgggcataggatagacattcccatttcaaaagagaagaaatggttaggaagaaagggataacaggttccaagtaaatctaaaacctaataaagcaaacattaagtcttgagagtaatcttctttgacttcatatcctacttttgtacacactggggtggagttgggctccaagggcctggaaggccctgcccgttagaactttgtgagcacggcccacacagcagttctcatgcgttggagttgggtgcctgcagctcttccaggctaagatcacactctggtggctctacagttgtgagatctcaggagtggtgctgctcccgtggcctcactagacattgccctaatagggagtccttgcagtagccctgcatccgtggcttcactaggcattgccctggtgggggctatctacagtggccccaccatgtggtatttttttttgcctgggccctaaggctctctgagccatcctttgattctaagtaaaggtagccatgcctccacagcttgtgcaccctacacacctgcagaattagcaccatgtggatgctgtcaagatttatgtcttgtgccctctggagtggtggccagagctgaacttgggcccaccttagtcacagctggggtggtcaaggaacactgcaccagaattctgggagcagagacttgaggcagcctggagcagtgagcaccaaggtcaatgggcactctggggccctcccttaaaactgttctgccctcaaggctctggcattgtggacctatgatgggtgtggtagcctcaaagttctttgaaatacttttggggttattttcccattgtcttaatgaattgtatctggctttcttctatccatactattctttttatcaaatagttgcttggccatacctttagggttttcttccaaacactcttttatattctttacatggccaggctgagaattttccaaatctttatgttctgcttccatttgactataaattccatgcttaattaatatctctcttcttgcagtttattataagcagttaagagagtccatacagcacctagagtattttgctcagagatttcttctactaaatattctatttcattgcctttaaattctgccttcctcaaagcagtgggacacaaacacaattcaaccaagttctttgccattgtataacaagaatggcctttcctccagtttctaataagatattatttatttttgtataagaccttatccaaatggtctttactgtccatatttctaccaacattctattcactaccacttagattatctctaagactgaggctttctttatagccgtcctcttctaagccctcacctgaatcatctttaatgctgtgttcatagcaatatgggccttttccagcattcacttcaaaactattccagcctgtacccattacccagtttcagagccacttccccattttcaggtatttgttatagtaacacccctttcttggtaccaatttctgtcttagtccatttgtgcagctataacaaaatgtcacagactgggtaatttataaacaatagaaatgtatttcttatagttctggaggctggaaaatccagatcaaggcaccagcaggattggtgtctggtgagtgctgctctctgcttttgagatggcatctttttgctacatcctccatagggaaggaaaactaagtcttcacatggtggaagagcagaagacagtgaacccattttctgaatgcccctcccccacctttttttttttttttttttttgagacagagtctcactctgttgcccaggctggagtacagtggtgtgatctcagctcactgcaacctctgcctcccaggttcaagcaattctcctgcctcggcctcctgagtggctgggattataggcaggtgcaaccacgcccagataatttttgtatttttttagtagagatggggtttcatcaacatggtcaggctggtcttgaactcctgacctcaagtgatccactgacctcagcttcccaaactgttgggattacaggcgtgagccaccacgcctggcacctggagccctttcctaagggccctactcccattcatgagggttctgccctcatgacttattatttcttaaaggcccacctcttaattctattatattattattaacttattatgtaaaggcccacctcttaattctattatattattattaacttatgtaagtttcaacatttgaatttaggggaacacgttcagtccatagtgaggggagagtctgtgcactcttacatggctactccagaaaaaaaaaaaacaaaactcaactctctaatcacccagccttcctcaggcagcagttcccttatttgcttcctagcagtccttccaaactctaacaacagtggtggtttatctgtgccaatctcatgtctgatgccaactgtagcatttcaggtagtggaaggagtgagtacactcaaacacagtagagttccttgcttaattgtaaatgtggaatcttttgagagtgaggtgaccacccatgactggaataggtacagtgaatctcaggatagcttttgctaaccccattttctgatgacactttgctaggctgtagcccttatatacttgggacctaggtcaccattccaaaagaatttcactaatagcttctgattaagagaatgtttataagcattggatttacatctgcatttttttcaaagacagaaagttgtcagtgctcagatgtccatgaaattattcttttgccaagcttttcagcattctggaaatccacagtgctcttcacattttctgttgggatactaaggttttgttatgtattattggaattatctctatagaataagaatattacgtctttgaatatatgttgaaatagttttgcgtggtttgtcattgactattcttaaaatgagttttattagagtacaatttatatataataataaagtatctgggcgcagtggcccatgcctgtaataccagtgctttgggagggtgagacaggagggtctcttgagcccaggggttcaagaccagacctggcaacataatgagaccctatctgtacaaaaaattagccaggcatggtggcatacacctgtagtcccagctattcaggaggctgagttcagaggattgcttgggagatggaggctgcagtgagccctggtcgcaccactgtattccagtctgagcaacagagcaagaccttgtctcaaaaaataaagaatgtatatatataatatactcactgagttcattgaattttgataaatgtattcaactatataaaccatcacaatcatgatatgaacatttctttcattccttcgcccccaccaaaaaaaaattccctcttacttgcccaccttcatccccagagaactactttctgtctgctttctggcactacagattagttttgcttttgctggaaattgattaaatgcaattattgtaatatgtgctctttttgtgtctagcttctttaattcagcatgatgtttttgagccttatccgcatcatgctgaattaaagaagaacatcgtacatgttctttttttgttgatttgtatttcattttatggatgtaccacaatttgctcatctattaacctgttggatatttgggctatttccagtttggggaaattatgagtagagctgttatgaacatttatatataagtctttgtgtattatcttaattttgtgtatttgtgtattatcttaattttgtgtattatctttgtgtactatctttgtgtattatcttaattttttgtattatctttgtgtattatcttaattttgtgtattttcttaatttctttttgtatatataagtatttgtgtattatcttaatttctttgtgtactatcttaatttctttgtgtattatcttaatttctcaatttgctcatctattaacctgttggatatttgggctatttccagtttggggaaattatgagtagagcttttatgaacatttatatataagtctttgtgtattatcttaatttcttttgggtaacaccttagagtagaattattgggttgcccagtaagtgtctttataagaaagaagtaacttcaaaagaaacttctgtacagtttttcaaagtgattgtatcagccagatgcaatggctcacgcctgtaatcccagcactttgggaggctgaggcaggtggatcacatgaagtcaggagtttgagaccagcctgaccaacatagtgaaaccttgtctctacaaaaaaaatttaaaaattagccaggcccggtggcacatgcctgtaagcccagctacttgggaggctgaggcaggagaatcgcttgaacctgggaggcggaggttgcagtgagctgagatcatgccgctacactccagcctgggtgacagagtgaaactctgtctcaagaaaaaaaaaaaagtgattgtaccattttgcttttccaccagctttgtttggcagttcaagttgctctataatcttgctaacagtggtactgtcagtctttataatttaagttattcttgtgtgtgtgcagtggcatgtcattgtcatttagttctcattttctgaatgactagtgaagcacattttttatatgcttattggcctcgttaagaaacagaacattttcagtatcccagaaacctttctcatattcccttccagtgactactacacaccccactccgcaaagactaaccaccatctgacttctaatagcatagtttccctgtttatgtactttatatgaaatgaataatacaggactctcctgtctgccttcttttgctcatcattatatttatgggacttgtccatattatatttatgggacttgtgcaaaatgagattgttcattctcattttgtgaatatataacaatctatccattgatgggtgtttgagcaatctcaaatttttagctaccacaaatagtgcttctgtgaacactcttgtatatcttttggtggacacttgtatgtgtttttgttgggcatacaactaggagtggaattaatgagttatagggcagcgcttctcaaacattaacatgcatatgaattatctgggctcttattaaaatgttgattgtgaatcaccaggtctgggatgtagtctgaaattttgcatttctagcaaactcttgatgatgccgattatactcatctatgaacacactttgagggacaaagtcatagagtatgctttggtaggtattgctggagttttccagagttattctgctcaatttatactcttacaaataatgcatgagagttctccacattcttggctatacattcctgatattttctttttagccgttttggtaggttttcatttatattttcataattaatagtgagtttgaacacttttccttatgtttattggccagctggatatcctcttttgtgaagtatctgttgcaatcttctgcacaattttctcttgggttatctttatgtagtttttatttctgccattttttttactcttctttatttttttttatttttatttatttattttttttgagacagagtctcactctgacactctggctggagtgcagtggtgtgatcactgctgactgcagccttgaattcctgggctcaagaaatcttccagcctcagcctcccaagtagctgggactataggcacatatgccaacacacccagctaatatttctaatttttagtagagatgagatctcaccgtattgcccaggcagctgcttattcttttatttcttcaagctccttgtttatttattctttactcttagtgaaatctctgactgttgcttattatctgatctttactctcttgtttcaaagaatctgcatttttctgaatttagtttttttgtggtgcaattttaattaaaatttacttctatttccagttttgtttgttttcaaaactatgcccttttctgtatcttgagggttaagttttcccctttcattttgttgcagaatgttttcatagatctattattttttctttttttcttctttttattttatttatcctcatgcatggagatgtctcatatgtagaggcctgagggtggattcatctgcaataacctcactgtccttagaaactaatagtttcctttcaaatattacataagagacctggctaatataagtttacatttctgttcattgatctagaagcctgagaggagtgaacttagagcctgtcctagcaaaggagttatctctaatttcttctgtaaggaatcagttttttgctagccacaatgccagttgaatactgtagttattcatccacccttctggtatatctgcctattatttctcacacaaattttttatttctccgattattatctggtacgctgcattacacattctagggcacagttatttcagatgatcttgattagtagtggtgaaacagattccagatgagggctttcttattttttctatggctcccctattcagtagctcttgctcctcttggtaatggtgtttctgccagtgtcttctctttctctctgagtcacagaactcctttctcaggaaggtgcatcactagttggctcttggcatctttcttccatcacaataccatgtcttgcataaattcttcaacagttttgtcatatgaatggcatctagtcctagtttctagtattgatatagttctctactattttatatttgttttggcattttcattttgataagatgaaggtatgagttaaaagttcaagatacaccctggaggcagagattgcagtgagccgagatctcgctactgcactccagcctggtgacctgtctctactaataatacaaaaattaactaggtgtggtagcacgcacctgtagtcccagctacttgggaggctgaggcaggagaatcatttgaacctgggaggtggaggttgcagtgagcctagatcatgccacttccctccagcctgggtgacagaacaagaccctgtctcaaaaaaaaaaaaaaaaaattgaagatattttcttacctcaaagtctaaaaccctttaaattatttttctttttttctaaaatgctttaagtattaaaaagaaatgtaccttttctcaccataggataacagttatgcagctttctgtgacgtttggttgttcgtggtatctcagatgatgttacatttttgcaattggttgatattctataagtgggccagaatatccaaatatacatcaagaacatttatgtagatgtaaataattcactttctatagtggatcagacagatgagacactctaattgggtagctaaaatggagatctttgacctaagccttgttatactaagtgtttaatggaaagttagcgtatatatctagcttcactaatatggtaatagctctgatagggacccgaagggcttatctagcctggtttgcttttaaaactgcaattacacttttgttttgttgcacttacattgtgacttttatatgaatttcttgtctctctttcattagggactaattcccgacaatttttaaaagagattctgctttgtatttagtatgaaaatcttaaccatgtgaagccagtaataccattttatttcttctcctcatcttttctcttctctctaaagtgagtcaagactttggaataatcttttgaaagggtactaactactcacaaagagtaattttgacactttaaacctaactgcctttcccacccttcttttttcatttcctagcatattggagtcaaagacatttgccagattgtgtagactgtctttatttttagagctcttgtttactttactagatttgtagtttcgaaaaaaaagtacctcttcggggctaagttctggttggttccttttgggtatgttgaaagtttgcatcaatatgtagcttactagttatctctgatatgttctatcctcagtgtcgtaacccaaaacaaaacataaataccacagtcttaaaatattttgcactgccagtcttaaaaaaaaaaaaaaagcaagagaactttttttttgctgtgacaaaataagtcttgatttaatttatatccctatttatcatcttatcaaattacaggcataagaagcttagttatagtacttagccagacctctagattccttcttttattaagaggctatagaatttagggtcttttcaaaaacacatctttggtataagatttttttctcacagtattcaattaagtctgtactaggttcaattggattagctttacttggattcctttaaaatagtaaatcttcttattgttggagaaaaattgttattttttatatcactaatcattaatgaaagggaaatgagcacattttactttgactattactaattaaactcttcttaaatctttaatatttgggaatatttaatccttcagtggaccttattgagcagataaaatttatacacttgaaacaaagaaagtgcagttccaaaagatgggaaagatgctctagcagcataatatttttttatttaaactttttatttagaaatagtttcagacttataaaaaagttggctgggtgcggtggctcacggctgtaatcccagcattttgggaggctgaggcaggcagatcacgaggtcaagagattgagaccatcctggcaaacatggtgaaactccatctcgactaaaaatacaaaaattagttgagtgtggtggtgaacgtctgtggtcccagctactcgggaggctgaagcaggagaaatgcttgaacccgggaggcagaggttgcagtgagctgagatcgtgccactgcaaattcagcctggtgacagagcaagactccttctcaaaaaaaaaaaaaaaaaaaaaaaaaaagttgcaaaagtaggccgagcgcgtaatcccagcactttgggaggccaaggcgggcatatcacttgagatctggagaccaccctggccaacatggcaaaacctcatttctacaaaaaacacaaaaattagccagacgtggtggcggacacctgtaatcccagctacttgggaggctgaggcaggagaattgtttgaatccgggaggtggaggttgcagtgagctgagatcacgcaactgcactccaggctggatgacacggtgagactccatccaaaaaaaaaaaaaaaaaattgcaaacgtagtataaggaatgtgtttataccattcacccagctttcccaaatgttaacatttagcatagaatggtaatccaaaccaggaagttaacactaacacaatactactaactgatctacagaccttattcaaaatttgaagttgtcatactgtgttttttgctggttcaggatctaacctaggattccacgttgcatttagtttttatgtcttcttgggttccttccatctgggatagctcctcagtctttatttttttttttttttaataactttgacacttttgaagagtactagccagttaccttgtgaagtgtctctgaaagacagaagagatgttcagttcattatctcaggaggtatatgatattgatatatcttgttactagtaatgttaaccttgatcacttggttaaggtgatatctgccagtttgctccattgtagttactccttttccctttgtaattaacaactatgttgccagaagatattttgaagtatgaaaataccttctttctcacaatactcttgtccactaattttagcatcaattggtgattcttgcctgcaacagttactgctctggtgtttgccagatggcaatttcctatttctgtgattccttctgcatgtactaattggaattctactgtaataaagggctgtcccttttcccttatttatttatgtatttatttgattctatcagtatggactcatagatgctcacttcattctgtaggttatccatcactatcattatctatcactatcactaatctcccactgatcacttttctttagtcttttagtctctagcagcatgctatcagttagaatatcagggttcttactctaacttcctatgtgccatgaaattcacctttaggcaaaatattcaactattgttaccctgagtgccctctctcataaaatgggaataatacctgcttgtggtatataaatagatttgtaaactatagaatgtgatacatatagtaatattgtcattattttattgctaaatgccacaataggtattcagagaacaggggctcttttcaggggctgacttaagaattaattcttttagagtgtccacttatttctatagggaggcccaagaatgaaagtggagaggaacagttgtatggagatgaaaggcagaaggaagccaaaagtaagtcacagaaacacagagcagcatttattttcacattctgctgtgtacagtaaataattactgaattccctagaatatcatgcaatagtaatctatttctttgactattagttttgaaaattcccttgtttcatgtaacaaaatatttttaaattaaatgtggcatatgaaaacaacattaacttaatttttcctgaacctcaagctattgtttgatttggaaatgttatctctggtgtactttaaggatgtgtgaagcacacaaaaccataaggtgttatgaatgttattactcttgtttttttttttccgagtttgctttgtgagtctttttagatacctatgacaatactgtgtacagaagtccttgatgtgactttttcctcattaaatttctgaatcaatacatacatccactgcccgagatcatttgtttctccatcctctttgctgtaggtatttggaggatctgttgaatgctaagtttgtgatttaaggtaggggtgtgtgtgtgtgtgtttccttttttatgttttattttgtctttggggatgagagttttatttcttcctgtcacaacaattgggcaaaaaatagtagactaaactgctaagtaggtcgacctgcctgagcaccatgaggtggcaaattctaataagatttcctgacttcagcagttatcagtgatgggaacagggagtagaaatagcagtatttgaacttcaaatatccagggaagaataaatgagtttctgctttgttcaacatttgtaactaaagaaagattttacacctttttctatttcattttaatgaatattaccaaataaaggcatgaaaccagaattaaagaataagatcacagtaaattattatattaatggatttaggctgtgtagtaggcaccttctgtattctctaatacagtaaaagattagaaatagccttgcctccttgttgcatatgtgtataaaagtgaacgttaggcgttgaagctattaagggatactattttgtgtcagttattttggagatggatgttttgtaaaatcctcttagacattaaaatcaacaaatgctttgaatgaacttcagacctttggctttagcttagcttttggtcataggctggaatttcattttttgttgttgttgttggtctttggctactgacttgtttgcagaatggtgctcagctaaactcttccccatgtcattggtctaccaagtatcttaaaactctccagataacaatggcaagcgcattggacactgtaaagaaacacctcttaaggcgttaacacttctgaatgaattactccgattcctttaggttggtgcaaaagtaattgcgattttgccagcagaaagtgcaattacttttgcaccaatctcataattgacctgaaaccagttatgaggaggcaagtattatggaaaaatatttttcattcctgcaaggtcatgtggagagtgttttaaatagcaaagtcaagtacttattcaccagaatccagtttgatcacttgctgtctaattagtcttttgtgttaaatctttcagtttggttgagggacaacagggtagttttcgacaaatcatattaaaaccaagtagttttaacatttgagttccctacatctttattaccgttacctcagtttagtcctcattatctcttgtcagggttactactgtaatctcccactgatcactttctttagtctcttattaagtctgtactaatatctgaataatcatttaaaaatacaagtctggtcagataattttcttgcttccagtttcttcaaagctcccaatcgccttagaataaaaccaggctttcttagcatggaatgcaaggatcttagtgatctagtcatggcctgacttttcagtcctgtttccttacaacttcccccaaatgacttgtgggtccctgaaaactctgcagttttgcttttcacccttgcttttaatgtttctctgcttggcgtgttattgtattactgactagctcctatccatgctttaagacacaatttaaattttagaaacttttaattatggatattgtccaaacatacacagaagtagagagaataatataataaaccccatgcatccatcacccaactttagagtatcattttgcaaatttttcaaccatgatttttttttccaactcagtcttcactggagtcctccatgacctctctaagcaaagtgagccactcttttcctgtgttctctttagcaccttgaccatcctgctattagaatgcctgcaaatataattcctcatttacctgtctctccctctacaatgtgaatcctttagggtaggtaccaagctcttttcacctgttctctatgcctagcatagatgccaacacatcataggtgttaaatatatgtgaatgaaagtaataacctcttatcttcttcatccccacttgctgtcaccctttctttccttcacagaaatagcaaaaaaaaaaaaaaaacttgtttccccaaagaaaccagatacgacaaaagagtgtgttatgtatgcacatgtgcatttatttttactttttcaagaaaggcaaaactagtctatggtgatagaagtcaggatagcagtacctttggcagcaggtgagatggaggcattgttcactggggagagatcacgcatggaggagccttctaggttctagaaatgttctatgttgatctggatggtggttaaatatatgtgtgtataaaattgtatcaagtggtaaagttaagatatgtgtataatactttgctgtatataagttacagctcattttttaaatgtctgtttgttttttaaagcctgttctcttcaattattgttttttttttttttttttcactgctggtaacatcattttcttgattacccaaattgcaaaactgggagtttctccagacttctcccactccctcctctgaactctgatgaatccattttataaatagcatttgatctttcccttcttattcatccttagaacctctgcccccaggatatggaccagcctgtgatgggcccactttgtgtcaggtgtccccatggtcttatgtatttagggaggagtcatctggcttactacccacttaacaggagttgtgagtgggacatggctcaaaggccttgtttgggaaggcagtgattcacatcacttatatacagtatgtgagaatttaaggcatatccattaagccatttttagtacctagataagtgtatccgtgtaaatgaggttatggtatttgaagtaaaataacacaatttttgctaactgtatattttattgcagcacatctatgaaggtgtgccattcaatctcattggataaatgttaactaaagtttaaaagaaacaagtttttattacatgtagtgtggaaacgtgtagcacaatttaaggcaaggtgcattttacctaagtatcccttgtcattcttcttctattgaaggaaacgtggtaaaaataaaaagccataggaaggttccaaatggtgataagagtttatcctgtgagccttttccagttttatcagcagcagcagcagcattattattttaggcagagtctcgctctgtctcccaggctggagtgcagtggcaccatctcagctcactgcagcctccgcctcccaggttcaagagagtctcatgtctcagcctccaaagtagctggaataacaggtatgtgccaccacacccagctaatttttgtatttttagtagagctggggtttcgtcatgttggccaggctggtctccgtctcctgacctcaattgatccactcacctcagtctcccaaagtgctaggattacaggtgtgagccaccatgcctggccaccagttttattattaaagaaggacagaattgactcacttttaagcaagctgattttatgtttggttcttgagaataaatgtctcatcaaataatcagaacagatacaaggatgcaacgatcagaacagtgaatacttaaatgtgtgcagttccggagtagagtttattttcttatgtaatgacatttaagatcatattcttctgaaaataaactcagtatttaagagagttgcattgtggaaaatgcaactcaaagagttatgagctgggcacagtggctctcgcctgtaatcccagcactttaggaggctgaggctggagatagcttgagcccaggagttggaggctgcagtgagctatgaccacgccactgcactccagcctgggcaacagagcaagaccttgtctcttaaaaaaaaaaaaatgacagaatgccaggaattttagatacagaatgtaacatttgtttactttgtattcttcatatcattgttaaataacacatcttatagaaaaaaaaatataaaagctgaggattaaatttccatggtaacatcaccttattacactacagttgatccttcaggatgcaggggttaggggcaccaaccccttgcgcagctgaaaattcaggtataaattttgactcactgaaacgtaactaatagcctaccgttgactgccttaccagtaaaataatttttaacacatattttctatgttacatgtattacatactgtattcttatgataaattaagatagagaaaataatcataaggaagagaaaatacatttactttttattaagtggaagtggatcatcataaaggtcttcattgtcatcatcttcatattgaataggctgaggaggaggagtaagaggagggattggttttgctgtcttatgggtggcagaggcagaagaaaatctgcctatacatggacctgcacagttcaaacctgtgttgttgaagggtcacatgtaattagttttagattccatttaagtaagttttagtgctaaaattgttcagagcataaatatttgaaaattttatgttgattttatggaacctggcacattctttagaatcctgttacctccaaaacttatttgtaggctattatttgcataaaggacaatatttttctatgcatgcttcaattcttactgaattgattgcattgattagcgaaatacagattaaaaccccaatgagataccactatatatctattagaatggccaagattaaatgaactataatacaactgtttgcaaggatgcagaataaatggagctgtcatgctttgctgttggaaatgcaaaaggatacagccacttggcaaaaaatttagcaatattttgtaaagttaaacagtcacttaccatatgacccagcaataaaggctcttaggtatttattcaagagaaataagttactttcacacaaaaattggttcacaaatgcttacagcagttttattcattatcacgccaaactgggaaacaatccagttcatacgttccccagtgtttcaactgagttgtggcacacaactcatagaactgtatactaaaaagggtgagttttactgtatgtttatacctcaacttttattgaggtataacttatacttcaataaatctgacttaaattttttccgtatcttttaaggatgtaactgaaatatttacaggaaaaaaaagtgatacaatacctgggatttgcttcaaaattatctggcagtagagatagggataaaataagattgatcatgaataaattatagttacattatggggtgggtacatggatgttcattttatttttctctctactttcatacatgcttgaaataagcaacattaaaacaaattacaggttatctggcagatgtgaaatgggatctcatgttttaaaattttattttcctgtttataatgagttttagcatcttttcttattggcaatttgggtttcctcatttatgaatttttgtttttgtcctgtgcccatcttcctactagcttgtttggcttttacttattgattttagacctttatatattctgaataccagtcctttgccaattacacaggttgtaaatcttttttcccagtctgttattggcttttcaattagtttatgttagcttttgttgtatataagttttaaatttttatgtagatgaattatgaacctatttatttatgcttttatatcttagaaattctcccataggaattttttttttttttttttttttttttgagatgggagtcttgctctgtcacccaggctggagcgcagtggtgcaatcttggctcactgcaacctctgcctctcaggttcaagcgattctcctgcctcagtctcctgagtagctggtactacaggcacgcaccaccatgcccagctaatttttgtatttttagtagagacggggtttcaccatgttggccagatggtctcgatctcttaacctcgtgatcgccctcctcagcctcccaaagtgctgggattacaggcgtgagccactgcgcccggcctgaaatatttttatatttctttgtttttcacatttctctaacccttctggaatttatctttttgtataggaattcaatatttttttcatattgattaccagttgtccttatactaacctttcctactgatttggaatgcaacctacagttctttaccactgggctccctactgatgttggatcccttcctggaccatgttcttgtttggcaagaggaatcctagcccctccttcctgcccatatgatcagaagttgctttttctcctctgggtttctttaggagtagttatagatttatgctgctttggctttgcttctcttccaggtttggaaatgggtcattttaaactttttctcaggaatatacttggtggaggttggggtagagaggagcaggcaggctcaagctacagattttatatgttgaactggtttggaatgagtcttttaaattatttttgttacttattaaaaaaaattgactattcatgaattataagttgtataaaaaattttgtgggttttgttttaatgggttttgtttaaaaatatagatgttttattggattctattttaatttgggttaagaaaccctgaaccttgggttgcttaaatttctgcaataataaacttgcatcctcttctctagccaaactaaattacattctattccttgttcatgccatgttcctctagtcctctgtacctttgcatttgctgtcctcacaagtgacctttttttttccttatctgcttgggaaacatgtacatgtttctgtttatcttcttcactagtctgtgagctcttactatgtcttatttatcttttaatcccattaactgtgcacagcacctaaaatgtagtcagtgccctgtaaatgtttatgtgcaaccttagattcactatgtttgtgatgttcttcatgtataaaagttttaaaccttttctataatttagtttgacatttggtcagtgtaaatttaccagtttcacacatgtggattgttattggtcaggctctaccatgtgtactcaacctgttggcccctaatttgctaaatccaccaagattcttatgaaaacagttttttgtccaattggcccgtatgtagatttttctacgcatccctttggcacaagctagttaggatgcttttctgttctaccaatgccctttcccctgtgtagggccttttcttatccaacattcaactgcacttctccttccttttttttttgtttttgagatggagtcttgctctgtcgcccaggctggagagcagtggcgcgatctccgctcactgcaagctctgcctcctgggttcacgccattctcctgcctcagcctcctgagtagctgggactacaggcgcccgccaccatgcccggctaattttttgtatgttttagtagagacaggatttcaccgtgttagccaggatggtctcgatttcctgacctcgtgatccgcctgcctcggcctcccaaagtgctgggattacaggcgtgagccaccgcgcccggcctgcacttctccttcttaccctggttatagttggtagaacatttcctgattacaccctgattattgtagctattgtgatgtcatgctcttagtttgaaaggctctcttctttttattcctactaatggagcggttgaagagggcacgcctgcacgtgtggtctgcagagcacatcctttctgaactgacaggaatggagatgccccctgcttttttttcctttttgtaaacaaatgttttcatattgatttagccattttatacagaaagcttctataaaatgttattattacttatttatggaataggctccataaatgaaaggttaaaaaaagctttgttatttcttagaagataaaagctttactttttttgtatctgatcttttatcacatatattttctaataatggaagatagtgagaactgagaaataggttctgagttgtgacccttcaattttttaaaagctctgttatgttgtcttggttctgcttttaatgtcacttagtattgtctaaactgtactgaaatagcaagaggtggcattatacctaactcagctggttcactgtgctgttataattactaatacttatgaaatctaaaaattgaaagtttaaagagatgcctgcagtgctgataaaacgtggctgaagtgccactagaaatgaatgcaagtagaagtgctatatataataattcaggaattaggtcagaaattgttaactataaacaatgtaaatatgcttggtttgctgaggattatagtttaatgcagccatatatatgttcatcaacactaagtgcaatcatttgtagaaccattattacaactgtaaatcttttggggggataagtgtaaatgaatgagttttataagtctcatctctatactcaagaggcaaataactctatcaaacttacaggaccctttgaagattaagagcaatacaagtctgagagaaggtacttgtataaatttgtgtgctgacattctggccttagaaaggatttttaaatcaccaaagaaaagatcaacatatattaactacgtaaaagtagaaaactttggtatatcaaataaaatccatagccaactaaaaaaaattaaagtcttggagtgaaaaggccttgttaaataagatagaaatgctcagaatctgtaaaagaaaagattgataaagcttgctacataaaaaaattcaaaactttctgcatggaaaaaataccataaagttttaaaaaaagacaaatcaactcaagactaagtgttcatttcctgtgtatataaaggatatctacaattaataagataaattataacccaattaaaaatgggcaaaggatataaacagactgtccacagaagtggaaactatgtatatataacttaaataaaaatatatcacatatacatttttgcttgcacatgcatagggtacatctagaacaagattgtccaacatgtgggccaggatggctttgaaagcagcctaacacaaatttgcaaactttctcaaattatgagattttttttttaaagctcatcagctatcgttaatgttagtgtattttatgtgtggcccaagacaattcttcttccaaggtggcccagggaagccaaaagattggatacccctgatctggaggctttataagaatttggtaaaatttcagtggttatccctagggaggggacctaggtggctggaggacagaaatgagaagaggatttactttctaaaatattttttaccttttgattctgtacatatgtattaaatattaaatagacactatatatgggtacacatgtatgtgtacatgtacgtacacatatatagtgttttatgtgtatatatgtatttttaatgttaaaaacctagaaacaatctttagagcacagaatgacaaatttttgttttaacaaagagctcacacaaattaaaagcagcaacttataaataagtaagcaaatgaacaaacagttcacaaaaagaatgaataaacagacatacagaagtatgttcaatctcagtagcaatcagaatgaagcttggacataaccttctcagaaagccatttccaagtacctagggtcatgaatggcttttatgaatcctgtctgtataaacgaggtggatgctaaggtcaaggttagcgccatttttggtgcatccctacagcatcttgtatttgctgtgttgtggcacttaatcataatcagtggcttttgttggttggttgttcttcttgttttctgtcttcagctctaaactacaagctctctgaggtcagagattatgtcttctgttattttttccaagtctgccatcacatctggcgtctgtttgttgaatgaataaatgaatagagtaaatagatagtaatcaaaggcatagaaattaaagtaaaatattttggtttatttaataagggaaattaaattttaatatattgtgtgttgataaaaatgtaatgaagttagtatgttcatttactgctggtgacatagcacactgtttttctaaaatgttttcttcatctgccagtatatatatcaagactaccctctaccgcagcacagtttctttttttttttttcttttttaattttttttttaattatactttaagttttagggtatatgtgcacattgtgcaggttagttacatatgtatacatgtgccatgctggtgagctgcacccactaactcgtcatctagcattaggtatatctcccaatgctatccctcccccctccccccaccccacaacagtccccagagtgtgatattccccttcctgtgtccaggtgatctcattgttcaattcccacctatgagtgagaatatgcggtgtttggttttttgttcttgcgatagtttactgagaatgatgatttccaatttcatccatgtccctacaaaggacgtgaactcatcattttttatggctgcatagtattccatggtgtatatgtgccacatttccttaatccaatctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcccgtttctccacatcctctccagcacctgttgtttcctgactttttaatgattgccattctaactggtgtgagatggtatctcagagtggttttgatttgcgtttctctgatggccagtgatgatgagcattttttcatgtgttttttggctgcataaatgtcttcttttgagaagtgtctgttcatgtccttcacccactttttgatggggttgtttttttcttgtaaatttgtttgagttcattgtagattctggatattagccctttgtcagatgagtaggttgccaaaattttctcccattttgtaggttgcctgttcactctgatggtagtttcttttgctgtgcagaagctctttattttaattagatcccatttgtcaattttgtcttttgttgccattgcttttggtgttttggacatgaagtccttgcccatgcctatgtcctgaatggaaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtcccatgctgttttggttactgtagccctgtagtatagtttgaagtcaggtagtgtgatgcctccagctttgttcttttggcttaggattgacttggcgatgcaggctcttttttggttccatatgaactttaaagtagttttttccaattctgtgaagaaagtcattggtatcttgatggggatggcattgaatctgtaaattaccttgggcagtatggccattttcacaatattgattcttcctacccatgagcatggaatgttcttccatttgtttgtatcctcttttatttctttgagcagtggtttgtagttctccttgaagaggtccttcacatcccttgtaagttggattcctaggtattttattctctttgaagcaattgtgaatgggagttcacttatgatttagctctctgtttgtctgttgttggtgtataagaatgcttgtgatttttgcacactgattttgtatcctgagactttgctgaagttgcttatcagcttaaagagattttgggctgagacaatggggttttctagatatacaatcatgtcgtctgcaaacagggacaatttggcttcctcttttcctaattgaataccctttatttccttctcctgactaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttatcattttgaaatacgtcccatcaatacctaatttattgagagtttttagcatgaagggttggtgaattttgtcaaaggctttttctgcatctattgagataatcatgtggtttttgtctttggctctgtttatgtgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaagatattggtctaaaattctcttttttggttgtgtctctgcccggctttggtatcaggatgatgctggcttcataaaatgagttagggaggattccctctttttgtattgattggaatagtttcagaaggaatggtaccagttcctccttgtacctctggtagaattcggctgtgaatccatctggtcctggactctttttggttggtaaactattgataattgccacaatttcagctcctgttattggtctattcagagattcaacttcttcctggtttagtcttgggagagtgtatgtgtcgaggaatttatccatttcttgtagattttctagtttatttgcgtagaggtgtttgtagtattctctgatggtagtttgtatttctgtgggatcggtggtgatattccctttatcattttttattgtgtctatttgattcttctctctttttttctttattagtcttgctagtggtctatcaattttgttgatcctttcaaaaaaccagctcctggattcattgattttttgaatggttttttgtgtctctatttccttcagttctgctctgattttagttatttcttgctttctgctagcttttgaatgtgtttgctcttgcttctctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtatccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaactttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctatattgggtgcatatatatttaggatagttagctcttcttgttgaattgatctctttaccattatgtaatggccttctttgtctcttttgatctttgttggtttaaagtctgttttatcagagactaggattgcaacccctgcctttttttgttttccatttgcttggtagatcttcctccatccttttattttgagcctgtgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcaatggtctttacattttggcatgattttgcagcagctggtaccggttgttcctttccatgtttagtgcttccttcaggagctcttgtaaggcaggcctggtggtgacaaaatctctcagcatttgcttgtctgtaaagtatttaatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacccgacctttctctctggctgcccttaacattttttcctttatttcaactttggtgaatctgacaattatgtgccttggagttgctcttctcgaggagtatctttgtggcgttctctgtatttcctgaatctgaacgttggcctgccttgctagattggggaagttctcctggataatatcctacagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacatagttcttgagccttggttttcagctccatcagctcctttaagcacttctctgtattggttattctagttatacactcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctactttttgtctttgatgatggtgatgtacagatgggttttcggtgtggatgtcctttctgtttgttagttttccttctaacaaacaggaccctcagctgcaggtctgttggaataccctgccttgtgaggtgtcagtgtgcccctgctggggggtgcctcccagttaggctgctcgggggtcaggggtcagggacccacttgaggaggcagtctgccggttctcagatctccagctgcgtgctgggagaaccactgctctcttcaaagctgtcagacagggacatttaagtctgcagaggttactgctgtctttttgtttgtctgtgccctgcccccagaggtgaagcctacagtggcaggcaggcctccttgaactgtggtgggctccacccagttcgagcttcctggctgctttgtttacctaagcaagcctgggcaatggcgggcgcccctcccccagcctcgctgctgccttgcagtttgatctcagactgctgtgctagcaatcagcgagactccgtggggtaggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgccgcgccctgcttcggctcgcgcacggtgcgcgcacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccccgccacagcacagtttctaacctttgacccaattctatttctccaaatctgtcttaagataatttaagatacaaaaaaaagtatacatttaaaaatgtctgtcacaatgttattcctaatagggataaagtggaagtattcataatgggcaacattaaagtaatggtttttacaaatcgttggttctatatgataggcattaaaaattataatcctaacaaaaaggtagcagtttgaaaaaaacgcttgtgctaaaataatgttaagacagcaaaattcagaatataagtatactttaataacaatgataaaatataaagaaagactagaagaaaatactttaaaaggagaaaacaggaaggtatatttatctgctgtaattggcataagtttaagtacagtggctaagactcctttctcaaaagtgctctaatgggcactactgcctttaacactctgattttttttttttttttttttgagacaaggtctcactctgttgccctgttgcccaggctggagtgcagtgatgccatcatggcttactgcagcctcaacctcctgtactcaagtgatcctcctgcctcaccttacagagtagctgagactataggcatgcaccacaatgcctggctaatgttttgtagagattgggtgtctctctgttgcccaggctagtctcaaactcctgcatcaagcaaccctcccaccttggcctcccaaagtgctgggattacaggcatgagccaccatgcctagccagatttctttttctttagatatatttaatacatccaaataacttattgtattatcttttatcttttggtaggagtctgggagatttctccaacagaacaatcatatgattatttttaaaataaaaatgtttacatattccagcaaacataatatccatattcttacgggttgctgcagttattgtattggtgatgttgcttacaaattttcaaggtattttggcagacaactcttgtgggcttttagggcctgaattgtgtctctgcccatattcatatgttgaagccctagcccacaaagtgatggtgtttggaagtgggggcctttgggaggtaattaggtttaggtgaagtcatgagagtggagcctgtgatgagattagtgcttttataagaacaggaagagagagaaatctctctcccttctcttggtgcatgcactgaagaaaggccatgtgtgagcacacagcaagaaggcagctgtctacaagccaggaagcaagccgtcaccagacactgaacctgccagtatcctgatctcagaactcccagcttccagaaatgtgagaaatgaaatatctgttgtttaagccaccctgtctctggtatttgttatggcagcttcaactgactaagatatgggctaacttttatgaatataggatgtgttgaaggcacatgatagctacttttatattttgcgcataatccattttactaacaaggaactgaacatgaaggccagtctctagctttttctttttttttttttggagacagagttttgctcttgtcacccaggctggagtgcaatggcacaatctcggctcactgcaacctccgcctcccaggttcaagtgattctcctgccacagccccccaatagctaggattacaagcacctgccaccaggcccagctaatttttgtatttttagtagagacagggtttcaccatgttagccaggctagtctcgaactcctgacctcaggtgatctgcccgcctcggcctcccaaagtgctggaattataagtgtgagccaccttgcctggcctctagcttttaactattaataaaattaaggttctgattgttagtgttctaagcatctgggggttttagaaagatactcgccaccagcctgaaaataacccaccaagaacttttatgatcttcaaaagtctagaacaagagaaacaaatttcacacagagttaaatggtaaaaatcaaagccaaggtatggaaagatctcccaaggagataagattgctcccaggctgagtcctgagaagtaaattgagataagtctgcagaaccttggaggttgtattgatgaatgcggtactccatgctatgaagtaagacagcattctgggccaagtcttactcaaagagaggtgctataaagctataaataatttttatactcttgttacccaggctgaagtgcaatgaagcagtctcggctccctgcaacctctgcctcctgggttcaagcaattctcccgcctcagcctcccgagtagctgagattacaggctcctgccaccatgccaggcctattttttatttttagtagagatggggttttaccatgttggccaggctggtcttgaactcctgatcggaggtgatctgctggccttggcctcccaaagtgctgggattacaggcatgagccactgtgtccagccatgtaaaggatttttatatgctccaaagttggagtattttgtaaaacactccatcgatttcattcatcccaaaatgtgtactggggaaggtgaggagggagttgagagaacctcactaggacacaggcttgttctgtgtccacagacccctgtcttaagaggtttcaggtcctagaatgtctttatgatttcttggctgtttatgatcttcaagtcttttatttagcaattaggtatgcaagtgtttatatacttcacccttcccacttctttgtaggtcatataaaagatttagtctttagcttgagagaaataggaagctattgaagaattctaagcaagggagtgacagagtcagttacgtttttacataaaaaaggtatctctcaaacaaagaaaaaaaatttttttaaaaggtatctctcacagtgttgtggagaagaggaagagtgggcaagaagatacatgaagcctacttaggaggctgttttagtaaataaagaagatgacagcttggactacaatggaatagatttatttaaaagatatttaagagcaaaaaccaatcggacttagtggtgttttagaagtgagggggggaaagagaagtgaaggaaaactttgaagtttctggtttatgcaactcaactgaaggtagcctcatttactgaagttagggactttagagacgagccaggcctggcagcaggcatgtgtgatgaccaccgccctggtgtcagacagtttgaattggaggtgtttttgagacactcaagcagggatgtcagttccacttgtcctcatttactatttaacaattagcccttctggttctttgaaggtcagagaaggctgtgctagagatatgatttgggactcacagatatttaaatagcaattgaaactgtggatctggtgaccatagcctgggggagggtaaaagaatgaacaagggaaagaggaggttgaagagaataagatcagagtaggcaaagaaggaactgccacatgtaggaggaaaactaggaaagggtgtgatcataaaagccaagacaaatgtttcacaaaggaagcagtggttaactatgttgaatattgccgatgctgataaaacatttagataaaaaaccaatttgttaattgctatgttaaatgaggagatgtggagtttttaaaatggcatagcaattagatagggaaatttggataatgagcagttaaagaaatgaattacgtttgctattatacttcttaagctgagtattaaactctttgtgttgcaaataacagaaacccaactcaggttcttttaaacaaagtaaataacttattccttcatggatttgaaatatccaggataggagtggcctccagcacaactgagtcaggggcttaaccaatattgttagctgtgtctctccctgtctctgcctctgcctctcagctccgttttcctctggaaggatctctctggtggttcctggccacatcaggcttttctgatccttacaataaataaccctaatggaaagagagctcctccttcctagttctagcaggagtcccaggatttacttaaattttactaatttaaatcacatcctttttcataacctaattactttggtcagaagtaattagatatgctgacaggccaggcctgaatcacctgctcacccctggaggtgggccaggtgaaaagtagccttgtctgaatcacatgggctctgaatagggggaggggtgatctcccaaaggaaaaccgaagaatgcatgctggggatacaaaaacaacagacagctattttagcggtaaaaagaagcctttggcccaatacatttgaataactgcttctgcaatatactttataggtaatcttttgacctaaaggatgaatggatgtatttgttgttataactttaaaagagctacagggtctgatttttaagactaaagaaaggttgtaattatttttgctgcatgtgctgctaccgtggggctgaatactaactaatcttaaagacacattgaggccaaaacaagcccatgaaaaatgttcagcatcagtaatcattagagaaatgcagatcaaaaccacaatgaattatcacctcacacccattaggatggctgctataaaacaacaaacaagcgaaacagaaagtaacaagtgttggtgctatggtctgaatgtttgtgtccccctaaaattcatatgttgaaacctaatcctcaatggaatagtattataagcattacatagtattaagcacccttaagaggtgattaggtcttgaggcctctgtcttcatgaatgggattaatgcccttataaaagagaccccagagagctagctagccccttccaccatgtaaggacacgatgagaaaatgtcatctttcaaccagagagcaagccctcatcagacactgaatctgccagcaccttgatcttggacttcccagccttcagaactgtgagcaataaatttccactgttcataaaccaccagtgtatgacacttttattatagcagctagaatggactaagacagttggcaaggatgtaaagaaactggaacccttatacactgttgatgggattgtgaaatggtgcaacctctctgaaaaacactatggcatttcctcaaataattaaaaatagaactactatctgattcagcaatcccacttctgcatctatatccaaaagaaggaaagcagggtctcaaagagatattcgtacactcatattcatcgcagattattcacagtaggcaaaaggtagaagcaactcaagtgtccatcagtgggtgaatgagtaaacaaaatgtggtatttacgtataatggaatattatttatccttacaaagcaaggctgtcctgtcatgctacatagatgagccttgaggacattacgctaagtgaaataagccagtctcaaaatgacaaatactgtatgattcctcttatatgagatgtctaaagtagcgaaactcatagaaacagagtagaacagtcatactaggggctgggggaaaggaaaaatggacagttgttatttgatgggtatagaatattagttttttttgcaagatgaaaaagttctggagatctgtcgtataacactgtgaatgcatatataatatcactgaactgtacagttaaatatggtaaagatagttttatatgtgtatcttaccacaatttaaaaaaattcatgacacattgactgattcaacaaattacataaatagatggtccttatggactaattgtatctcttttttttttcgttttgggttttttgtttgtttgtttgttttgagatgatccctgtagcccaggctggagtgcagtggcacagtcttggctcactgcaacctctgcctcccgggtttaagcaattctctgcctcagcctcctaagtagctgggattacaggcgtgtgccaccacacccggctaatttttgcatttttagcagagacggggtttcaccatgttggccaggctggtcttgaactcctgaccttgtgatccacccaccttggcccccaaagtgttgggattacaggtgtgagccactgtgcctggcctattgtatttcttaataaggattggtgcacgtatccaaaggcaaggggttttcaggggttgaatttgttagaagatgtacctagcaccccatcacgaacctccctgccccattttgccctggatatgcctctgaactatgtggttgttgtactttgcagtggtattaatagatttgtatgattaaccttatttttcctggttctcttttaaatagtccatttgtgttatcagtaactatcttttaaaagagtatttctaaatctttctaggagtttgcaactcattatatttgtttattagaaattaacccacactttcttttgccatagatgggattgctgttcttcattttttcattaattcatcaaacagacatgcctattgaatgtcattcttgagatacagaggtttgtgacatagactttgctctcaggaatctcacagacaaggcagatatgattcacaagacagggtaggaagtgctgtgacaaaggtgtgcacaagatgttacagggacatagaggatgagtatctctttcaggatgggccagagtataaagaaagtcttagcagaggtaatgactgggttaaactttattttagcattaaaaatacttaagaaacggacaaatccacaatcctggtgagagacttcaacacacccctctcaatagcaaatagaagagcagagaaaaatcagtaaagatgtagaagatgaaacaaaacaacaactgacatactgaacactgtacctagaatgacagaattcacattattttcaagtacacatagtatacataccaaaattgaataattgttggcctaagctatgcttgaggaaattctgtagttgtacaagcatattagaaaagatgtaagagtgaaaatcaaggatttaaacttctatctcagattgaaaaagaacagtaaatcaaacctaaggaaaatagaagaaataaagaagagaaataagtgaattagaaagcaaatgtataacaaaaaaaatcaagaaagcccaaaattggtactatggaaagattagtaaaattgatgaacccttacaaagactaatttcttgaaatagagaagatataatattaggaatgaaaagggggatatcactgtagagcctacaaacattaaaagaaggtatttttatcatctttatatcatgtatttgattggatgaaatgcacaaatttcttgaaaaatacaacttaccaaagctaacagaagaaagaatagaaaatctaagtagtaaaatgtatattaaggaaacttgtttctgttatttaaaacctttccacaaagaaaactgtaggcccatgtaacttgtctggtgaattccttcagatgtttaaggaagaactcagatttttctagataatagaaaaagggaatagttcctaactcaaattgaacacataaaatgaacagtacattacaatgaattgggtttctttaaagtatgctagggtagcttaatgtttaaaaatcaatgtgtttcaccacattgacaggaagtagaaaaagtagatgatcattttgatatgaatttttagcttagcagaaaaggcccttttcaaagaatctgcctgtcctccagcctcctctccttccctgtcatgtatacacacactccttcagccatatatggaatggtttgcacttctgaggcatggcatgttatttcttgcctctctgctttcacatgtatcatactacctgcttctttactcagtaacttacacttgtccttcaagtcagtttaggattcttggaagatgttgccagcatagtctttcctccccctttttccatctttattgagatataatttacatgcaacgaaaggcatctgggtaactaccaccaccacaatcaatatgtagaatatttgtattacccttaaaagggtgctccttctctataaatattccccacattgatctatctgctttccgttagtgtagattaaattcatattttgtgaggtttcatataatctgtattaactcttttgtgtctggcttttttcactcagtatgtttttgagattcacccatattgttgtttgtatctgtagttcattttctctaactgttgagttgtatatcactatatggatataccacaaattgtttatccaatacatattcatggacattagagtttcttctagtttttattaagaataaaacggttataaacattagtattcaagttttgtgtggacatattttcatttcccctaagtaagtacataagagttaaattgctcagtaatattgttggtatattcttaactatgtaagaaaccaccagactgttttccaaagtggttgtaccattgtacacaccaatcagcaatgcatgagtgttctgtttgcttcatatcctcagcaagacttgctattgtcagtctctttaattttagccattctgctgggtattggtggtatgtcatgattttaattgatgtttctctgatgaattatgttgagtatcttttaatgtgtttattggccattagtattatcttcctttgtgaagtgtctgttgaaatattttgcctattgagttgtctataagaggttatatatatatttatgtatatattctgaattcaagtccttcatcagatatgtgataaaagaaaaacttcagccgaattaaatttaaaggagtttaattgagcaatgaatgattcatgaatcaggcagcccctagaatcacagcagattcagagactccagcacagccacatgatggaagaagatttatagaccaaaaaaaaaaagggggaaatgaggtacagaaattggaagtgaggtacagaacagctggaatggttacagttcagcctgtgccttattggaacacagtttgaacacacagcagtgaatgaatggttgaagtctggccgctgggactggccaagacttagctattgttacaggtgcatactactaagttaggttttcagttttgtctgcctatgaagctaggttacagttcatccacaaggacacaaatgtagaagtatggagtccttctcaggccatatttagtttgctttaacgtatatatgttgtgaatactttttcttaatctgtggcttgctttttcattttcttaacgttgcctttggaagagctgatactttaaattttatgaagtctgatttatgaaatgtttcttttatggttcatactttttgtgtcctctgtttctaccccagggtggcaaagattctctcctatgttttattttagaaattttatagtttcagctagtacatttaggtctatgatttatttttagttaatctttgtgtatgatgtgaggtaagggtcaaggtccccttcttcccaactatggataatttgattgtcccagcaccattttttgaagagattgtacttccttcattgaattattgtggcacttttattgaaatcaattgaccttgtacaaggggtcttcaaaaagttcatagaaagtatattgtgaaaaatctatacaaggatttcattttttttgcaccaaaataaacatctactaacttgttataacatgtctgaacaggatctaatttgaggcactaagaaagaggagacatcagtttgaaaacaacccctattagagcaacatggattttgctaaaattgaagaaagaacaaacatcacatttatggtgaagcttggatggaagaagagtgaaatcaatgatgctttatgaaaagtttatgaggacagtgttcccaaagaaattggcagtttataaatggataaatcattttaagaaaggatgagacaatgttgaagataaagcccatagtggcagacaatccacatcagtttgcaaggagaaaatgaatcttgttcatgccctaattgaagaggatcaatgattaacagtacaaacaatagtcagcatcatagatatctcaattggttcagcttacacaattctgactgaaaaattaaagttgaacaaactttatgttgatgaataccaaaactcttgtgcccagatgaactgcagacaagaacggaggtttctttttatttttctttttttttggagacagagtctcactctgttgcccaggctggagtgcagtagtgtgatcttggctcactgcaactttcgcctcctggtttggagtaattcttgtgcctcagcctcctgagtagctgggactacaggcacccaccaccatgctaggctaatttttgtatttttgaatagaaatggggttttgccatgctggccagactggtcttgaactcctggcttcaattgatctgcctgcctcagcctcccaaagttctgggattacaggcatgagccactgtgcctggcccaaaagcagagctttcaatggaaatttttaacaagtgggatctagatcccaaagcatttcttcgaagaactgcaacagatgaaacatggctttaccagtatgatcctaaagacaaagcacaatcaaagcagtggctagaaagaggtggaagtggtccagtcagaggagatgtggatcagtcaagtgcaaaggtcatggcaatagttttttgggatgctcaaggcattttgcttgttgacttgctggagggccaaagtgcagggattacagacatgagccaagttgtactattcttactatctttttagtgcctgtgggatctgttgtgccatcttctcttttattcttgttgtgaatttgtgtcttctcactttttattcttgatcaatctagatagagattattattttttcaaagatctatatttttgtttcattaaattttctgttttctatttcatttacctaagctctatatttatttccttctacttatttctggtttagtttgttattttctgacttcatacagtggaagcttatattattattgctttttttctaagtatttaaaatcataagctttcctttgagtactattttcactatatatcccaatttttttctatgttgtattttcattttcattcagtttaaaatgttttattctgtgatttttttttacccatgggtaatttcacattgtgttatttaatttgtaaatatttggagattttccagttatctttatgtaatttttttctaatttaattcttttatgaccagaaagcctactctatagtatttcattcttcttttaaaaacctactctatattatttcagtctttatggaaggtatgcatatggtatatctttttgaatgttttgtgtgcatttgaaaataatgtatattctgctgctgatgataggtattctatgaatgtcagatcaagtaggttgattgtgttaagtgttccatattcctaatgttattcagtctacaagttctgtccattactgaaaaaggagttttgaggtttccaattctaattgtagatttatttctcctttcagttgtgtcagtttttgcttcatgtattttgaatagctgttattgggtacaagcacattcaggattgttacgttttcttgattaatttaaccctttatcataatgagatgttcctttttatctctggtaatgatccttgacctgacacatgtttgtctgagattgacatagccattccagttttcttattattagagtttaaatgctatatctttttatctctttttatctgtttctttacattcaaaatgaattttttctagatagaatatcgtctgatcttgcttttaaaatctattctgacaacctcttttcagggtttagaccctttgcatttaatgtgattttctgtgtaagtttaaatctgccatcttgttattttctgtttatcacatctatttttgtttgtttctttttccctcttttcgttacttttgggttaattcagtgtttttttaggattccatttcattttcacaattggtttattagctactcctcctttatcaccacccaccatggctgttgtagggtttacaatatacatctctaacttatcacagtctgtcttcaaatatatgctgcttcctgtgtaatgtatgaaacttaacaatagtgtacttccatttgtcccctggacaaatgtgctgctgttgtcatatagagcatattcatgaaatagcttcttcaatacccttttctgctaattttatcatctcttaaatttctgagtttgtttctgttgactcatttttctcaaggctactagtcattgttgctggtttttcatatatctagtactttttgatcagatgtcagatattgtgacttttacattgctgcatgctcacttttgttgtattcctttaaagagtacagaatttctttcaagcaagtagttaagttactaataatcagtttgacccttttgaagcttatttttaatctcttttaaggtagatctagagtagcttttactctaaggctgatttagcaatactcctgatgtattttttttttaaatagagatagggtctcattatgttgcccaggctagtcatgaacccttggcctcaagcaatcctcccatcttgggcttccaaagtactgggaccataggtgtaagctaccacatctggccctcatgtatgttttctactgaatgtcctgtgtattcaatgaagtctctctactctagctagttgtaacttaaacattcccagacctgtggaattctaggactgtttgacttacaattcctggtgattcttatttttccagaagttgttcttgctcagtcttatggtatttcgttctgcatatgtacagatagctattcagccagagattcaaggaacgcatatgcaggtttctaaagctcttcctctgtgttgtcttcctctcttaagtgccctgccctgaaaactgcagcatcttggcctacctgacctcccatctctttcttctcaactcactgggattgcaggctctgtttggatttccattctctgtgccaaagtctggaaattaattttaggaagaaagcctgggtgatggtagggctcactttgtctcccttttatcagatatcacagtcctgtactgtctattttctactgtctgaaaatagttgcttccaatagttttgtccagttttctagttgtttataataggagtataaattttgaccctcttattccctgttggtcagaaatgacatcacagcttttgtattttctcctatctccccataaaaatagacagttcaaacagggctgcaaaaccaaagacccatggataacatctacaactaaaactagatgactaggcattcctgtgaccttccaaatatgagtggatggagctacatcactgacagcttgaagacctgtgtgatgtcgttatctatacgggggggaaaaaaaggcatttcagcttctgataccttgagattgctaaggctatatcaaaaggacagggccaacttgaaaaggtcctcatagctaaagagaggcaatgtaaagatcagtaactgcaaaggatcgaaacagcaaatatatttaaatttgtaagtttcaaatgacacttttttaaaaaaaaaccctcattgtaatctttggaggatactagagaaccacctcattattttgaaagctgacaaatacaagaaatgagggtgagcatttatcccacctttcctatttttacctagtataacaaaatagttgatgaggcaaaattcctctttcgagatgtattctgtctcataaagaatgaatgaaaaaatttaaaaattaccattttgcaaccccagatgaattaatgagtgtaggcagtgattatcaatggctgctaatatcacaaaaagaataaaaaaccattatgtacctactatggaatcgaatacctgtcacttaggaagtaatcttataaaatctgagaaaaaaaaatccaacctgaatctgcaagcttcttgatctaccgctttttgagaattataagacagagttacatattaaaacacaccatggagatacaaaaacaaaatttagtgaggggactttagggcaggggttagcacacaatgcgtgggacacatctggcccattgcctgtttttgtatggcttttgagccaagaatagtttttacattattaaatggttgaaaaaattcagaatattttgtgaattatgaaaattgcagcgttcataaaaaggttttgttggaacacagccatgcttatttgtttatgtattgtttgtggctgctttcgtgctacaagggcagagttgagtaggtgcaggagtctgtacaatcaaaatgccaaaatatttactcactggcccttaacaacaaaaaaaattgtcaatccctaatctagaggactaatggcctggtttctttaacaaaaaaattccaagaaaaaggatgaaaggaaaaatcagtaagacttaagagacatgacaagtatcacaatatgtggaccttatttggatccctattcaaaacaccatgtttaaaaaaccaagatcatcaggaaaatgtgaacagcaacaaagatacttgatgatattacggaattgttaatttttaaaggtgtgataatgattttgtgattatattttaagaggtccttagctttttatttttattatttatttatttattttatttttttttttggagacagagtctcgctctgtcgcccaggctagagtgcagtggcgtgttctcagctcactgcaagctctgcctgccaggttcacgccatcctcctgcctcagcctcctgagtagctgggactacaggcgcccgccaccatgcccaactaattttttgtattttttagtaaagacggggtttcaccatgaaagccaggatggtcttgatctcctgacctcgtggtccacctgcctcggcctcccaaagtgctgggattacaggtgtgagccactgcgcctggctggtccttggctttttagagatagattctgaaatatatacagatacttggatttgcttcagaataatccagggagatgggagttgttgagtgtggatgtaagtaaaataagattggccatgttatgaaaattgtgactggaagatgggtgcgtagtgtgatggctcatcacactgttttactattttctctagctttgaatgtttgaaaacttagagtttaaaataaatcagttatttcaaaataagtttaaaaaatcagttcaaaggccatttcctctggacctagtaattgaatgcctcttttctgtgcttctgtagaatcatggaacttaccacattgattattgttgggtggttatttgtttaacttcccctagactcccagctccttgagggcagggaccatttgactttgatctgtagtgtcagttataggacatagcacgtaatctggtacatacttctggaacaaatataataacttttcatggcatatcatgatttctagatgataaaaattgtaaaacacagtcgtccttttttgttgacattatttatttttatttactttactccttccaaatagcctatagttcagcatgaaaccaaactggttatatagcttttataaatcaggaaaaatataactccaaaataaagtaagttatagaatgggcatcttagtttgagctatctcagtctgagatatgatattaagtgtggaataggtactttgaagtaaggcaggtattgcttctccaagcacaatattgtatgtttctgaatattgcagaaatatccatattcaaatctaagaccaaaatctaatcaaaccagctacaaattatttctatctatcttattattcccttttgttagcttaataccttaattattagcttaacctaacaactggttatgattattgaaaatttaatttttgcctgggtgtggtggcttatgcctataatcccatcactttgggaggcccaggctggaagattgcttgcgaccagcccgtacaacatagcgagaccccatctctacaaaaaaatttaaaattagctgggcatggtggtgcatgcctatggtcccagctattcaggaggctgaggtgggaggactgcttgagcccaggagatcaaggctgcagtgagttatcatcgtaccactgcactccatccttggcaacagagcaaaactctgtctccagaaaaaagaaaatgtaattttagaaatcccaatcttttgctttgttttccctcttcacatcgttgtcttcatatttgtagcaattctcttatcatggatttttttttttctgttttcagtgaaatttgatcctcacaaactgagctccaggatagtgagtcagaaacacaaccctgaagcttaagccagggtctaatttttaaataaatcacctggcaccaaaacaccttctcacattcatcaagaagcgcttttggtgttctgggcctggggacgaggtgcactgtgaaatgatcagtcatccagttacttttgtaacctgattctcctatgctgttttcctctgaatcagggttttaacagcaggtgtgaacatttagaattgtcattttcataaaaataaaatgctgttttcttcaaagcatttacaaaatcataatgggaagattttaaagctaatttacctagctaaatgccagtgacaccccatgatattctcctggcttccttgcccaaactggtaggtgaagtcagaactgaggggtgtctgaggtactaatggaactagctcaatggcagagtcaacagcaagggaaacagactcagtagggttaagggcacaggtagtttttcccaccatctttggacttcagattgtgtacatcttatctgtgcatccattttcttaggtacttttctccctttcgttgatggcttcctttttatctctatggcaagtcttcattatgtatgatagcaggggccacggagtgcatggatgaccacaatttagaaacgcacttcataatttataatgcatgaaaagcaaagcttgagattctctttatatgaagtgtagtgtggcgccccatcttggtggcattctggccactgcccctcaggctgtgccagaactgggcaaattaagggatgggtcaaagtgtgttaggaggaaatgggggtgtcaaccatgtgccagaaattggccctctttcattcaacagacatgctgggcacaaagatgaatgtaccccagttcttgatctcatgaagtttgcagtgaggtgtaggggctacaaaaagaagacagggtagaagcaacagccagccattgcagggcacagcacctcctgctgctagactccatgcagatttgacagcccttatttctactccatccctgtgcatcacctgacaccattgacaagtttctctgctggaaactctcacccctcttagcttccacattactctgtcctggacattaattcttggtattggctcttgttcttttgtctgatggtaaattagcatttcctagagttctccactcttttttttttttttttaatactttaagttttagggtacatgtgcacattgtgcaggttagttacatatgtatacatgtgccatgctggtgagctgcacccactaactcgtcatctagcattaggtatatctcccgatgctatccctcccccctcgccccaccccacaacagtccccagagtgtgatattccccttcctgtgtccatgtgatcttattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccaatctatcattgttggacatttgggttggttccaagtctttgctattgtgaatagtgccacagtaaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcactagcaaggcaggccaacgttcagattcaggaaatacagagaatgccacaaagatactcctcgagaagagcaactccaaggcacataattgtcagattcaccaaagttgaaataaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaattaaatactttacagacaagcaaatgctgagagattttgtcaccaccaggcctgccttacaagagctcctgaaggaagcactaaacatggaaaggaacaaccggtaccagctgctgcaaaatcatgccaaaatgtaaagaccattgagactaggaagaaactgcatcaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacacaggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagagatcaattcaacaagaagagctaactatcctaaatatatatgcacccaatacaggagcacccagattgataaagcaagtcctgagtgacctacaaagagacttagactcccacacattaataatgggagactttaacaccccaatgtcaacattagacagatcaatgagacagaaagtcaacaaggatacccaggaattgaactcagctctgcaccaagcggacctaatagacatctacagaactctccaccccaaatcaacagaatatacatttttttcagcaccacaccacacctattacaaaattgaccacatactgggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagagaagcaagagcaaacacattcaaaagctagcagaaggcaagaaataactaaaatcagagcagaactgaaggaaatagagatacaaaaaacccttcaaaaaattaatccaggagctggttttttgaaaggatcaacaaaattgatagaccgctagcaagactaataaaaaaagagagaagaatcaaatagacacaataaaaaatgataaaggggatatcaccactgatcccacagaaatacaaactaccatcagggaatactacaatcacctctacgcaaataaactagaaaatctacaagaaatggataaattcctcgacacatacactctcccaagactaaaccaggaagaagttgaatctctgaatagaccagtaacaggagctgaaattgtggcaataatcaatagcttaccaaccaaaaagagtccaggaccagatggattcacagccgaattctaccagaggtacaaggaggaactggtaccattccttctgaaactattccaatcaatacaaaaagagggaatcctccctaactcattttatgaagccagcatcattctgataccaaagccaggcagagacacaacaaaaaagagaattttagaccaatatctttgatgaacattgatgcagaaatcctcaataaaatactggcaaaacgaatccagcagcacatcaaaaagcttatccaccatgatcaagtgggcttcatccctgggatgcaaggctggttcaatatacgcaaatcaataaatgtaatccagcacataaacagagccaaagacaaaaaccacatgattatctcaatagatgcagaaaaagcctttgacaaaattcaccaacccttcatgctaaaaactctcaataaattaggtattgatgggacgtatttcaaaatgataagagctatctatgacaaacccacagccaatatcatactgaatgggcaaaaactggaagcattccctttgaaaactggcacaagacagggatgccctctctcaccactcctattcaacatagtgttggaagttctggccagggcaattagtcaggagaaggaaataaagggtattcaattaggaaaagaggaagccaaattgtccctgtttgcagacgacgtgattgtatatctagaaaaccccattgtctcagcccaaaatctctttaagctgataagcaacttcagcaaagtctcaggatacaaaatcagtgtgcaaaaatcacatgcattcttatacaccagcaacagacaaacagccaaatcatgagtgaactccattcacaattgcttcaaagagaataaaatacctaggaatccaacttacaagggatgtgaaggacctcttcaaggagaagtacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatgggactggtaccaaaacagagatatagatcaatggaacagaacagagccctcagagataacaccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctggaagaaaacctaggcattaccattcaggacataggcatgggcaaggacttcatgtctaaaacaccaaaagcaatggcaacaaaagacaaaattgacaaatgggatctaattaaactaaagagttctccactctttcctgtcccacccagtactatcaattctgaacctcaatttttctgcctcagcactttcctgggttatgacagactctcatcaattaacagtaacttcctttggcagtgattcttgacctggtgggggaacagtatccaaagctccagtagcagaagctcccttggtgattttgacacatttccccctcctcttggacagattctgtgtcttatattttaacccctagcacagtggccagctgtggtaggagctcagtgatgttaaccgcatgtttaatggcagtaagcacagcatgctatgagaacacagagcaggtcacttaattgtgagaaagtcaggaaaagctacagagaagctatcagttgagccaaactgaattctctagatggataagccttaaaagagattcaaacaggtggattttcacagcaaggcagatcagttattgaaatttatgtatggcaagtggttagacacacaggcttctttactaaatctcagcattaggaggaaagaactctttctgaattttgaacattagcataagtcaaataaaagtaagatgttctatatcattggataggtaatagatttgtggtcatcactgctcccaagaaatgatactggtcctggcatgaaatagtctaattaatttttaaaaataatttcaattttcattttagattcaggggtacatgtgcaggtttgttacctgaatatattgtgtgatgctgaggtttgggatacaaatgatcccatcacccaggtagtgagcatagtacccaatagatagtcttttaattaattgtaataaagtgtttcatttattcactcaataaacttattgaagcaccttctagtgttaagcactataataggtgctatatattcattagcgagcaaaacgaacttagccccttccctcttggggcttatagtctagtgaaaaaatagacattaaggaaatcactacaaacacacagacacaatgataaatgctatgagagaaagtggaatgttgagggaaagtacaacagagtcacctagttgagagactaggcaagaagtgaacaatgatcagaggttaattaggcaaaaaaattagggggaagaggcagaagagatataggaaactccatggcaaaatggtttgaacaaatcgatgaagagccataaagcagctcaactaagagttgctgttgaggaggaagggcacaccccttctcaggtcctgcttctgcctcttccttgagttcatgccatattgtagtgggtatccccccctgaatcaactccagcgacagtggtctccttgcaggttcccagacaggctatgctgtttcatgcctttttaaaattgtggtaaaaaacatgcgacatgaaatttaccctcattttaagtgatcagtacagtattgttaactataagcacagtgttgtccacaaatttaagcattatgcataagcattaagcataacattaaacaataatgttgtccagcacaaatgtttgcacaaattttctcatacatgcataagaagcttacacagctcaaaaatcagagcaatgtaaaaaggcatagagaaagcttttattcccacccctgccacatctgcactgttcgccttcactccctgcagataatatttttattagcctcttgtgtattagtcctctagttctttatgtaaagaatatacattgttatgttctctcttattaaaaaagtagcatatgatggacattgttatgtagcttgcttttttgcctaacaatacgtgttagagttcagtttatatagagctgcactgtccaagatcagtaggagtcatatgtggctgtggagcacttgaaatgtggcaggtgcaactaaaaatggaattttaaatttaatttaatttaaatttagatttaaaaaatgaaagcagtgaacaatattttcctattaatctcaactttattgttttagtaggactacatttcactttaactattgaaaatccaacatccaaattgagatgtggtataagtgtaaaacacacactggatttcaaagacagtataaaaaaaatgcaaactgtctcattaatgttttacatcatttacaatctagtcatcaatttgttcagtgttttttgatatagttggctaaataaaatattaaaaccaattctgccaatttatctttttttaaaagtgatactagagaactttaaattacatatgtggctcaaattctatttctttttttttttttttttttgagacagaggcttgctctttcgcccaggccagactgcagtggcgctatcttggctcactgcaagctttgcctcccgggttcacgcctttctcctacctcagcctcctgagtagctgggactacaggcacccgccaccgcacccagctaattttttgtatttttactagagacagggtttctctgtgttagccaagatggtctcgatctctgacctcgtgatccgcctgcctcggcctcccaaagtgctggaattacaggcgtgagccaccgcacctggctcaaattctatttctactggacagtgctgatacataacatttactactttttacacctgtatagtattccattgtatagagtaccacaatttacttaaccaatccacctttgatgcatacctgagttgtttccaatcttatgtttaaaaaaaaaaaaaagcagaaatgcttacccttctccatgcatcacttcatacatgggcaggttgatctgtaaaatgaattcccggcattgggattgctgggtccaaatgtaaatacatttgtaattttgatattgccaaattgccctccgtaagcattgtaccaatttgcactcccaccagcaatgtgtgtgagtgccagtttcctcatacattgccacttgaaactacaattaactgtatttttggatgtaataatcaacatttctttttgctaattctgagagggttttaagaagaaatcataaatggtttgtctaacttctctttccatttggaaaaaaaacctattgataaaatgcttagaggtagcatttcagaactgattttttttttttttttttttttttttgagacggaatctcactctgtcccccagactggagtgcagtggcgcaatctcggctcactgcaacctccgcctcctgggttcatgccattctcctgcgtcagcctctggagtagctaggactacaggcacctgccaccacgcccggctacttttttttttttttttttttttttaaggaaagcatcaaagaattaaccctcactgtttcccaggttgtaaatttctatgaaagttgcaactttcaccatactgagatttaggcagagggattttgtgagggttcaaatggataagggactacattttcttctgtttttttaagagttggggatttctcagattactccagcagccttccctggctgtggtggactaacatttaagggtagactggcagtttccatgcaatttttgcatattgtcagttaatctcctggattggttttactgtatgctaaacatattctaactcaatgggttgcttaactgaggaaaccagtgacaacataactggcgcttaagagctgccataatcatcagatagttcattccactgactttattagtaaatggcagagaaagtttatcttttcactttatggatccaactgttgtccctcatttgagacttgtgtgccctctactgccctctttgcctttttttgttttttcagatggaaatgaagaagtaaacattcagtatccaaaagaaaactgctttaaattttccattcataggaatatgaaaataagattcttatgaagagaattcttactatggagttagagacgtgccagataagttaataaatcagtataatggaacccttgatttgggggaatataaaatattttggcaaatcctagaggcatagaaaggcattttatatcaaatatgactatggacacttaactatctttagtattgtattgattttcaacataaaaagattaagaaaaaaaagttgtcttacgttcctcatgcaggaaaagcaccaggacattgaggacttagtataagggtcatccttggcaactggttttattgagtcattgctactatgtttgagttacacaataaacaaatatacaactttctaacaggaagtagctgcagccatagctattcttcatatttttgtttctgttgctaatttttgcctaattttgtttcaggaagggttttcactcattggtagcaaggactggttgaagattgtaagacgcgtggattgtctgttgtttggaacaacgataaaggcaagatttaagctaatgatcacactcttctcatcttctatgtgtgtatgttggggaggtatttgggggcatctcttggtaggtgacgggtactgggaagaatacaaatgtttaagaaaggtttgtactatgagaaaaacatgaaacaaggaccgtagagaggcagaagcctcattagcaggaggacattgctaaggagtcaggctctgatggatttctcagtatgcgtctgatggagctgtgcagccattctctatcccccaagcacaaattggaagtggagtacatcatttgtcttgcgatttggatgtttaaaaaggtgtataccttcaaatgattcagtgaatatgtattttcattttttctttttaatattaaaaaatttcccttttacttgctttctagctgtattaagtgtaaagaatgatcttcatcaaagaaacagtcatattaatcacctggatcattttccttcaaaaataactatgaaaaccaatctgttaacattcatggagtagataatattgaaatttaagtgaaagatactaatttttgagggactcagactctgagagttagacgattatctagtggaggggtattaacctggggtacacagaccccagagtctccatagaattcagggggtccatgaacttccatggattttcactgacctctaattgaaatgtatcatttccttccactatgaatgtaaggccagcagaccacagtagttttagaccttctcactaatggaaatcacagatactttcatatcacatttcagttgtttctgacatctcaaatgtttatgctcatcactacctcaaaattaaggtgtttattagtcctcctactagatctttattatcaaatacattaataaagaagcatatatattagttcacaaattagtgccttaatattgtaataaactaattcagtataattggtttctttgtaaacttgtgcattttgtgtgattaaaaacattgttctgagaaggggtccactggcttaccagattgccacagggatctggagcacacactccaaaatgttcaagaacccctgttttgtttcccatataaggaaattgacttaagccaatagcccaggttatgactagctatcagagaaccaggctgccctttgatctttggacttagctccagaccatatcatactgaatgaatgtatagatctctgaaaaagttatacatgctgtatgtttgatacttgagttttaaatttttctaaatatacattattactaaaattttaaactaactacaaagagcaaaataaaaatcaaccataatttgaccactcaaaaataattattaatattctgaaggttttactaagcatatatactatatcagttaggattgtgttcagatgcatgtaagagaaaaatcagctataatggcctaaaaaaccagatttctttttttttcacttaaaaggaaatctaggctgggcatggtggctcatgcctgtaatcccagcattttaggaggccaagacaggtggatcacctgaaatcaggagttcaagaccagcctggacaacgtgatgaaaccccatcttttttaaaaatacaaaaattagccaggggtggtggtagatgcctgtaatcccagctacttgggaagctgaggcaagataattgcttgaacctaggaggcagaggttgcagtgagccaagatcgcaccactacactccagcatgggcaacagagcaagactctgtctcaaaaaaaaaaaaagaaaaaaaaaaagaaaaaagaaatctagagacaggcccttgctagcatcctccagcaactcaacagtgtccaggttggcatctcggtaattctcctggcctctccctcttgggtgcagaatggttgctgcagctctactatatttccattgaaggaaggtcagcatcacctggcccttttataaggaaagcatccactttcctatatagctctccaccacccacaacccccagaagatgcctgcttatgtgtcatggaccagtgtaatatggctgtcccaaactgcaaagattaggaaaatgagcgtttgacatttccagcccctcttgtggattggcttgtgctaattgagtgtccaccatatagataatttataaaatggggattgtagtactttgtatcctgttctttttatcaggaacattataccaagtcattagatagtctctgaaagaaaacactcataatggcttggtagcgtgttattgtttggatgcactagggtttaactcatcgctaatttttcactattataaaaatgttctgattttcataaggatttatttacagggttcttgagatagaagtcctagaagtatacacttttttttttttttttatataaatttgccctcccgataggttgtccctgcttctactctactggcaatgtgtaagaatgttcatttatccaaatcctctccaacgtggtgatacaatttaaattcaaaaactagtttctaatttgacaggcagaaataagcatattcctttaatttgcatttcttgttaaaactgatgagaatggtaatgtaacatttgtatttcttctgttaatcacctgcttcttttgcctagtttttctcttcttcaaactacgtataatttgtgtagctatataattttatatatttgtgtatatactgtatgcacagactttttaaacatttaaaactaggaaccatttgcctgttattgtcaatggtttttttgtttgtttgtttttgagacggagtttcactcttgttgcccaggctggagtgcaatggcgtgatctcagctcactgcaacctcctcccgtgttcaagcgattctcctgcctcagcctcctgagtagctgggattacaggcatgcgctaccacacccagctaattttgtatttttaggagagacggggtttctccatgttggtcaggctggtctcaaactcccgacctcaggtgatctgcccgcctcggcctcccaaagtgctgggattacaggtgtgagccatcacacctagctgtaaatggtattctttatcccaaatatattttcagccagttattattggatttttttctgaattagtttaaatttaacctccttactaaacttttattaactgttttttaatttctaggaaagtgtttttataatttacagacaattgtatttctttccaatgatttatattttttattactttccccaccttaccgaattgtctagatctcccagaatgctgtaatcatagggttatagtatctttgacgtcttcctgacttgcatgggaagtagtgtttagacattaactccatctctgtctgttaactggcttttttttttttttttttttttttgagaagagtctaactctgtcccccaggctggagcagtgttgtgatctctgctcactgcagcctcaaccttcagggctcaaacaatccttccgccccatccttctgagtagttaggaccacaggagtgtgccaccatgcctagccaatggttcgatattctttatcatgtaaggcagattctctttcaattatagtttatttaatacctttatcaggattacatatcattttatcaaatgctttttgacaagtattaagatcatgggtttcttcctcctttgatctattgacttgatgtaatatgttgacattgaaccaacagattcttcttttgccctacctggcaaagagtatctgatgcatcttggcttggataacttttagttttcaagtattatgccaaaacactattatttaattgacaaatggaagaagtaaaattttcattccttttatagcaatttaatataaattctatgagtagtaaacattatatttcttttctctctgaactgaaataagtaggttgaataaattctgcctacttataaggtaggcttccctttttccagcaattctgatcaaatagggggctaacaatagacatataattccttatcttaagggcactttggctcaaagaaggaaacccaaacaaccactgtcctctttacttctcactcccagtaactcacggaggagtttttaaaatgatttcgtctagccaaggctttgagtattgccttttagtttcaaagcaaagaatcaaataaaatgctgaagtaccttctctgtttaagacctttttctgtacttccacattttctatagtagaggaattcacaattagcggtggggaaaactgcttcagttggggtcttagtggtaatggaaaatttcttaccaacctgggtgatgaatctaaaaccagcgggaaaacccactgggtttttatgaggcctctagtgtctccttggctctctatgtcatgttaactgggctccacattttccagggcatgacgatgccttggaacacctactgtggagcctgtggcctaagcatctctgtatggagatgctattcatacctgtgagccagcacttagtaggcctaatccctttgtgagtacacgtagataagtgaaaagagatgagcacttatccttaaatttgcttccttgagtctgtattagttgttataacttgaaattaagtgttctgaaggagggcaggtgcaactttacatgtaagccaccacttcagatacagtaattatgagcccatcttcttaggtgatagaaactagagactgtatatttggcgaagttcgtgattgttggtatacttgagaacttttcacttcacagcaagaagctctttctgacttttaattatggcataaaaataaatctcatcaagactttcaatctttagcagtccctctggttaacccagtggaaagttttccattatggtaacctatggcattgaggatataggatggagatacaactaattttcagatttttcctgatgtacctgggttttatcttggatccacatgcattgaagtggtatttctggctttagatgataagctcaaattctaaaatttttacagaagcaaacatggaacaagacttcagttaggctattagacatgtaaactactctgttgcttttttggaattatactccaaaaaaaaccctagctatccaaactgattattatatacattcacatatagatacctgtagacttatataactggtctcaggtttttgccctgcttgtatgcttagtgtctgcttgtgcatacagctttttaaagctagctatgaaatacagttgctgatgtcactgtcagaaagttaattgcagaatcctaatagctaatataagggtacttcatatagatgtcttcatatagagtctgttggaaacagctaaataactgtaaacaagaaatcagtttaatttcacaaaagaagattcatagtagtattatagattgaatgtataggtctcttatcagttcttttcccttcctcagggaaggtaggctttcaatgactcctgataatctggggattatccatccaagaggaaaatggctaagggcatgaataggtaatacactaaaagaaaaaatacaaatgaccaataagcataagaaagatagtcaacctcacttgtaatcaaagaaatgaaatttttaaaaaactatgttaacctagtatgttgacaaaaatttaaaaaaagaatcttcagtgtcggagggaaatgggcacatagattcttggtgggagtaaataagccctgtcttgccacaggggagttaggcattatgtaccaaaatatgaattacacacatcctttgacccagcaaatctgcttttaggcatgtatacacaaagatgtatgtataagagtgcttgttaaagctttgtggtttataataggaacaaaggctggaaataacctaaatgttcatccatagggggccagttaaataaaggaatactcttcagccattgaaagtaatgaggtatacttctatttttatatatttgatgttaaattaaaaattatgttatagaacagcaatgtattttacatatacacacacaatatatataacctataaaaatatatttatcagtgaactcatttttgataaaggttacaagaacataccctgagggaagagacagtctcttcaataaagagttctgggaaattgctgaggcaggagaatcgcttgaacccgggaagtggaggttgcggtgagccgagattgtgtcattgcactccagcctgggcaacaagagcaaaactctgtctcaggaaaaaaaaaaaaaaaaagagttctgggaaactgatatctatgtgcagaaggatgaaacaagactcctatctttcaccatatacaaaaatcaaataaaaatggattaaatacttaaatcgaagacctcaaactatgaaaactactacaagaaaacactgaggaaactctccaggatgttgatctgggcaaaaatttcttcagtaataccccacaagtgtagacaaccaaagcaaaaatggacaaaggggatcactttaagttaaaaagcttctgcacagcaaagtgaagagacaacccacagaaggggagaaaatatttgcaaactacccatataacaagggattagtaaccagaatgtataaggagctcagacaactcaatagggaaaaaaaatctaataatctgattaaaaaatgggcaaaagatttgaatagacatttctcaaaaagcaaatggtaaacaggtatatgaaaaggtgatcaacatcactgatcatcagagaaatgcaaatcacaactacaatgagataccatctcactccagttaaaatggcttttatccaaaagccaggcaataacaaatgcaggagaggatgtggtgaaaaggggaccctgttaaatggttggtgggaatgtaaactagtacaaccattatggagaacagtttggacgttcctcaaaaaactaaaaatagagctaccatatgatccagcaatactactgctggatatgtacccaaaagaaaggaaatcaatgtatcaggatatctgcacccccatgtttgttgcagcactattcactatagccaagatatggaagcaacctaagtgttcatcagcagataaatggacaaagaaaatgtggtacttatacacaatggagtactattcagccataaaatagccatacacagaatgggtataactggctagccatacacagaaatacaaaaattaattcaagatggattagagacttaaatgtaaaaccaaacgctataaaaatgctggaagacaacctaggcagtaccatccaggacacaggcacaggcaaagatttcgtgacaaagatgccaaaagcaattgcaacaaaagcaaaataggatctaattaaaccaaagagccatgcacagcaaaagaaactatcaacaaagtaaacacaaaacctatagaataggagaacatttttgcaaactatgcatatgacaaaggtctaatatccagcacctacaaggaacttaaatttacaagaaaaaaacaactccataagaaagtgggaaaaggacatgaatagacactttttttttcttttttgagatggagtcttgctgttgccaggctggagtgcagtggtgtgctctaggctcactgcaacctccacctcccgggttcaagtgattgttctgcctccgcctcccgaatagctgggactacaggcatgcgccaccatgcccagctaattattgtatttttactagagacagagtttcaccatgttggccaggatggcctcgatctcttgaccttgtgatcctcctgccttggccacccaaagagctgggattataggcatgagtcactgtgcccggcctgaatagacactttttaaaagtaagacatacatgcagccaacaactatatgaaaaaaagctcagtattactgatcattagagacatgaaaatcaaaaccagtgagataccatctcataccagtcagaatgactattactaaaaagtaaaaaaataacagatgctggcgagttgtacttatatactgttggtgggagtgtaaattaggtcagccattgtggaagacagtgtggcaattcctcaaagacctaaaacaccatctgacccagcaatcccgttacttggtatataatcaaaggaatataaatccttctgtaatattcacacatgcatgttctttgtggcactattcacaatagcaaagacatggaatcaacctaagtgcccatcaatgatagactagaaaaagaaaatatggtacatgcacaccatggagtactatgcagccataaaaacatgaaatattttttgtagagatggatggagctggaggccattatccctagcaaactaacacaggaacagaaaaccaaataccacaagttctcacttataagtgggagctaaatgatgagaacacatgaatacatagaggggaacaacacacactggggccttttggaggtagaggaaggagaggatcaggaaaaataacgaatgggtactaggcttaatacctgggtgacgcaataatctgtacaacaaactcccatgacacaagtttacctatgtaaaaaacctgcacttggacccttgaacttagaataaaagttaaaaaaaaaaattatgagatcttgttacttacaacaacatggatggaactgggggtcattacgttaagtgaaataaaccaggcacagaaagacaaacatcacatattctcacttatttgtgggatctaaaaatcaaaacaattgaactcgtggagataaagagtagaaggatggttgccagaggctgggaagggtagtggggatggttaatgggtccaaaaaaagaaagaatgaacaggacctagtatttgatagcacaacaggatgacgataatggaaatttttaaatacacgagtatggttggattgtttgtaacacaaaggataagtgcttgaggggatggataccccattttccatgatgtgattattactcattgaatgcctgtatcaaaacatctcatgtacctcataaatatatacacacctatgtacctaaaattttagaaattaaatatacatgagtgtttgtatatattcttttatacacccacagatatatatgactcttcatattttttccaatgttggataagataatgataatggatgacttttatattcagggggaaaaattaaatgaattaaaatataaagagtaccaaatactggcagtgaaaaggggcagtggtgcctattcttctaaacatgatagcttaccattatctcagccatgccaagagttttctgtaatctaaatatatggctttacttgatgggtttatttaaatagtgtaaattatgaacaggaaaatcaaggactatttatttgcttataggaacttacaggattttgttaactgtagttaggagtgttttcaaggaagcaacatggtatatatatttcatgagggaaaaggactgtcactgtgctaagcttagcatctacatttctttacagaagaaactgatgaaaggtatacaatatatacagtcctgtttcgggaggcttttatgtaggttgactcctctaaactaggcagagtagtagactagaaaaaagggaaactattctaaaatggttttatgttattgttataatctagatgtttttacacttagatgtttttatacttgtaatcaaataagtttgatgtagttgacagatttttaaaattttttaattgcatctgtcccacatttgctaatttgccaagggatgtgactcatacagcaaattaaagacagcctttcactatgcaacttgtatggtagtctggcctctttaaggataaagggtactacagatcattagcatgagatctattagctttgagcatctgcctgtcactcttccccagtattgtttaagctcactgccttgtttaacatagttatctacctggtttggtattactcagtttagaaaagttttgagcaggactatgcttgctgtattattatcctcacagatttttcacttagggaattagaagctatgaaatctttattccaaagcacgataaaacactgatctgcaatcagtatagtgatcttcctgtctttatgatatgagcttttccactgttgctgatgtcacttcccagagggaagtgaattttagtatgatgaacaactcccaaaagggggaagaaaatgaattattggcttttctatgcctgcatcaataagtgaagatgactgttcccttatctatacctcttcctccgccaagcaaaggaaacactcagtggaagaccccaaagtaaatagttatatgatgagggtctctcatgataacttttgatttgtcaaacaggacaagagtcgcctgtttcgagtacagttcagtggagagtcaaaggagcaggcgctggaacactgctgcagttgtgttcagaagctggcacaatacataaccgtgcaggtgcctgatggaaacatccaggagcttcagctgattcctggcccacccagggcaactgaaagtcaagggaaggattctgcaaagagtgtcccacggcagcctggagtaagtaggctgatgtgttggttatacaggaaacatgacaatgcagtgcacaatgagtggccaaaatgacagtggagtttgtcaagtctgttaggtttgtagtttaaaaaacatctatgttcggtgactttttaaaattgaggtcgatactcattgtagctccctattcagaaattaggcagggaggagttccagctgcattctgggtgtcactacagaacagtggttctcaaagtgtggtccacgaacccctccctaggactcttccagggggcccacaaggtcaaaattatttttcttaatatttaaagaaagagtatcacttgcctttttcactgtgtcaacatttgaattgatgacacaaaggcatcgtaaggctgctgtcatctcatacagatcaggcagtggcaccaaactgtactaatagtcatcatgttccaatcattcgcagtaagaacaaactaacgaaataaccctgcagtctgcagtaccatggctgtctcaagggaacgcacctgtgtgacatttgtattttgaactagcctcttttttcataaaataccatcattatgtgagagaacaacagactatggtaattcagatttgggtatttggcagacattttctcaaaaatcagtgaaatgaactatcacttcaggaaaacaactgatagtatttattgaaaatgataaaatttaagcttccaagtgaaaattagaatcttgaaaaacttgtatctgccacatgagcttcacaacttcccaacccggaagacttttctaaaggtgctattaataaatgtgatttacttgtttataagtaattacctgatgaaatgtgtcaatatttgaaagacagtatattcagtgaatcagtattgtccagatgaccgatgcctgaatgccacaaaattatacgtggataaagagctattcaaaagtgtaagataggctaaaagattgtaatataacagtataacaagtttattgccatggtttcagattctatattgcaacttaactttaagcaactcactcgttgagttttggtgttgtatcaaggaatatccacagttatctgaacaggctattctaaaatacccctcccttctccatctataatttgtgtgaggccagattttcttcatgtcttcaaccaaagcagcacattacagcaaactgaatgcagcagcaaatataagaatctagtcaccttctactaaactaggtagtaaagagatttgcaaaaatcattattttgttttagaaaagttattttccataaaatgttttcaacattaacgtaaagtgggtttattatttttaatgaacatttttaaattccgtgttagtttctaatatgataaataccagataaatgtaactcagatgaaagttctttgaaggcctcataaggggtcttgtgataaaaaagtttgagactcatgactatagaatttctcccagaaatatgtgttctgcatttctttggcagtttcaaatattattggaataagcacctacctctgttcttgagatgagatactactttcaagctgggttttgcatttgctttgagaagtgatttttccaaacctggttttccattacttcatcatgttagttttccttaaccaaaacacctcatttttgctgttttgtcactatgtttcttttttttgagacagagtttcgctcttgttgcccaggctgaagtgtgcaatggcacgatctcggctcactgcaacctggcctcccaggttcaagccattctcctgcctcagcctcccgagtagctgggattacagacatccaccaccatgcccagctaatttttgtatttttaatagagatggggtttcattatgttggccaagctggtctcgaactcctgacctcaggagatccaccctcctcggcctcccaaagtgctgggattacaagcatgagccaccgcacccagctgtcactaagtttcttgttactcataatttgtctaaggtgaacataaattttcattatttattatacaatctttttctttaagcaggtgctgcatgatttcctcttgaatgtatttagtttaccaaacagattttggtgttttccttcccttcgtttgatttttgtgaagatgtcttaatgctgaagctgcttgcctcacaaaccctggatctagtttcaaacaataatgcttcgtctatattcagctcctgctatattccttaagaatcccctccctacaaatgggttggttgttataaggtattttattgcttatgatcctttgccctttagtttttcatgtttcactgcctgttagattcagatgatagtatagtatacccagtgtatggagtgtaacaaaaaaacccaaaagggttccagattttgggaactcagtctggagttccttataaaggtaatgaagtcacatcacgctagaacctcatcaggctacacaattatctaagtattacaaatgcaaataaattgaagttgtaacatgcagtaacaaatgcaggctgagttgtgagctacagccccagatgaaggctccagctctctgatgttaaagactggtcccaaatgtctaggtaggaatacctgagaagtggttaggaaactttcatgcctttcttgattctattttcagggactcttctgaactgtaattgggtgatttgactaagatagcatgatgttgtgcaaagactacaggctttggtatcaaaatggatctaggttagaatcctggccctatttcttagtagctgtgtgatctcacggaagccaattagccccatctgtaaaatggtgagattaaaatgctgtatagaaagtacccaatacaatgcctggcaaatataatcacaaaatccatcattactattattgccaccaatgttaccctttcagatgtgccttcccttgcaaatgaacaaatcagcatcctagtcaattagcaaggatcagaacctccagagccaagagagggcatgataagacagtgtctgaagctgcagagcagatgataagttaaagccattggattaaattccaccagggtacagaccttgtgaggcaccacctagaacattctagttttcctaatggcaaaacataaggtttgcccttaactctgttgtacaaattttggtagcatgtgctctttctcagaatccgtcttaagcggcacaagccatggccaaggttctggtcattttgctgctctcttacattcaggtgtgtcatttttgtagtacctatatattttttagtataaaatagttatttccttctttgcaaatagagataattctatttcaagttcttgagtcatttactggctcatattttagtttttgcttttcctcagccttgtaattttgttaattgtggcttaaccaggcatttctcaaccttagcacttcaaaggcaaccagcccaccccagggagggggatgggaaagacagttaagaggatcgcagttcctatgtggactctttcctgttagcacaaaaagtccagaagaaagtagctaggggactccagctactgtgtgcacagactcttccatctctatgctgttgcagaggtggaccatctaatcctagagcccgctagcctcaggtgcttcagttccacttagctattttttagtgtttatggcagacaattttggttgacattagttctttgtgtgagctgaaatgataggtattctaggaaagcatcatatgtcatagctgaagaaacactaggcactagaggctgccttgtttttacagaggagaaaactgaagaaactgaacagagaaatggggcttgtctaaggactattgattatagagtcctttggccctttggccattttgctcgttttttgttttcttgtctttgttctttccttcctcactgtacctccacccctcttttttgttgttgtttgatgcttccaggtctggtttcctgctacctactgactagcaaccatcagattctctgtaggacagaagacagaatttggcatctcctgccttctggtagtcagacttgttgctgaaggacagaagcgccctccaaagagtgccctgtttcctccctgtattgcaccatgagctcatacctagtgtaggatcaccactgctcgtctggagattagcactgcagcaacctcaggtacccaaggcatattggggcctgcagacatgtggctaggaaggaacggaggtagggcccttcatgcctccagacctcctgcaccttgttcattccatttgcctggaaagcatcccatgtcctacccgagaacaacttattaccatagattctctccagatagcatggaccttagagcatccctgtacttcctgcttagcatacagccctccagtttacccacttctctgtgaacctctagcacttcctgagttgcaagataattcatggttttacttgttaggttctcactgggttgtgggcttccagagggcaggactatcttgttctttgtcgctcctatccccgtaccaccccagtgtctagtacgtaggaggtataaacagttgttgaaagaagatatctgtaagttttacttacagaagaactgattctttcagaatatctaaaatgagatttaaaaaaatcattttattgaaaacatcagttgtcttaaaattataggagtttccccccattttgcatttcttcaatgaacatgtattacttgagcaataatttttagagtgtgacaaatcatcagaagctggggtccgtccactgcatgtaggctgccatggtaacagcaccgggcccaccctccagcacctggtcctgaatcctaggctgggcctctaacaacagaggaatgccccagtgtctgacaggaagaagcactaacagcctgccaactgctgaggaacatcaaatagaggtcaggagccgcaaatttaaactcagtacttctgctgtggtaactcaagtaaccctccgtttaaaccaggacagacctatgctgacaaccatttttatcactcttagtggtattttctttctttgaacatgaatgcatatttctgctctttaatggcctttggtatttaagattacattcagctagtctccttattgcatgttgttttattccagtcccaccagcactcagaacaacagcaagtgtgtgtaacagcgggcacaggcgctccagacggaaggacctcactgacgcagttagctcaggtagagcttatttctgtgttcaattttcttgtcatgagaagcagtgacccctaagaatttgtatccctttgttcaattctttgttttaggagagaaacttctaaagcattactctaaaaggtgatagagacagagacgggccattttcatctaccccttgcagagttaagttttattacagtaagttgtgaggtgagacatgatggctgcaggcacatagtcaagatctaccctcctaaggaaataaaacggggaaaagtggttgaatgtccaatatagaaaatttaatcaccactttcccaaaaaagaataaatggaggactccattgtaattatggaaatgaaatttgggaactattttaagacaaatatcaaaatgaatgtggattcagatctacaacaatttctatatgggtagattgttagtactcagctaaggatgtgaaacccaggaggattcagctgttaactcagacttgctttcagacagccccttgccccctgctgcaaaacctcttcattcaaaactatggttgtgtgacgtccactctcctgggagctctgcaaggactttgtctccccctcactgcattcctcattgcaggtgttcaagccagcagcttctgcttgccacagaattctgtgtgaagttcatcaatcttcaagtatgatttttttttttttttttgaggcagggtctcaccatgcctcagcacccagcaggctggagtgcagtggtgcgatcttggctcactgcaacctctgtctcctgggttcaagtgattttcctgccttagcctcctgagtagctgggattacaggcgtgtgccaccacgcccagctaatttttgtatttttagtagagtcaggatttcactgtgttggccaggctggtcttgaaccccagacctcaagtgattcccccaccttgggctcccaaattgctaggattacaggtgttagccactatgcccggccacattttcttttaatccctccactaaactgtactatcagtagtttaaaaaaaaaaaaaaaaaaagaaaaaaagggttttctccatctggcttgccactaactcaaaataaatggacaatcatatagaataaaaaactcaagaggtaggaagactaagaattcatgtttatttcttttaataaacccctaactatgaaaaaaattatttgtccagcagcaggactaatgcccatatttgcattggggttaggggctaactgaatcagagaagctgaggaaaacagagctgcaataaaacaataagcaaggcagggtgtgatgtccttatttaggaaatatcaattgctagaaaaggcatacctttgcccagtttatttacgtagtatggaagaaccatatacaaatgagaaaaagcatgaagcttggagctcagatacattacttacttgctcttatcttttggacatgtcattctatgtaagttggtaaaaccttttggaaggcaatttagcagtacatatcaaatttaatattatgttagctataatttcatttcaactacacaaatatacatatgttcatcacaatgcttaagaaattggaaacaacataaatgttcatttaataggatattaagtgaggtataaccacagatgggatagaaatgcaattaatacaagggatgtaggctgcacatggtggctcacacctgtagtcccaagcactttggggggctgaggcaggaggatcatttaaggccaggagttcaagactagcctggcctaacatcatattgagacccccatctctaaaaataaacaaaacaagtgctgtatatcccaagtaagtttctgttacagagagttcctggagaaataccagttatgtacttacacactaaaacatgctatccacgtaaagaataaaaccacctacctcacagaattaatgtgaggagtcaataagatgaccaagtcaatgcaccaaagtaagtggaccacacagaactggagcccatcatcgtcatgtgggactgtggatccggtgttgccagatcttccaaattgtcaagatttttatttgaactctcctaatatttaaacgttgacaacttattcaactggttttaaaacactgcaggttaccaaagaaaacatacagatgacaaataagcatgtgaaaagatgctcaacattattagtcattaggcaaatgcaaattaagaccacgatgagacatcctgcaaacttattagaatgcctaaattaaaaacaaaaagaaaaactgacaataccaaaccctggatgggtgagcaactacaactctcatctacactgctagtggaatgtaaatgggacagccactatagatgacagtttggcagtttcttacaaagttaaatatacactcaccacatgactcaatcctaggtatttactgaagtgaaatgaaaacctgtgttcacacaaaaacctgtaagggaatgtttatagcatctttattcataattgcaaaaaaataaaacccaaatgtccttcaactggagcacagataaccaaactgtggcacatccatgcaatgtaatacttattcagcaataaaaatgaattactgctatactcaacatcatggattaatcccaaatgtattcattatgctaagtgtaagaagccagattcaacaacgtattatgatttcatttatatgacattctggaaaaggcaaaactatatggagaagagatcagtagttattaagggttaagggtttgacggtaatggttagcacaagggtcacataaaggaatttttttgggaagtgaaagaaatgttctgtattttgattgtggtgacagttacacgactatttgtcaaaactcacagatggccagaaaaagatgcgtgtgaactaatgtcctttgggagtctgtggcctctttcttacattcagaatgcagctagcacatagtaggctgctcacatccactctgccacctatgctgtggcgaagatgaactgagctagtggagctcattcattgatagcattgataggtttgttttcaatccacaggttatcagcacagtattcttcattaaagtagaatctcaactttgcaaacatttcatcagtacatttgaaattctttccttagggcaacaagattatctcacatgctatgtgtattcagaatacatattaatatacaaaattgtaaatgtaacagtaaaactatgtaaaggaagcctgtaaagctaattaacactaatttttttggtgtgtatttcgctaatctttccttaaagcactatttgcctgtgttctattagccaggtattgcttttacctgtaatctgtaacgacttttctggtatccctgcagactcttctggcatcggaggagctgccccatgtctatgaacaatctgcatggggtgcagaagagttaggccccttcctacgtttgtgccttatggatcagaatttcccagcatttgtggaagaggtagaaaaggaactgaaaaagctggcgggtttgagaaattaatgctctatatacatatataactaaggaacttcaaagtattgaaaaatgcttcctcctaaaattaaagaagatattagaataaagagtattatccaaacaccttttatcaatgttttatttttaaaaacaggtgaatccacttttttatacatcattgcacttcaataattacacaaaacacacaagtacatgcatctacaattacgcaccgcatgagaaccgttaggttataaaatctatcatcaaccagtaaatcaatgtgaaaaaatacagtgtcaaaccaaaaagtataactatagttgcatagaatattaccatgctataacatttcaaggtcattggaaacaaaagaaaaattataaaagtttgccttgattgaatgaatgtacaagaataaggttcaacacatcagtgcaaaaggatttatgaatttacatgacttaacagaagaaaagataatcacttaaaaagcaatcatacgtatatactgcaattcattatacccattcagtggactgttccagcttattaaagtcacaggttaagcccttaaaattatagatttcagtttatattactcatctttatgtaccagaactgcacaatttcctcatctgacaacatacaataaggaatgaatatcagcagcttaaaaatgaaacaagcatttactttattttggatttctcccacccccaaaaatataaatatatatatatatatatttatatactgtatatatctgtaggttttgctgtactttacaaaagtgtatcactagatggcagcagtgcattttagagctttgccaatttaacagctgcattaagtaaaaaatggcgcatgcatgatctgatcctcagaggaccttttcacttctatttaaatattttaacaaaggaaaaaaaaaagcaacattcacagcacatcaagcccaaaatagtttacaccttctacactgaagcattgtttaaaatgtacctggctagatcacccttacaggagaggctaaataaggcatgctttagacagtcattgtggtgttgctcacttgaaaggggagagaaccaaagaggtccaagcagaaaattttagcaggtcatgttgccaccagtttcaggaacctaaagatctgtaaagaaatatgtatttggaaattataaagggattatgcactgtcactcacaactacaccgtgtgccacacaaaactttggttcaaacagcacgctcagggatgtggtgtgaaattctgatctccatatgcctaacaagatgacattctggccctgctgctacctggccattcttgtcttgcccccagacgtgaggtaagactagtaggcctctgggaataagccacctaagaaggtgacaattttcacctctttgtaaagatataatagtagtgaaaagtgttgattttaaaatatgtcttctgaaatggcatttatataaacatgtgacacaatgcacctgatggcggggcacactggctcatgcctgtaatcccagcacttctgggaggctgaggcaggcggatcacttgaggtcaggagttcaagaccaccctggccaacatgatgaaaccccgtctctactaaaaatacaaaatttagctgggcatggtggtgggcagctgtaatcccagctacttaggaggctggggcaggagaattgcttgaacccgggaggcggaggttgcagtgagccgagatcacaccactgcactccagcttgggcaatagagtgagactccatcttaaaaaatccaaacaacaacaaaaaacaacgcagctgaaaaatgttcctttccagtccctaaactgggcagacagaactggcttcatcagtatcagctgctctgaaatgaactaaaatatcttataacaccaattactgaagaatttgtaacaaggtcaatagaggcacattcatttgaatataatttttaagactgctacagaaggccatacttacattgtaagcagtacttaatttgtgtttctctggcgcaagtttttatctttgtgattgttggtagagttggttttcctttggaggaaaaattgcattacatgagttaaactcagtcaataacttttcaaagtataacacatggaaatacagggactctttcacttactgccatccctggtgtagtgagaaattttgtggcacaatatgagtgcataaaaaaacattccttaagtagctacaggttaagtatccctcatctgaaatgcttgggatcagaaatgtttcagattttgaatttttttagattttggaatatctgcattatacttaccagttcagcatccctaatctgaaaatccaaaattcaaaatgctccaatgagcatttcctttgagcctcatgtgagcacacaaaaaaaacttcagattttggagcatttcagattatggattttggtagtaggtagactcaacctgtatatacctcattttatcctccttttgacccccaaggcagacgagtactttcccttcgaatccggaactataattacgatacaggtgagaatatgtaaaacttttctccactgaacacaacaccactgtcccttcttgataaaaggtaatcataagctggcagtgctgggccctctggtacttaacaaatttgggtgctgtttgtctgcttctcactctttagtccaactctaggagattctgccgatcttagattgattccatacctgcagtaccctctctcttggatacgagcaattgttaatggggctagacagtttatccaggctatagttcagcctcaaattgcattacatgagttaaactcggtcagtaacaacttttgaaagtataacacatggaaatacagggacccttttactaccatccctggtgtagtgagaaattttgtggcacaatatgagtgcataaaaaaacattccttaagtagctacaggttgagtattcctcatctgaaatgcttgggatcagaaacgttttaacattgacaaaaccgggagcctcagatatactggccatttcccccacattttaagtatatcaaatacacaaaatttgaaaaaaaaaaaagttttttgcatggtattccactttgtatggccactggaaaacaagactgcataacctatcctgagaatcaagtggtttttagtcagatctgtgtcaagctaagaaatctacactgcaaccttcatttccactcactgtcttcccctccaatcttagctactccatttgattaaactgcaaacacaacatcattcaatcagatactgttgaatcaatgtccaataaagtacttacattggtccagctggttcatcatctacatggtgttcagttttttaaaaatccatgagagataagagaagaaaggagaaaactgttagattctgcataaggattaacagaatagcaaactgcaagtggcaatcatggctactcacagcatttattaaaggccattccatctggaggtgcaaaacactcatggagttattatttctagattcaagtttaaatggcaggtatgttgtttcaatggttttagttaacactttgaatgcttgtcatgaaaaactgcaactgtagcggacagataggctgcaacattgttatactcatcttgtccccaagttccagtggttcactcttaaatagatgagaagacaaaccaacatttcagttgtaaaatcctgctgtttgttttcttgtggtgaatgcatgcagttttggctcaatcctgcaatgtgaatggatgtgtaccatctgtacatttagccacacatcctcacttccccaaagggcactctgtttttcttgctgttttgtaatctttagaagagtctttagtctggagaatgagattgagaagaggcaatcacaatagttcaacctaaattgggtcagccatgctgggctatgccagcaacaagtgtatgtataccagaggatgttctgtgacacaccgaggaaagctgaacagtggtgacatccctctagaaaagacttcagaaagacaggctcactcctgtgccctggccaaaaccagaagccaaacccaggggagccatgagataacttttttaaaatcaaaaagctgacattatatgagtttaagccttcttaaattgatactttatgattctgatttataagtctttcgtgtttcaactaagtgcaacttgatcccctttaagcagagatacacattcacagagagagaatgttttaaaaagacccacaaggggaagggaacaagtaagtgctcttagtttgtttttattatacaaaagtcaggtaaactaaatgattcagaacagtttgatttcactgaaggcttctagaaaaattctcagcaggattccacaagggggcttggtgcacatgaagcagttatggagattacagtctcagtgtaggcatctgcaggagcacatgtcgggagtaatgtctgtcagagggagacattgctccacctgttccttcgaggcaacggagaggcaaagccaccgccagcacacacagtgactggagcaaaaaaggatttcaaaaaaaagaactaaccacaaaccaatgactcatcagccaaaacaataggctagcgacacactagtgtccacaggagtccactactaacaacagtatacactatcaaacgggtacagagaacaaactaagacttaaggacacccaagacatctgtgtgctgtgtatgcagtggagagatacaaagacataccaggtactaagacacaaaagcccagcctaaattctcccctcacaacatcctaatgctcagcatcccggccaagccagctcagctacatgctaggaactaagcactttggggatttaaatgaaaagacataggagcaaacttggaatacttttagtgctctggctgtgcactcgaaaatacaaaattctaatgcaagagagccgaatcaagaatacaccaatctactcccaaatttaaaataaaaagcaggggagggagaatcgcaatagccaggctaatcttttcaaagcatgacactgtaggcaccaacccaagcacctcacaccacgggctgtttttccttttggagtgtgggtattccctggtgtctgattagtaatgtcactttccagcccaacaagctggtaacatgcaaagggttgcatggaggtgttttagcgacagtgcctccggcatagctgccatgcctgcaagtgggagcagttgagattcacaagggggcaaaatcccaggagccctcttcatctgtctccccaaatccactttcacactgacaaacaaaagagcctcatgtctccccactctcctggactgaatcactatctgcagcaccactctcccctacaggtcagacaaaaaaacgacttgacccctaacagggaagtcaggggagagggaaagaacagaattacagaaaaaagatacagaaaccaaagtaaatgaggattaaacagcaaactgaaatccaaattagttgtgaaagtgaatgaagtaaacttgaagaaaagtgttaacattatgaactgtgcatcgtatagactgaagcggagattaaacaaactccaaaagcatgcatatcgctcacttaccaccatgttttaagggtttgatgcaattgaggggggaaaaaaaagaagtcatagtaaccgacaaatatcaacataccccaaaccctcaggccaaaagatagccagcttaaacaatgactgttctctccacctcagtattacagccactggctagatgagaggaagaggactggggggataatggaaacaagatgcttctggaatccaccttatgagagtgaagttaccggtggaactgtagcacacactgatttatctgcgtgttccatcttcccaaccgaatggaccacagccctcactccccctatatccgcctcatcatctagaaggggtgctctgcaatgtctagtaaataacggattgcctaatacaatatcacctccaaaaagatggctttaaagtccgaataatgaagagttgactctctggtcaaaggtcctttgtcactgcattcatctcactagaaggttttatggtttctaaatccacttaaattttgcctgaccttagcaggttagcattaaacccaagagagactgagttacttcctatttccttccttgtttggtcctattgcattttctccatgaggtaacttgttattgacccagatggcccctagttaacagaccagacaccgaatgcatgttttaggtgtcattttaaaagtcacatttcttttccaatatccctagtctgtataaagcttcatatgctaccaaatgttttgaccaacgaatagattttggaacattagaacagctcttcattctaaagtgtctaaaagagcttggatatatcagagccactaaaaatggccccccaaaaaacctcaaatatcttctccatcagtaacttaaagagagtccctttgacttgcttataaaaaattatcccaaggtaaaaacagaaagttcttttttggtaccagcacttcttttcttaaatcagctcctgttttaatttgctgtctgtgaggtcactaaaatatccagaagaactgcaggcctcagcaactaagtgggttcactccccattcctccagggcctggggaggggagactcaggagcacaggctgactgctcctggagtgcagtccgcaggacaccaacacagaaggtgcacccaagcaggtgcccagctgtgacatggatggaagcctagaggctgctagcttgacctggtctttttagagaactatcatttaacattttcagggaatacagtcaagtggtgagtcaagtgaacaaaacaaagctcttatttgactccatgattcacttgttcctgaaaatactgaaggtaaaggtgatctgtagattagtccacctacaagacaacctagtgggcactgatcctcaaagagaccatacaggggactaaaggaatgcaggtgggtgttttcatgtaggaaatggtctgagaatactccagtaggtaaagaaaaaagacatggggctttttttttttttttttttttaaaggaagcagctaaacctcaatcctaagcattttcaatgtgagaaatctaaatatttgattttctagtgaaacatacttaaactaaactatgtaagttcaaatttgtgcttttatacttttgtattgttcacttagtgcttttgtagtaaggggatgagttaccaagaactcacagactgcccaaaatatgacgactgtgcattcatataaaaaaagttcagtgagtctgaaatgagccatgggtgtatcttgataataaagtgctatttggcaaagtagaagtatggcaggcctataaaaaaattcccattttcctaatggtataaaaaaaatccaacacagagccacagatggttatctgataggtaaacacttatgacctcttaacactcccaagtttgtgtcaaatataatgtacctcttcgtttattccaaaaggagtgtacgtatatatctatatgaaaatttggggagaagcacatgggaaggaagcagacaggtaagtttgtccttcctatggagtgcacaggggttgaggggaactggctaaagaaggaaaaggcagagaagaaggaaactcaccaaagaacattcaactttttcttttgtttaatgattacttccaggaaaggagaagaaaagcgggcaggggtggaagcaggatggagtttgagagaaagacagaaagagacagaggagaaaaacagaatggaaatactggagcaagggcagggtgtgaagatggagagtggagcctggcccacactggctgtcaggaagggaaggagagaaggcaaacattgccatcattccagcatctcagatttttcaccccaatgcaacaacaacgaagtaaacgctgctttcattacaatactctcccaagagactagagcaaggaggttttactttgcacttaccctgccgtcatctcttttaagggtaggattcattcactgtctataataacttagtttaaaagaggtactttccctctaggaagctgttcagatttgctggccacagatgtctcctataacaaactggtcccccatttgatttcagtaaccaagaaaactcttacaaaaaaagagctgcttccctgggcaggtgtctgcacttatccaacagaacaatcctaaccatttctcaaatctaacctaccacatgcactgtgatagcaacctcataagcgcggtgacttcttagggcaaagactagacctctgctgggaacacgctaggctgctgcatcactctcaccagtggcagccagccttgccttaaaatttaaaaatcaggttctgaagtccatctctgccttctcttacctgactttttagcttctcaacctttccaaaaggcaggctgaggaaggtggtattggcaaagcaaaagcattctggggggataaaaaggcccttttcaggaatgaggcataactgatcccacagagccaaagctgaaaacacacgaaagacaggcaactctttccctttactcccaggtctaaataaaggtgcactcttgccttgggagtcctaatatgtagcaggaaagaaatacctggagagaaaaagcattaggagtacatgaaatcccaaagaaagcaggttcacttcataaagtaggaaagtaaaactcatggggacactcccaggttgcaggaaactagagattcatttgcagaggccgtctgctcccagccaacgtccttcccacgcctctgcccagctcactgctgagtgcacatctggagggagtcaccagatattgtcagtgtcatcaacaaacctcctcaccagccactcactctacttactgcaggcagagagatttataactgctgagaagaaaggaaaagatggggaaggggctgttgctctcaaacatgtcctcccagagagtctaaagccactggcatgcctctggggccacattctttctgagggagcaccagatgtcactttgtattctccactggacagccagctctgtggggcaggatacagcaccacaggtgcacaaacacaggccccagaacagctggactacagctggcaaccccaccatcaccccgggtaggctaccactgagcccaggggcacacccatctgtctagtctagccagggacagactagtggtggtaacagtcggccaattaatttctgtacgccggtcatgttatagggtggggatggggagccagctgggaacctgaagtactgcagatacaagtctccatcagcagcttcccccttcacaggaaaaatcgatcaccaaaaatttcccaaggcttttctgactctaggcatatccaataacctaagatttcagctcttgctctttccagtgctcagtggtgtgctgtggttctgctgctaccatctcctcccttctctgaccctaggccagcttgagggcacagcctcggggcatggactccatttgttccgcctttgctatctctgtcttacactagatgggtggatacatcagactctcctttgtctgtgagacacagatggaaagccacccagcagagagcgctggaaacctatcaaagggaccaaccaaggaaccaaaagctggcttgttccaatggcttttctgagaacagtctgactgggctggggcagttacctacaggggctacaccaggcaaccatgtgacaaccagttagataccttaaatctgcctgaaaggccaggtggcctgccatcttggggtggcttctaggcttgacttggattctcctcaagctcaatctgcctgatgatctgtattgaaggaggacagagctgaacaaagagactgacagctgcccattcaccacatggggcctgaaaggcagatgggactagggtttggaaaacacccaaacagagggagagagctaaggacagctctagatggctaatgcaaaaaaaataaaaataaaataaaaataaaaaataaaaataaaaaactcttacgggtagggggttaggaactggtataagaattttccttctttcctttagggattgaatcccaacatccctatagtcctctttgggtacttggaaaccacccgaaggaaccaaccccagcagtacagctattttgtagggatgctcttaccgtcaggaacctcatctggcctcttcctcttctcatacacaacaatgatcaccacaaggatgataatttcagccagaattcccaagaaaggccagagtggggccaggtggctccgcaccctgaggacagtgacaacagaggcggagccaatggcgttggtggcattacattcatactcgccagggtcttccgtgatctgcaggttcacaatgttcaactcagtgtaattttccttgttgatgatgaagaagcggccagaggtattgacaatgtcctgcaaaaaagtgagaatacacaaaggtgagagtgagtaactgagctaatgttcaagagagggtgacactgctctccgttctttttaggcaccagccagaatgaggaagcagtgtctaggaacatttcattaatgatttcccttcagtatcaacaacaacaaatcaacttctgacagagccaggcaagcctcccttaccatcggtcctccagacttccccgacttccacgaagtgagtgcaggtcctactgcctggagactcagaaaagtccaacaacctagtaaatgctgcctccaacaccaggtaagaaaccacagcagaaagaggacggcagaaggaggggtacaacccctacagtcaggcatgcctcggggacctcaggcctctctgatgacctcagagtcagcacactgacttcacacttggtgagttctgaggaagtctccttaaacttcctccacaaacaatgctaagaactcactcctagtcagactgggggaaattcataactttcctttcatttaaggactagaggttagaggaaaggttattcaatcaatcaacaaatatttgtggctgggcacagaggctcatgcctgtaatctcagcactttaggaagctaaggtgggaggatcgcttgagcccaggagttcaagactggccttggcaacaaactgagaccccatctctacaaaaaatcaaaaataaaattagctgagcatagtggtgtacacctgtggtcccagctacacagaaggctgaggcaggaggatcacatgagcccaggaggttgctgcactccagcctggtagacagatcaagaccctgtcttaacacaaaacaaaacaaacaaataaaagagaacaaatatttactaaaatatgctgcatgctttatatcctactaagggcaggtgggagtgagaaggtgagatagggagaagacagacctagaaatgaataaggagcttggcctcaaaagggaaccagacatccaaaaagggatgactgatttcaggaatgtgttaagaagccccaacagagcgtgtgtatagagtgctgtagggcacagtgagtggccactgctggaaagagtcagggaaagcttcacacatgagctaacatttgcactagactgtggaggaggacagctgatcaaacagggaggagcagtgcaggcagggattcgcatgggtgtgaaggcagaggtgcaagagtgcacaggcagaggtcgggactcagcgggatggctcactgcactcagctcatgagatcccggcagggaaaaaacagactcatgtgtctttaccctgcaacaactaaagcacaatcagaaataggagagaaaaaggggaatattatcctggaaatgattctagatatggcatacaatcttgtcagcatttgagtgcaggtacatctgaaatggggaactcgtaagcttttaaaacagctagtctgtgatgcctcaagcttcatctttcagattaaaacacatactgcgttaattccaacctgctttggcaaaagctcaagggcactccttcccagtgaccagcagagagaagtggacatttcctctccagtgccttagaaagttcagtgtcttgtaaaaaagactcagcatcttcacctcggcaatcctcatcctgctcctcgttaacgggtctctgaaatcatcgctgatgttggagtcattatcacaactcaacattttattatcaagatgtcatgaagtaggaagaataatggacttgaaatttaaaaaaactagatacaactcttggttttgccactaatttatcttggctactatggaacccttccaaagaagatggattaatgatctttaaggtccttttggattctgaagactgataatcaaagaggatccatgggatcagaggaacgcttgacacgctctctgacagaaaaggtaatgggtcaacaatcataatgagagagaaagtgaggttctaaagctctgactctccaaacaacatcatgaatcatcccactgatcggaaaagatgttctctttgacattttctggggcaaataccgtcaggttcccaatgtctaaggctgccaaggctgcccttgggcctcctcaggttgccccgattccttatcagtatgttctgtgttgcaggaatgtactagtaattgccctcagtaccttgggcctcctcaggttgccccaattccttatcagtatgttctgtgttgcaggaatgtactaataattgccctcagtaccttgtttcctactaaaaaaacaaggcaggttctctaagaccacttcaaaaacagtattttcttcaggataaatggacgagaattaggctcggttctttcagtgtcctatcctgaaggcaagtgatatggtttggattttgtcttcaccccaatttcatggtgaattataatccccagtgttggaggaggggccttgtgggaggtgacaggatcatgggggcggatatcccctttgctgttctcctgacagtgaattctcatgagacccggttgtttaaaagtgtgtagcatctccctccttcactctcttcctcctctccagccacctaggacctgcctgcttccccttcaccttccaccatgattctaagtttctctacttacagggatcacttaagaagaaataaacagcaactgcagtctaaaaaataggtaagtttcaaggatcaaagaagcctgagggggaggctaattctttggatttagctttatcttaactatattacctgtcaatgcctcaccttcagttacagtaatctgaaagcaataaaactcaaagcaggccagatgtcactctgttgtctaagataggaaagatcatctttcctgtgtttcctgaggcctccccggcaatgcttcctgtaaagcctgtggaatcatgagccaattaaaccttttttctttataaattacccagtctctggaagttctttagagcaaagtgagaatggactaatacagtgagcaatctaatctcttaccagagggacagctttaacaaatcacgtacagggatttttgtgctggaagagactgtcaatgacctcttgattcatgctgtaaaccgtgactctagaaagggtgaccctcgccatgcacacatccgaggatacagctactacagtaactgacccacgtgtctggacctctgcagggaaaactccagcaaccagagacccgggcctgcctcctactcaccatgggcatcccgttctccttcttgcgccatatccagtctgggtgggggtagccaactgacttgcaatacatagtggcatcctgcccttcattcttgttctcactccgtttatggccagtgatgtcaggagcggctgtgagaaagcgttagacgcagttaccacggaagtctactccaaacaggatacaaaggccccaccttctggctcagagccctgcttgtaatgtagtcagtctttatgcttactgtcatactcagctttgatgaagagcatttcaggtcagaatagggtaaagggaccaaacccatcctctaccccccacccgctaaagatgcccaggcagataccagggttactaatatatgaggctctactaatgtaggtgattctccaacctactggaaaaggatgcaggtccaactgccctcaattaagcctacctttaaagaaaatgcaaacaaacactattatctcttctatcggcccaagttttttcttaaaacacctgcatgaacaacagttatgcatcctgtcaaatatcacacattcccttaaggaaatgagattctgagataaaacaactacaatcaagtcctattacaaggtatgtaaaaacaatgaatgcttggagaagctactcaataagtaacaatgaccaaggctctcccaggaaagagggaatccagaaactggtcttcacaaggaggaagaaaggaatgaacaggaaattcaaccagtgtcccaagagattttttttttaattgaatgactgattgagatggggtcttattctatcgtccaggctggagcatagtggcatgatcgctgctcactgtagcctcaagctcctgggcttaagtgatcctcagctcccgagtaactagaactacaggcacatgccactacacctggttaatttttaaatttcttgtatagacggggtcttactatattgcccaggctggtcctgaactcctgacctcaagtgatcctctcaccttggcctcccaaagtgctgggattacaggtgtttgcatctgcacctggccctaagaccttttattaacaacttaagaatctgccttggacacctgatttgcaacagtttcctagactgaacccaatatagaaggaatttcaagacatgctagaggccgttggtcttctctatttatagggatcacttaggaagaaataaacaacaactgtagtctaaaaattaagtaagtttcaaggatcaaagaagcctgagataaaagcgaattctttggatttagctttattttatcataactatattacccgccaatgcttcaccagttacagtaatttttttggagacagagtttcgctcttgtcgcctaggctggagtgcaatggtgtgatcttggctcactgcaacctccaactcctggtttcaagcgattctcctgcctcagcctcctgagtagctgggattacaggcatgtgccaccatgcccagctaattttgtatttttaggagagatggggtttcatcatgttggtcaggctggtcttgaactcctgacctcaggtgttctgcccgcgttggcctcccaaagtgttgggattacaggcgtgagccatcacgcccggctaattttgtatttttaggagagatggggtttcaccatgttggtcaggccggtctcgaactgctaacctcagatgatctgcccgcctcagcctcccaaagtgttgggattacaggcgtgagccaccacgcccagccgggttacagtaatctgagagcaataaaagtcaaagcaggctggatgtcactctgttatccaagataggaaagagaatcgatatgccttggtcccaattccagttttgttggttctttcgttattctgggctttgctgctacagccattatcaaatggagacacctcgtgtccttgtctacctcccagtgttcttgggtagatgaacaggatgtcaaaacattcatcttgagactgtagaagcctgtactattgcattggggctaatctcatgttccacctttgactggcttggtttttcttggcttaaaaacaatgcaaagtcctactagtcacagaatgtgcttcccaggcacaaactggttttagactcaccctccagaggcacctggatgggcatgcactgggcaaggccccaagctgtctctgtaaccagtccctgccaaactgaggcctgctgagtaacactcagtgtgaagtgttttctagatagtacgtttcaaaggaaatatctttttttttccaggcaaagtttcttactacagaaggaagtggtcaacctggctctatctcattcccacaaagccgaacttttcccacagctactcagtcacttcttaggctgactgttcaacctggtcaccctttctcagagcttacttcagtccataaattccaagcactccaaggagcaggctccatagccacacaggacccagcatgcccgaagggttaccatgtgctgctccagccagccatgcttcattcatctggcaaacacctgctgagcacccactacacaccagatatgtcagactggttgggtaaggcttttgtgatgagatgaactttagcatggtcgtgaagaaaataagggagtatatacaaggttcctgacctgtggtaagtaaagaatgtattttttcttttttgagatgcagtctctctctgttggccaggctggaatgcagtggtgtgatcttggttcactgcaacctccaccttccgggttcaagtgattcttctgccttggcctcccaagtagctaggattataggcatctgccaccatacctggctaatttttgtatttttagtagagatggggtttcaccatgttggccaggctggtctcaaactactgacctgaagtgatccacccgcctcagcctcccaaagtgctgggtttacaggtgtgagccactgcgcctggctaagaatgtcactttctaacaggccaggaaccccaagttatcttgggacctcaagaggagaggaatttgcccaactcgtaagtatttgagggtacaaacccatggctgggctcgactttttaacagtcttatctgagattcttcatggaacagagttctgtcaaagccaatttaaaaagcctaagtgaaaaataactactcttgctgcactttatgcaaataatcaggccaagtacagtaagaataagtttattttataaataaatcagttctatcatgatttgtttttaataaaaatggggactggagagagaaaaattacgcttcaaaagaaaaactatagtatactgttgttagctgttcttgaggtttttttctgcagtttagatgaaattctaaattctttgtgggttggaagtccccaaactaatgctttcaaatctttgcttttaaaattgggaattgtactcctcatcctaggactcgttatttaccttacagtaggctgttcacttaaacactgtagtaaaactatagatgagagtagtaatgtttttcccacacaagccttggaatcctagccaggcctgcatgagtacactcagacagttacaaggtggttccactcttctcaccttggggttcactcccattcccacaatgtcccctatcagcaggaagaagccagagtgatctacggccttttgccatcttcagagcctacaccttaagattaaggtgttataaaacccaaagggagagactgaaaccgtctttgcaaaattatgactgagacagggaaagagatcgaacttaactgcttcatcttacttctaacctccaagctgtccttgttcactcctgggcgcaggctgaactaactttgggagaaacttatagtttaaacaaagatggtaacaaccctttcccaaaacagactcccttcttgcctggggactagattgcctttgtagaactaacattagacacaagattagaaattatggtttaggagtcatgcagctggaagctacaagattctgaccctccctaaactgctcctaagatcagtgcttgagatattttgcagaccttgcacttgatggatcagctggccccacccagatcaataaactggctcatctgatcctgtgacccccacccaggaactgactgagcacaagaagtcagctctgactccctgtgatttcagctctaaccaatcagcactcctggctcactggcttcccccaaccaccaagttatccttagaaactctgctccctgaatgctaggggagactgatttgaatagtaataaaactctggtctcccagcaaaaaagaaaagaagggagtaggtcacacatatctgtaggaagaacactctaggtcgagggaaatgcaaaggtcttgaggtaggattgtgcttgttatgtacaaggaacagcaaagaggatttgattggaacatagtaagcaaggagaagagagcaggaaataaaagaaatcagagagactggggacccagattagacaggactttgtaggccaccataatgactttggcagttacagtgagtcagccgggaagccactggtgaatactatgtgcaggtataaaatgatgggtgtgttttaacaggctccccgtggctactatgtgaacaagaactgcagagacagcagtggaagcaagaccaagcaggaggctattacagtaacccaggcaagggagaggctggtttccatgggggcagtaacagtggaaataaggagaaatggtgagattccaggtatattttggaggttgagttaacatatttgctaatagattgaatgtggactgtgagaagaaaaggagtcaaggatgacaccaaggttttggcctgtgtaactgtgagaatggagttgacagttactaagatgaggaaaattgcaaaagaataagagtgttttttgtttgcttaatcttagtttgttttgttaaaagactgagaaacagtggtggtaaaaaccagaaggtcaaggtctagaacatggtaagtttaagatacttatttaacatatggctaggtgtggtggctggctaggtgcagtggctcacacctgtaatcccagcactttgggaggccgaggtgggcggatcacctaaggtcaggagtttgagaccagcctggccaacctggtgaaaccttgtctctacaaaaatacaaaaattagccaggcataatggcaggtgcctgtaatcccagctacttgggaggctgaggcgagagaatcgcttgaacctgggaggtggaggctgcagtaagccaagatcatgccattgcactccagcctgggcgacagagtaagattctgtctcaaaaaaaaaaaaaaaaaaaagatacttatttaacatccaagtattgggaaggctgaggcaggcggatcacgaggtcaggagatcaagaccatcctggctaacacggtgaaaccccgtctctactaaaaatacaaaaattagccaggcacggtggcgggagcctgttgtcccagctactcgggaggctgaggcaggagaatggcacgaacccaagaggtggagcttgcagtaagctgagatcgcgccactgcactccagcctgggcgacagaggggactccgtctcaaaaaaaaaaaaaaaaatccaagtaaaaatatcaagtaggcagtaaaagagcaagtctggagttcagggaaatgttctatgttagggatataaatttcaggtatcagcttatatgtggtacattttcccattttcattctcctttgacccaaagaagacacccactttgggccagttattggcaatagtactatgaattcagtactatcagcttttgctttggggactcatttccaagactgtacattagaaccatctagaatgctaaaagttgagtcggcagctgcactgcctctgaaaagtcactattctgaaaggacccagacttaaaggtcaagattgggaagggggctaggaacagtcttcactcctgccttggtgtgtgggaggaggagaacaccacttcccctctttatttgacactctgggaaagggtggccgccatactgggggacactcaaccaaccaatggagaggggcacactgaggaactgagggccactgccaagagccatgtgagtgagctgtacacatggagtggatcctccagctctggtcaagctttcagatgactgcagctccagccaacagcttgaccaaaatctcaggaaagaccccaagccagaacaccccactaagctgctccctaattactgactcaggaaaactgtgaggtggtaagtgcttagcattttatgccactaagttttggggtaatttattatgcatttttgtatgtatagatacaaatataccaattgatgaagcagacattaccccactttttaaaattggaaaactcaagtttggaaaagtaatttaatgtttaaatggtaaagccagaatccaagttcagggttgtgtgaatccagagactatgctttttgtactttaacatactgaggggaaaataaactagaatagagtccacaaaaataaaaatatacaacatgcgaggagggagaccattaggacaaacacctaatgcatgtggggcttaaaacctagatgatgggttgataggtgcagcaaatcaccatggcacaagtatacctatgtaacaaacctgcacgttctgtacatatatctcagaacttaaagtaaaactttaaaatatatatattatatatataatatatatataatatatatataatatatataatatatatgtatatatacaaaatatatttatatatacataaatatatatatacataaatatatatattatatataatatagttatatatgtatatatttgttatatatgtatatatgtatatacatgttatatatgtatatacatgttatatatgtatatatgtatatacatgttatatatgtatatatgtatatacatgttatatatgtatatatttgttaccatgtattactggtaactgcagagcaaagagcccaaaagttatctttccttgtagatgtgctaaaacaccttagacccaaagcagaaccaatttaccttagacccaaagcagaacctatttacctgtcagactttactctgtattagtgtagcgtaaagagcagagcttcagacctgaaaacatggaaatctggacttgatctcgactctattactcaccaactgagtaacccagggcagatcacgtcaaatactctgagttttagtattgtaaaataagagtaatactcacatgtttcagaggtcttgtgaggattaaattacatctccatactaatctagaacatggttggaactcagggccaagcatttaaacatcagtcagggaaaggaaaggctaaggcttcgactctgtcattagttctaagaaatcaaagatactgattactatgtgctctccccatttgctgatacaaacaggacttttgtttgtagctctaaaaataaggtttaatcatgtcagatactgataaattatctgattaatggcctattttagtgcctcaccttctatggtcttgccttttaataagggactgcttaaccagattttgttggtctaaaagcaggtctgagcgtctaactaagccttcatatcctgaaggagacagagacaatactctgtgcttctctttaccctcttaggggggcacagactaagtggcaagagcaaggggtaggagcaacaaagtaacaaaaagacccttagaagagagttctgatccactcaggaattcattcattctctggccttgttagtcacatattctagtcacactggttaatggctatccctccagtatcctaataaatagcaacacaggggtcccaaaagagtctctgttacccaacagcacctgaaccaatttcattatctgggcagtctgggactctggctgaggacgaatgcatgttccttagtaccctctgctacccaacctgatgcacttagagcaaagggtcagcttctaggccaggctggatgctgtagaaactgtcaactcaggccatggaggcacgtttcagatgatattaaataaagttaacagaacagacttaagaaagtgatcaagatataaggcctctttacagacactgcttatatggtgctctttttttttttctttttagacagagtttcgctctgtcgcccaggctggagtgcagcagcgcgatctcagctcactgcaacctccgcctcccgggttcaagcgattcttctgcctcggcctcctgagtagctgggaccacaggcgtgcaccgccacactcggctaatttttgtattttttagtagagacggggtttcaccaccttggtcaggctggtctggtcttgaactcccgaccttgtgatctgcccgtcttggcctcccaaagtgctgggattacaggctcaagacactgcgcctggccttggtgctcactttttaaagcatgttcataacccagcaacttatcttcaaagaaaatctatccttaaaggtgttgtcaatgactagcctgtttccaagtaaacacagagattctgcatttacggtctatttgcttccttcatgcaacctatcaaatcccaaaaacacctatctttgtggtggacaaaatgaacacttggctgacggcagtgggagagtgaagatttactgcttgccaagagctatgcccaagaaggaatatgagatcagtcaagacagaagcaagaaggatgcaggcttttggctcaacaagcattctccacccacagcagatttatcattggttgtgaacactagagcagtctaggacaggtgcctccttctgcaggtgaaaccactgtgtaagaggtgtagaagtttccttgaagacagtgaccctcaaccctggctgtacaccataatcacctgatgtgccttaatctgatgcccgagccacagttcatatgaattaaatcaaaattgagaaccactgttctatcacctttcctggcaccagtactagaggtcagataccccccacaagacagggagatgagtgggtagaggtgtgggagtcattcaggtgacttttccaagctgagaaactgacaaattgaaattttccaataacactaggaaaatgggcttggaaatcacttcctgcaataaccaacctctcccagcctacatccttctcccgtgctggatgcttcctgccctcaaacatcggactccaagttcttcagttttgagactcggactggctctccttgctcctcaagcgtgcaggcagcctattgtgggaccttgtgaccatgtaagttaatacttaacaaacccccatatatgtatctcctgtaagttctgtccctctaggaaacactaatacacaacctctcatctctgtccacataagggaacctagaccgtcaagagccacacagagcaaaggaaccttaaagatgagctatctcattctacttcatcatgcacttgaggaagctgagacccagagaagggaagtgactggtcagagtcactgtgtttaatggcaggaccacgattagaacacatttctcctaactcttagtcaaggccttttaaatgttacatgctcaacagggcaccatggcttggtgcttaggagcacaggatctagtgctagggtgcctgagtgagaaccctagcttcaccagttaactctgtgacactgggccagttattccctcaagcctcaattttctcaactggaaagtagagataataattgcacttatcccatagagttgtggagactaaaggagagaaaaggaacaaataatgcacctagcacagtgcctgacccacagtaagtgtgcaataatgttagctattcttattcttattaaggaaggtcagggtggcaccctgaagagaggaaaagaaagtgcaggtgtggtttttgggctgaagttaatgttcaaaatgccctagcagcttcatgatattattatgccttcaaagacttctcaagtcacagcaattctgagtcagaagcaggttgctttgacatcagttctcacctaaaggatgtcacaacctctacgcatcctcacctatcacactagctgcctttcctgactgtcagtgaagaaaggacggtggagatgctgtgcatgctgaaagtgccgtgtgaatgtggtctgggtatcactgttcttcacagtgatcttcatccccaccacactgccttagccagtctggattaatatgtcacttgtaatgcaccatgacagaataggaaataggaaggcagggcaaggccacttatagaaatcctaacctttattcttaatagtcaaatatagagaaagctaaggagtagggaggagaaaaacaagatcaatcctggctctctcagcagccaaaagactgaaactcatttgaaatgtccaataaggagggtgagatgaacctagtaagacaacaggctcaacccccttctgggctgggaagtgcctctcacaagaggcagtgacatatttgttgcaaaggattggatgaccaacaaaatcctcttccaaaaacagcaataaaattcaaactccttctttcttgtactaatcaaaatggttaagggataaggatactgcttgggagtcatgagagcaatttttttctttttactttgtaaatgataccgggatttttaatttgcttttttgtgagcactttttaaaaaaaaattttagaaaaggaaggaaggagaagagggaaggagtaaggggcaaaaggttgaaaaattataggggtagaaaatttcaacatctattcattcatgtattctctgtaaggtgtgcactctggtaccacagcctctgaagagtcacaagctgaggacagagatgccctcctcagtattagctgagtggatcccagggaggtggggctttgggctccataaggcctcatcactgctgtcttccctctcctgaccggccctgctccatcttccttctctccatctgtgcagatcacctgccgaatacctgagaaacgtaaccctcaacagtatcttcctgtttatactatgccacattgtgtcctttaaaaaaaaaaaaaaaaaaaagggagagaatttaaaaacctgctccagatacaaggcctcccccactacatgtagatactcctatcctccaaattcctttcttgacggtgatctacaggctttggttaaaaaacatgatcatcttggctctgttcccaggccactgtccctctgtctggttccttcagccttcttttcttttgtagaccacagataactcaagatttggtaatctgacagataatgcccagtccctggctaggctaaatgcttcacttcccacagtgctgagcccaaacaacaccccagaaatgttctgaaagacaggaaaaggcagatgggaaagaaacggctgagagcagaatagatgatgaagaaatatatatgcatggtctgaattacatgccctgttgtgctgattcagttaaagccacacaggaagattctcagagactcctttcagccaagaggccactgatgttctcggaacctctctgttctcaagtacaaccacctcttaactctctattactcagcagatttttcagatcactacagctataaaaagataactgtctcttatccccaccccggagacactaagggaataaaatgagagtttctattaaaatgttttgggaacatacacacatgtactactctaaatgcaaggcagtttttctaccccaaccacaattggaggttagcttagaatatgatcctgggcctatggcaaaccttttaaaacttatacagaaaaagcgaagtgttcatagtctttaccatactcaactatccataactgggaagacaagacattaaacattgaactcttttctatccaggtgttggggggagaaggaaagacagactagaattcttttacaaattttcttgagagataaacacacagtatatctatccaaggtggtccagaatatggtttaagatatttataaaacagaattccctcaaggtctacttctgtaaaaccaagatactaccacctgcctcaccttccacacagggctatttgtacagtgagaatccaacagtgcacagtaagcaccttgaatataacacgtaagttgtaacttgctctgaaaatactcctggcctacagcgtcctattctctgaccctggcaactgctgcttcctacctgctgaagagactatgaagaaagatgcctctagggccactaaaccccaccttcgtaagcagccaaacaaatggaaaaaccattttgatttccactcttgaaagtgctttttagaaatcattaactcaaagtcactaacgattacagttagttaggactaattatctcttaggcttggggagcacaatgaactagacaccccactctttccttccctcacccaccctgcctctctgcacttggactttgtgctgaaggctcagccaggaatgctgcacggcctcaagtctcacagagaggtctcaccacaaatttggctcacctaggctggggaaagccctcactggcttagagaaaatgttttcccacatccttcattttcatgttgaatacatgtggcattcttctaaaatgggtagaaaccaaggtttctccaagaaaagccactaaaaaaatcaaatgctaagttctctggcccagtgtgacctgtaactgtaactcctttaggcattcagaattaaactggcagctggaggaggcagtggccatccctacatcaactcacaagttcagggctgtgtcaccaagacattactttcttttgataacaccatataatggaaactttgaatgtgtctaagcctttcttgaatctgcatttttaaccttccaaatattttaggaagacctgaatacctattatacgggcccttccttctcctaaatttgtccttctagcttccagggataactctatggatttaaagaacaagtctgtgtccttactaagcaaaatgagaaagactgaaaataaaaaatctgacctcaaacagtagccctgccttctcatgataattttgtgagagtagaaaaaacattggattgggggtcaagacctgtgttctagactagctctgccacaaactcactgtgtgacagacagctagaggtttcacttttctgggtctcagatgcttctttgaaataacttaggaaagctgaaatttatgatgttgggtagctccaacttttatagttctgtttgcccatcttggaactttctgctactgcctcatctttcaaaggtttctattaaaattctaatgaattatccacaaacagctgatgtccactctgcacactgtactttcccctcaatcctgctggcccacagaagacctatgtaatcatacttgtaaggcactgatctaagagctttacaaagccttgggccataggagctgccagcattcaaacatttttgacatataaaaacagcaattttatgcagttcaatctattaacttatttaatcctcctaaataacccatgatgtaagtactgctgatatcctcattttaaaaatgaggaaaaggaagcaaagagaagttagtaaaccaccaaggccacacagctagtagatgatggggtttgaatttaaacccaggcagccacgatcctgagcctgtggcctaaccacaacattatattgtgtctcgacatggaaagaagaggagcttgaagactgggactccagaccaaggtactgtcttggaaggagagtgagaggctcacaccacagcctctgctgggttgtacctttcacttcaatggtggcgtttgctttaggagcgctgacaaagtgatatacgcagtggtattcgcctgaatcctcagctctcggcttattgatcctgcagagatgagaagaaaaaccaagtgaggaaactgggaacggtcaaaatataaaacagaaggagaatcaaaggggcaatcagggatcctgctctccgaacccttaatgcaactcacctccttctaactaaaagcaaaaattcctctctgtgcatcctaaaacattaatgtcttgctcttttccaggtgccaagaatacaaagatggaatggcaacatggtccctaaccttagaatgctctggtctactgggagaaacaaaatgcaaaagaagtaatcaaaatagaaggatgtccaaagtactatagtttatattcagatatacaatataaaaccatcacggctgggcacagtggctcacccctgtaatcctagcactttaggaggctgagacaggtggatcacgaggtcaggagttcaagaccagcctggccaagatgctgaaaccccgtctctactaaaactacaaaaattagccgggtgtggtggcacatgcctgtaatcccagctactcgggaggctgaggcaggagaatcacttgaacccaggcagcagaggttgcagtgagccaagatcatgccaacgcactccagcaaaaacaaaaacaaaaatcactaaaaacctcttgttcacctggtggttccagttagataaacaagagaaacaaacaaacaaacaaaaacaaacaaaaagcacaagctttctgagcttctccaaagaccttgttttggtagttctgttcttcctaccttgtcttttaggagcatgcgtttccacaagtctacttgctaacaggacccaggcacagtttaaagaaaaagaaaaaaatctgccatcagagcatcagccacagacatgcagcaaaaagtctggtgataaatcccagggccctacatgatctggcccctgtctatatccctagctccatcccatgccactgtccagatcttctggtctctcttcagtttttcaatgcaccaagcttgttcgcacctcaaaacctccacacaagatgttcctttacagagaatgctcttctcatcactcttagtctacctaactccttttccatcaggtcttggcttacgtgtcagtttattccagccccaatctaaatgtcatccccttccacaacattctctctcacactactctgtgcttcttcacaatacttatcatgtgtgtgattatatatttatgtgattacttgattaatgtccggcttcccaacagaccaagttctatgtggataggcactgtttattcagcatactatcccataccgagtacctagcctggtgcctggaatacggcaggggaatgaataaatgaatgaattactgagtgaacacaaacacagagtgaatatctatgtacagattcagatcaagttaagcagagtgacaggaaggactgtaagaagagtgtatgggtcaggcgtggtggctcacacctgtaatcccagcactttgggaggctgaggtgtgtggactgcttgagcccaggagtttgagatcagcctgggaaacatggcgaaacgctatctctacaagaaataaaaaaattagctgggcatggtggtgcacgtatagtcctagctactcgggaggctacgaggtgggaggatcacttgaacctgggaggtcaaggctgcagtgagccatgatcatgccactgcactccagcctgggtgacagagtaagaccctgttgcgaaaaaaaaagaaaaaaagaaaaagtagtatatatggccagaacagcacttcatttcaatcacacagggtgatcccaaacaagctttcttgcccccgagggtcaactacacatcaactcagtacactctggcctacaagcacatacaccaaacacatgcagaaaggttagtgagtaattacagaaagaagaaaaacatcagcctccagatgagaggataaatagttatatagggctgagttctagctcttttgcttaggggttaaaatatgatacttgtgatggtcaaatctctactgcactatttaatgtctaagaaaaactcctaaactcgaccactctggcctaatgcatttatccatcttatattgctcattccaaaaaggaaacacaggttaagagactatggacgaggagagacatagcctatccccagagctgtctcaagatatccacatggcggcacaatattctgtgagaagcagtcagtgtcttctcaatgtgacaccatgcctcttcttaaatcattatgctcccaattggaaaacagacaagtcagctgctcttatcaacaagtgttccagagtttgaggaaggagcagcagctctttcttcagggcttaaactgaagttctttgagtccaagctctgaagaaagacctgctgttccttcctcaaactcagccctgaacttaagactgaagttcttagacttctaagttctttgagaaatacttgggaagataactcccacacttgagtccatgcctataggctgaaaatctccccacaccattcccttggactagctattaggaagaaattaaagcaaagggaaaacgttccctacaggctgggcagaagcagggttctgaaatcgcctcttcaggctaacttatttggtagcccaaggaactcatcagttgttatttcacgaaatgtagaatccctgaaaaactctagagatacacaacacccttggagagcttcaaataagctgaggggaaaaaagaagcagcattttataaagtcaggctgaaacttcatgaagttaaagctcagcactttgcaggcaatagtacaagacccaagagaaacatgattggatgtctgctatcttaaaggaggtatcataaaaaacaagtctaaggctggacacagtggctcacgcctgtaattccagcacttcgagaggccaaggtggggagactgcttgcactcaggagttcaagaccagcctgggcaacatggcgaaacccagtctctacaaaaaatacaaaaaaaaaaaaaaaaaattacccgggtgtggtggtgtgcacctgtggtcccagctactggggaggatggcttgagcccgggaggcagaggctgcagtgagctgagactgtactactgcactccagcccgggaggcagaacgagaccctgtctcaataaaataaaataacaacaaaaaatcaagtctgtaaaactaatggacagaacaagaaaaaaatgcttttcattccacctaacaactttatttgattaatcctttccaaactatgaggaaaattgctgaggctaaatttctaatttttttttttatcagaagaaactacagtggagataggttaactaccttgccactaagtggatggcatagcagggaaaagaaaaacaattctagaaaaaattctagaaaatcagaagacctggaacctagccttggttctagaacttattaaaatacagtatttggccttaaagcagccaagagtcactcttcaagtcctagtttccttgcttgggaaaaaaaggatccacaaattcatttggatcaactaaataaggggtgtgaaaagatctcaatgctgcaatatcctgcagaatgcccttgctatcactggatacacaggctttcctggtctcacctcagtgctctctttctttgcactgcattaaccttctaagcaggattagctgattcttttccagacagccttcaaccaggaacaaactattctgcaaggtggggtgccatgtgttctagatattccaaaaagcaccaaatatttgggtgctgggtaactctagccagcaaatatccttcttttttcaaaggatatttccaggctaccatcctcaatccagatcattcaagagccctgcatctgctggtccttatcaggttacagtgatgttacacactcctaaaagggaattcacaggaaatctacccagtggaaagatggcttagggagatgtcttgctctacagtcacaaagcagacttcaatctgtttcttcaaacctaacttcaatctgactggattaggtcaagagactacattctaagtgtgactctcctattgactaacattgttaccctgaacaaatcactacttcacagcctcagtttctctatgattatagtgaggggatcatctatgattctccaatctggctgctcattagaatcctttgggaatcttttctagactactgggccttacctgagatactggattggactctcaaagggagaaccaaatatatctcatgtcccttctgcatggcgcaactatggattatgaatgtcaagtaagctcagccacactccctcccaccttcccaggagctgcccaccactctcacctgtactccatgttgctggcattcttacgagtggcactcagttccaccccattctttgtccagtagctgtatgtaagggtgtgagagctggaggtgaggttacactgcagggtgacagggagaacagggctgtctcgaataatgacctcttcactggtgacaatccttggctctgtaataagagtgcacaatgatagggggcaatagccttccatcctctgtagccctggcctgagagttggacggggtaggagggggaaactagaaaaagagggagggcagacaggaccacatgaggaatttcactttaccactttggaggaagtcaagaaaggaaaaacaatgattataagcaaatgaccactagcgcagacaacagcctgaagaccagttggcctagacgtgaaagaatgggagtattacgggtgcttgtactggtaataatccacttacgtttttgaataccacctttttataagaaccaccaaacaattcggcttcaattagacaaccaggctccaccttgccattctgaagacaaaggccatatcatttatatacctattataataaactccctattgtaccactgggccttggaacagtaataattacataatacatgtatagctttccccacatttaaatgttaaacctatggcaaaccataggccattatttatgcagaaaaagacattgtggattctaaaaagcaaacttcctattggaagtcacttgcattttccaaattttgtggaggcaaaattcttgagaaagcatcatcagttcctcctctccagccatacctattcccaaaacaagttgttgttttcagaattgcactttaaaacacattccattctgagaaaatataactagagtgcaatattgtgttggtattatgggctcccagaattttagaaaggcccttagagttcattgaatcccactctttttttaagagctggaaaagtgaaatgatttgtgcaaggccgtaagtattactaatggcaaagctgggcctagaagacatatctgactgaattctctatccttgccccccatccccaagaccacccccaccaccttgtgtcctgggcaaggtatatatacttcaccttctgattctattctgcgcttagataacctgggatcactagcttatctacaaaaataacctacttgagtcaaatattataatacattgaacaaaaatgtttaaaatcactctatattattcctggaagcttcatctttaaagcactttgaaatctatcactgtattaaagtcaagacatttctatgtttgttgtcttttgttaatgtgctttgtctttattatttccccaggcttagttttctctacttttgatcaaacatttccaggtgaagtctacactaaccatcttttcccaaccacaataagaggtatttgctgtttgtttgttttccaattctctctcagaaacccttgactgacttcccatttccctgtgtctagtcacttcctatctacagctttgcagcagctcccctcaccattttatacagtattgtgctgagccttaacgtgaggaaagaactctctccctccatgggaactaagttgcttgctgttcagggagggggaaagcatggggaagtcgtgggatacttgggaaatgtaatgtcttaaggacctcctaaccgatgtaacatttctgacttgtagagttaatgtctttgaagaaacttgtaataatgcaaaaccttaagtttgctcaattaacaaattagttctattttccaactctggcaaaaggataacggttatcttccattcagcactggtccttatcagtaacatcaaacagggtctctatgtacagataatggaggcatagcagccactaagacagaagcagatgcatgtaaacacgttagcgcagtggtgtcccatggtttccaagacacactggacagaagccaaatccctgggccttaagaagtcgagcagaacggctgcaaaccctgcaatggaaggcgcacacacaccatcagcagaaagcatcacaattccaagaaaaatcaaaaccaagcaaaaacaaaagagaaaaagatagaaccagtactccacagaagagaaattaaaaaaatataaaggcaacattaaaacccaaacacacttttaggtttttacttaatttttattatccaatttcattttctgtcccacttgggactctcgttctgggtattcctctcagactgcactgagaaagggtaaactctgagaatgaggccaagagcttccagatgtttaaatacaaggaggccaaagtaaatgctactcttacctgtggcgatgcaaatgaccactgcagctcagggagattaagaagttgatgaaagcaacctggtagactttctgccaagtattctttgaaggcaaaggaaagcactttttcccttaagtgttaaagatccaggagagagtcactgggagcaagtggataatttaaataggtttaaatatgattctgcaccataggagggttgtggggtagggtaacctgcctcctgtgattgctgtatatgaaaaacagtgctacaccaagttccttggccatggtgcctcaactgcattctgcaccaggatgaaggtggggcttttatttttgtggccaagcgctgcccaaagtccaagagagatgaacatttaggagaagttcaaatgtgtttacctgccactgatgtctatttaaaagcagtggataggagacccttaccccagccatcatgcatatataaagaacatgctatggccagagagatacctaaaaactgggcacacttctcttcttgccttacatactcaatgagctttggggaaagtactaccaggaggtcattcttagatagaacacctgatgtccccatagagcaatgtcttttgggacgctgagatcataaaacagtccaattagagttggatccagggtgttttaaaaaaaaaaaaaaaaaagcagcagcagcagcaacaacctcctggctctccaaaacagctaacttgggttaactgactgatggggaagtctgaagagagtctagccaggatttggatttgattcaaccacatgcagacaattctaagtaaactggggaatgctatgtattctcgggattggtaggtaggtaccccaatgcctcatctttttctagccccttggcatggccattctagctatgagtcaggctcttggaagtataagtgcaaatgcccagcccagtccatacctataaacttccacagacctttgtggccatgtaggtaattctgcttttataaggaaaggagcaagggggcaggagaaggaggcgtgcagggtaaaaatattgttaaaaaaaaaatcactgggttaatgttccccattttcacatagacaaggttttcttttcctctttccagaagcaggttctttgattcaacagtgccaactgcagcagcctctcctaccactgccctacaaaggactctttttttacccataggatcttcaagtggctacaaagaacagacactaatttgctattttccatctaagtatatagactcaaggcccatgtcttactactttatgttattaccaaattcctcatcaaagtaagattttactattcttactttctctagatcaatcagctctttaagctggaactggctatagatctctcattgtgtcctcaaagagaaggtgaaaaacccagaggatctttccaaaagtgaatgtcccctcaattataaccaggtttgatgtggggccagaactcttcttggccaggaacgttggttctgtggtggcttctccctctctctgcttctcaacataaggtagcaagtcactttcaagaaagagagagaagtggccacaaaagtcccggtgtcatatgtctcacgcatacctgctacaaggagaggattctgagccagctggtcagctcaccccatcactatgagaaaccaggttggaagttagtttcctcttttttcaagacacaaagaaaaggccagtgtgagtggtccccacactatgtctggagttcccatgctctgggataaggtacactgtgccaacagctactcatcagagtcaaaccgtgaacaggaatcaactgcaactctgacttccaaacagtgtgatgggctaaaaaaataataatttgcagcttagtgtcacctggctcctaacagcaaaacataagaaggaagtcccaggctgctgcttttaaagaggagactaattagcaggcccagtgaggagtacactgctgcagtagagggctgttatcagagaagcacatgccacggttttagaaaagaaaaagagctggaactatgaaaatatccaagcttacatgccacccaacaaccaaaacacaccaccacactgcacccatggcaacattcccatcacaacaagatgacaccaagtcacagttaaaggaagaggctgggcagacacaaacttaaaaccatagaggtgaaggcagctacttagagagcttcaaacagaagaacagaagaaataaaaagtagttagactggggagagaaacaaaaatagaaaggcaccagagaagaaatcagcaaaagtatagcaggaaacctactacaaaatcaaaggggagggaaaaccatttcaacactaccctccttggactgcctggttttatgagttttaatttaagcttcccagttctccctccccaactcttcccaacacagatgattttggacagtcacggatttcctcaagttctttgttcctgagaagaaagacacagagaagggttgggggataagggaggcagagagaacggcaaagaaaagaagaaaaaaagttgccacagatgttttcatacactacaaccagaagggtcatgggattgaaaaaaaaacgaagacaaggggtggggtgagtgatcatactggggaagagggaaaggatgcagaagggaagggtcattgggccacctctaatgactacagtactactactgtagggtgctggactcactctgaaggacgcttatggtggcctgggctcgaatccatgttatggaggggttttgcctcaagtcattcctcttggggtcgttgctggccctgcactcgtaagtcccagagtcctccaaggtgagccgggttattctcagcacactcacgccgtttgacccgtaggcggtgtttacggtgacacggcgcttccgagcaccgtcccacagctgtctgaaagactctgcccggttgacttctgcgtaccaccactggatctctggcgtggggctcccgaccacgtcacagtacagctcaaaggcgtcccccgtgagcttagtttctgacatgggcgacttgacaaacccagctagagggagggggagcaggaatgcagtgacaggccaatcagaaaaaaaaaaaagaatcaacaggtgttaatagtaatttaaagaaaagaaaagaaaaaagcaaatgagttgcaaagaacaaaaaaggattcatttttaaactataaagagacagtacagcaattcatacaagcttttagaagaagaaccacaccctgggaagcttatgaagcaaaggcaggctaattacaagctggggcagcccaggtgctggccaggcagaagcaagcccactggaaagcattttagcaatgggcccagctggtaggaatgagaaagcctcaggtcttgggaagagcctctttccttagaacacaaaccatttattacctttttaaactcaggcaagtgatgaaagataaccagaagaggcagtagttttatatgccaaatcaggatctctcttttggatgggcaaacgctttgttagaaatgcagtgtcttttgcaagcctcaacaagaagtattaaatgacctactggtgccttctcttgggattcagagttcaaatttcaactgaaagagtagcaaatttctctctcacacaggattctatcctgggttcgattagactttctccacctcctattcttccctgggcctatggcaaacaaacaacccagttgtttagcgttaggcagcctcttcctgaatgcagaccctcaggagaacaagacagtctgtacttcacaccacagtgagatattaatactttgtgggtcagctcagaagtgggaccaacaataccagcaacccaactcactgccagctaatggagggactgtgccctccataaccccatagatccattacctagaaaaatctgaaaagctatggtatttgacaggctccatacagttgaattgcctggcttctagaagccagctcagaagaatgagaaatgtaccctgatgaattaaactaaacactagggtgaaagccaggcctcaaccaacactcttaggaactgcccaggaactaaagttgatgcctacctctaattgcccataatttgcttgaggttacacttccataagacaaggtggaaatggcagaaagagttaaaaaaaaaaaaaatccaggcttagtttaaaaacttggagttaggtccataggaaacaaaatcagagtgcaagcatactctctcttacccttccaccccacctagggttcattcagcatttctactgattcagacagtatccgaaggtataaagagagacactaaaagagggcattctgattggcttggaaacgtcccctgggaggcctgctgcataagccaagccagcccctgtgcagtaagcagggagtgaggtcaggatctgccaacatcaaattaagaacattccagaggaaaggatgaaataaatggaactgttttcctacagtccagaagccaaggatgttaacagggctagctgaaaatggaggttactaagtggaaaaattcctgtttacatccatagcagtatttgcctttggtgataaccccacaccatggactaagaacattaatggaggtactatacttactcaagtagaggccaagacctccaaattcatactagtctttcaattcctgacattttcagactctggggagcacaggaatgcagtgattaacaggcttagactaaacgttctgcctttaatatgccattttaaactacctcttcagatccagcatgcattccttgtaaggaaatatctaccagaggccccaagaagcccaacagatgtcattctcagatgcaggagaagctttagaattacagaaaggagcccccaagcccctgcatgaagagctgagctcactgcccaataaagtggtatccaaggagccatgtctcggtctcacaaactaccacctgcccacctgtcaaagtcaatgccagctaatataaacaaagaagtaaaggagggccgggcgtgatggttcacacctgtaattccagcactttgggaggctgaggcgggaggatcatgaggtcaggagttcaagaccagcctggccagtatggtgaaaccccgtctctactataaacacaaaaattagttgggcatggtggtgctcacctgtagtcccaggtactcgggaggctgagacagaagaatcacttgaacccaggaggcggaggttgcagtgagccaagatcgtgccactgtactctgccctgggcgacagagcgagactccgtcaaaaaaaaaaaaagaaagaaagaaagaaagaaaaggaagggagggagggaggggaagtaaaggaagttggttttatttattttactactggctcaatcaccagagaaaactggatatcagtaaatccctgaaatgcagtaaaagtattattctgttttaatcatattcttgaccataagtggtaatcacaaatggtcttatcacattatctgtgaacttggggagttacagcctctcaaatgcggtaattatgtactcgattatgccctagaactgttagtggatttcttttgtactttttcccttcttctgtattgtacttcaaagcagccttagacttaagcctgtttatcaatctgttgacaatgctaatgtaaaaaagatgcctgaaagtatcctttcaccaagaatccatccaattccactgtaaccccaagtcctaataacacacaagtcacaggtagctgagaaacagtctgactatgattcccactgcacacaactgggcgagtcactcagccagatcatgccaccctgggcaagacttcctgctaagagtaaggaatgctgatctgagtcagttcaattttctacctgtatcaaggaaaatgggaccaagacaaaaatgttctttgcattagtaaattataggatgtatatttaaatgaacttttaaaacacaagataaaaaaccctttaaaatgccaacaatggtctttgaaggccattattgttattaccattattagacatatagagtaacagtgacattttctaagtatgcattatatgtttaggcaatgtgctaagcactttattcattatcatattcaaaattcatttattcattatgataagtgccattataatttttcttaaagatgtggaaactaacgtccaaaaaagttaaatattttgcccacggtcacaagctaataacaaagagtctggcctggaatccaaagtgaaagcatggtctcttaacacttaccacaactgtggtcaatgtgtctcactggcctgaaaaggtttttgtagttacttaagttaaagatatgctttgtcaccacttagtttaattaataaattaattaataataattcctggccacaaaaagccaggaacctttgaccaattgtgcaacatactatgatcactaactccataaaattataatcttactagagaatggagatagagaagcactgggtcaaagagttcttaaagcaactggggggagggtgaacagtgtgaaaagataagatgattctgaggcaagactgcctctagttctgatgattccaatgccctgctctggagaaggctggcttcagagaaggaaggaatttacaagacactggaaaaatttctctgatgctgtagtcaggagccaaattaataaagggcagcacctgaaagttttataaaactccgcagtttgcaaagagcttccacatacatcacatctcatttcattcgcacagttccacaaggttcatacatagggcaggtgcggagacaggtttatgacttgcccaaaatcacttaggcagttaatcctgagtggggctgggactagaatgcaggtcttagcttagtctagggttctttccaataaactgtgctgcctctaaacaaactaaggaattccttgatagctgaacactcatcaaaaaccatgaaaagagatctattccccctccaaacagcatggaaaagaaagaaaagaaaaagaaaaagagaaaagagaaaagaaccctctttacaaagtactgtgaaatcacaattagcaagggaaagttattagcaaccatccaccttattatccatccaaaattagcttcaattcaggaaaagaactggctctcagcagcagcagcaggaggttcagagcctgactcactgccctgcctttcattactaagggctttcaaacaaatatgtaccttcaacaagaaagcacacactgcctaaagttgggaggccaacagaagcatctgtttgctctctaggtcaagggtcatccaatattttggaaaaaccctaaattttgtaagacaacctcctaccccaccctcttccccaccatcgtctccacccactatcttaagtgactgggcccagatctgcaagagttttgggaaagtattaatatcagtgcattcagagcaacagtgataaagagggaaactgaacagtggttactggctttgagggaggaagagactagaagctgatgctggagggggtagcaggcagagcattaaaaatggaggcagcaaacccaagagaagcgtaatgtaaaattgcataactggggatgggggatgggaggcaaagatgacagctgggactagcagccggagaaaaggaggagcttgctggcaggaaaaactggatgtgtggatatgtagcagagggtgagaagaaaaaggaaacacagaagagcaagttgagcccaatcccaggaaaactgctttcatatatgccctaaggaagtaaaaaaagctagcctagccctatataggagagactatcatgatttttcacatttacctccagggcaacccacagaacaagaaatcagactaactttctctctccctcaactgactactgccaaggccaggcctttaagtcttgcctgcttttgtcacctcttttaaaaacagctgttcccttcaaaccccctctacctctaattccctgtggctggctcatgctgttctctccttcgttcctcgcaataaagagaaaatgacagccaagatcataagagcgtttctctcctctgtctctctcacacacacacaaattcaaatcgtctacctcaaaataaagactgagcaagacccactgacatctaaacgtgaatacaggaactatgagtatttcaaatgtctaaaggacccttaactgctgtgaggctgtcacagacttgagcctacacaaactactgtagagcctgcctatccttcctgttaatcaggaaacagatcattcatcactattccttaacaccaaaggcaggtcagaagtctatatgcactcattctgtgtgtactgaccaagggtaaggcaggcttgaagtcctgggagcagaggaaatggggtaacctcattctctgcagcaggaagaggtaccacagattagtctcatctctaggtagagatggcagcaattacaaaacattttccaaattcaaacctgctccttccacaggtaccttgatcaggcagatatgacaaaagtttggaaattaagatcatccctatcactagcttctaaaccagggtccaccctttattctgaaattataccattcaaaatgaccaaaggcatctataccagccagccttctgctttggaaaaataggggaatctagttcatgccaagagaaactacatagtttagtgaccaaatgcagcaaactctaaaatcagttgtctggattcacataaggctctgtcactaactgtatgactgtaagcaagtgacctaacctctctgagcttcatctccctaatctgtaaaacgggactaataatagcagctacctcacagggttattgtgaggattatatgagataacatagcttaaaacagtacctgacacatagtaagcactcaataatgttagctattattatatgtctccatagaaataagtgctaaacaggccacgggcagcagcctgcagcactgctccacaacaggctgggaagcagaacttcacatccaaaatgagcttaacttaaaatccaagttcttcaagaaacaacaaaaaactaaccttaaccttccaaataaaatgagaaccagaacggaaatgttaactgcagaagggaatgaaaaagaagggaattcttcattccttcctatctttagagcaaactggaatgaacaaagtgataatagcagacacatgtatgtggactcaaggaattagcaagtgttttcagagttataaaccattaaatctaagatattatgaataatctggaaagtccaagaataataagaataaagagaggcagtacaaattctccttttcaaaaaaaattcttttaaagtagaaaataatcctatcaattataaatcaggctgcttaacaatatttgggaagatactggatattgaacaggccaaactgttaatttacaaaatataagatgtagttatggaatctgagatcatgtcacattagcttaatttcagcctaagaaaaggtgtcaggttttgagtcagcacctccacaacacaaattctcttaactttaagcagtttcttcaaatgggaatgatgccactttctttatagggtagttgtgaaaatcatgttacattatgtgtaagagttctgtaaactactctatgcaaatgttaagttactttaggacagacaagaaataagcatttggtatgacggatctccctcaacaaaaactttcattcagtcctgttgccaattcctactgacaagctaaacaagcatgatctacctagatctacaggtttaaaaaaaagtcaatgacaaaaaagaaaaaaatttaaaagtatgatttaaaaaaaaacatgggccgctcacactcataatctcagcactttgggaggccaaggtggtctgatcgctcgagtccaagagctcgagaccggcctgggtaacacggcaaaaaactgtctcttcaaaaaattagccaggtgtggtggtgcaagtctatgattccagctactcaggaggctgaggcaggagaatcacctgagtccaggaagttgaggctgcagcatgctggggtcacaacattgcactccagcctgaacgacagaggagaccctgtctcaacaaagaaagaaaacaaaaattatgggaatctctcaactcagaaaaatataaccaaagttttgcatatttcaggggtcttccagaccctgagtctagattgtactactgttagatgagtgaacagttaagggtctattaagatgagagctcaccttatagggaaatgagccatggtttaaaaaacttgggatggatttttccatttcttcaacctcagtttcctcatctgaaaaatggggacaatgattcctatcttcttcataaggtcatggcaagattcacatgaacaatgtacataaaattactttgtaacctgtaaagctataaatgtaataacatgtcagttttatgcaagcattctactctattaggtaaagaatgatctaaggccaggcgcagtggctcatgcctgtaatcccaacactttgggaggctgaggtgggaggactgcaccagtctggacaacatggtgaaatcctgtctctaccaaaaatagctgagcatggtggtatgcacctctagtcccagctacttggaaggctgaggtaagaggatcaattgagcctgagaggttgaggctgcagtgagctatgatcattccactgcactccagcctggtgacagagtagagaccctgtctcaaggggggggggggaaaagaatgatctaaactagtcctgagtgttctattaacatacctcaaaagcagtgtggaagaaactgggggcagggctcacacacatccatgaaggagggggatgtctactggactgactgtttccaaatctttccattttccaaaagaaaaaagcactgcaaaccactgatccagaaaattaacatgtttcaaatagaaagtgacattaaatgaggtaaggctgccagaaattaataaaaatgatttagaataaattctggttaaaaaaaaaaaatcttacaaaaatagaacctgacatcagacctgagaaacagaaagaattggaaaatgtaggtcgggtgcggtggctcatgcctgtaatcccagcactttgggaggccgaggcgggcagatcacctgaggtcaggagtttgagaccaacctgaacgacatgaagaaaactcgtctctactaaaaatacaaaactaggtgggcatggtggcgcatgcctgtaatcccagctactcgggaggctgaggcaggagaatgaggtgaacccaggaggggaggttgcggtgagctgagatcgcaccactgcactccagcctgggcaacaagagcgaaactcacctcaaaaaaaaaaaaaaagaattggaaaatgttaaaagcaaagagaagaatcagctcacaattgaacccctcttgcattccttttgtacgtctgtcttccagggttccttcctatgatcctgaatatcctcacatggactcttaacagattgaaagctctgcctgtatgttacttatcagaaaatactatggccatcatgcggtggctcacgcctgtaataccacctacttgggaggctgacgcacaagaatcgcttgaatgcaggaggtggaggttgcagtgagccaggatcacaccactgcactccaacctgggtgacaaagcaaactacttctcaaaaaaaataaaaagaaaatgctagccacttgcaggcttttacagtactcaggtaaacagcttcattatcaaagacactgctggagactaacaatgtttctccttcaccccagggaggaaaaaggcatttaatttactcttgagcagtcagatccaagaaagtgtggccaaatacaataaatcagggcccattttgactttgacatcaaaatgaccatgacttttttaaaactaaggatgtgtctgtccaaggagaaaaatgcagcagccacaaactattgtcaagctagtattttcaggggaattttaggtaattcacttcccaacttcacaaatagtacttaagctgctggtccctaagagaaaaagctggttttgctagccattaaaaaccaggaatgtctcatgcaggggaaacagaaaaatgcacacaaataagctatatcttaaagagagttattaatgaaaggtctggttcaaatatgtaagtgaaacccttacatatttaagcaaatgctcataaaagctctcttatcccaagagattgtcaaaagtagctatgggcagatctagaactacatccaaaatggagctttgaggccaaaaacaattttaattaattaaaagaaaaataataccagttacaaaacatttaaagagtgtacttcaactgactctccagttagcattaaagccaaaatgaaaacaatatactagaaagctttaatacttcaattcgacaaagattctttgcttgaccaatatgtaggcttctgaaccttctcctaggcccatctgtgaacttccttgtaaaattcagttttagcaaagaaccttgctaagtcagtttagcaagaacccccatctttgatcatcctcagtatcagatcaggttcttcagcctccaccattccctagctgaggtctgatcaacctggcctatcctcagtgagaatgtttaggttggcttagccaaatcctccttacccctaatgtttcctcttagtaattttccatccactgacccccacctgcctatgctgtattcagagctgagcccatctctctccccagtgcagaatctcactgcagtggtctggtccctacatctatcaccatgttctaaataaagcctttcttaccatgctttaacacgttatcatttttttttctttagcaagttgaataaaccattctcaaaagccataggtaattactgctcaaaagctaatctttgccaaactttttctgtgaaatgcacctgtctataaattcagcgtaacttctgataacaagcttactttctgtctctgacaacacagtaacaatcaggacttaaatgttaagataccaaaattcatctcattcttccatcatcatatatcgcatgaatatgacaatgaacacaagcagtccaagctgatagtctaagtataatctagaagacattttaactgaaagaggtagtaagctacttctccccacctttttttaaacagccattctcagaaaccacagagtcaaaaactctgaccagagggaaattcaagttttgaatcacatctcaggatgttaggtaaccgtagtcctagtcttcccagctgatgaactattaatatttccaaagcataaatagcttatagcagaaatcacactgagaactttgtcattacatacaaaaggcaaagctttccttagatgacaaaattctaaagcagtaattcttaaattttaccatgcagcagaatcatttggagggcctgttagaacacagactgaggcctgagactgcacttacaagttctcaggtgatgcccgtgctgctgctccagggaccatactctgacaatatcttggagaatctgaaactgtgcaaatattgtgcaaattttgagcttgtttaaatggaaggaaaacaaaggcataagagccacacagatgtttctgaaatcatataaagattctcccaacagctgggtctgtgatccatggccaaaagaagtagagtagcaaaaacagttgctaaaaaaactgtgtcactatgatttcaaaacaatgacttttatcttggatttgttcagttttccagtgtatacactgacaggatgcttcaatttaccatttattgaggtcctgtttaccaaggactgtgcacagggataaactttgttcctaaacagatttcaaccttgcaagacacaagacagaataatcaaaatacaataccactgacaacagcacttctatgacaggtatgtacaacaggaacatatataaaaaataattttgttggactaacgtatacctagaaagctcatgcattgaaatctaaatctagccttgtcagttgcggggagagatggtcttgttctaggcaagaggaaacaccatgagcacagtattacaattagtaggaatgagttctagataaaggtgaaaaaattcaacattttttgagtgctattatatgtcaagcacctattaagtgctcatgctattcagaaaaatatcctcaagacctcacaatatagggagaatgacaggtatcctgtaagctatgaagagcatattgggcttctttccatagaacaaggggtatgactgctctgactggtggcagtacaatggctgtcagaaataaggaagtcaacaaggagttaagaagctccttcaataatccaaatgaaaaatagtctgaactaattaagagtggctgtgggaatggtgagaaggtaacagacatgagaaatgtttacaagatagaatcaaatgaacttattgacgtggggtgggcagtgatactataactgtaataagggaaagcaggctgagctggctttacagacatctggagatatccaaatgtagttaaaaataaggatctgatatgcaggagagaggtggaggctggaaatatgcacttgggaatcatcagcttatggacgttgaagccatgggaggagatgagctgactcagggaggatgaaaaagaaactgagaatggaactttctacataattatacttctttccaaatgattcaccactgaatgcaatgcactttcactaggataaaataccccaagttaggaactaattcccttcccatatctagacaacacttttaataatgtcaagtaaatattttattactttgcttcagaagacttaaaactccatgtcaatgactcagatataaggcacagtatccataccagaaggtctcaaagcagcattagacttcgcttgagtagagtgtgtaatgctattagcctttacaaagaatcctggccgggcgcagtggctcacgcctgtaatcccagcgctttgggaggccaaggcaggtggatcacctgaggtggagttcaagagcagcctggccaacatggtgaaaccccgtctctactaaaaaatacaaaaacttagctgggcgtggtggtgggggcctgtaatcccagctactcgggtggctgaggcaggagaatcgcttgaacccaggagatggaggttgcagtgagccgagacggcgccattgtactccagcctgggtgacagagcgaaactccgtccctgaaaacaaacaaacaaacaaaaaacacacacaaagaatccttaccttctgagaaaaacagtatccatatggttccaaagattacctttggaaatgcttttttccccttacttttttatatgacacataaaaattatatttatatgacacataataagtatatatatttatgggatacatagtgaagtttcaatatatatacaatgtgtaatgatcagattggggtaattagcatatccatcatctcagacatttatcatctgtgtcgtgaacactcagtattttctattttagcaacatgaaagtatgtattactgttatagtaatcctacttctagtattttctagctataaaacactacaacttattcctcctatctagctttaattttgtgtccttaaacaaatccctccctattcctttcttccctcaccttcctgttctactttttacttttttttttctttttttagagacagggtctcgctcttgtcacccaggctggagtgcagtggcatgatcatagctcactgtaacctcgaactccttggttcaagcaatcctcccacctcagcctctagagtagctaggactacaggtgtgtgccaccccacccagctaagttttttagttttttgtagagatgagggtcttgctacgttttttgtacagtatgctagtctcaaactactggcctcaagtggtcttcctgccttgacctcccaaagtactgggattacaggcatgagccactgtactggcctactttttacttctatgagatcaacttttttttaagcttctgcatatgagtgagaacatgcagtgtttaaattaccattcctgggttatttcacttaacatggaatgctttctgtggagaaaaagctaacgcataatcccaaccaaattttctcaacttttaaaaaggaaaacaagcggaatctcagcctaaagcccaaagctaaaccaactcccactctgcagtaaagagtactgaaaagaaacaaagccaatatgccacggaccagtgattctagagaaaatattaacagaaatagtaacccctattttagactgtgataaaagttcatgaaatattacaatgtttatgccccttttcctacccttctggtcccctccagtatttctgtaaagattaaacaaatatgattttggaaaataaggatatgatagtgatacacaggcaactgaacaagagactcttcacttccacaatggcatgaaatgggaacattttcccccctctaggccccagtggtttctcaatttaaaaaaaattgaggatgctcagcagaactttactgagtcttattttgaatcttgaaaaatgagacaaatttgactccgttacatatggaccatatggacaatgtgctgaaactgcaaacattcccactacttaagttgtgatagtagcaaaaattatttatacagttacactgagccagagtccaaagaatatttgatatttggtatgacacagtttatgaagatcctgtatttgtccctgaattctcaacaactcatataattattgttcattcaggaagacaatcattcttaaagtaatacgcaatttcactcccattaaatgggaatttatcacgtattcaactcactgttaaataattaaaagttcccacttgtggaatttagtatgccaatctcgaaacagactatcaagaacattttcttaaaattaaatatgctcccaaacagtaaaatactattcaatgcaaaaacaaaacaaaacaaaacaaaaacaaaacaaactctcaagccatgaaaagccaaggagagaccttaaatgcatattactaagtgaaataagccaatctgaaaagggtacacagtatgattccaactacatatatgacattctgaaaaaggcaaaactatagagacaataaaaagatcagtggtcccaggagataagaaggaaggagggatgaagaggtagtacacaggggatttttaggacagtgaaactatctgtataatactctaatgattagcgtatgtaattatatatttctcaaaactcatagtatgcacaacatcaagaatgaaccctaaactcaaagtcctaaactgtgatctttgagtgatgatgtgtcagtgtaggttcatcaactgtaacaaatgtaccactctggtgggaatgtgatagtgggggctgtatgtgtgtggggacagggggtacatgggaactctctgtacttcctgctcaattttgctgtgaacctaaaattgctctaaaaatgcagtcgatttttttaaattaaaagtatcaactgaaaaatacttataatcatgtactgaggtttatttgcacttgacactgagcatatctgattggaattttttaaatgatacataaatgcaaagctacttttgagcaagcaaaaataacttctgctcggacaagctagtaatggtcacctatcttgtgtttctgatgcaagcacagaaaacatgggacaggttgggcctagtggctcatgcttgtaatcccaacacgggaaggccaaggcaggaggatcgcttgagcccaggagttcaagaccagcctgggtaacatagggagaccctgtgtcttacaaaaatgtgaagaattagccaggcatggtggtatgtacctatagtcccagctactcaagaggctaaggtggaggaacacctggacccaggaggtcgaagctgcaataaaccgtgatcacaccactgcactctaacctaggcccacagagcgagatcctgtctccaaaaaaaaaaaaaaaaaggaagaaaagaaaacatgggactcttaaaccttaagatctatcagactggccaggcgcagtggctcatgcctataatcccagcactttgggaggccgaggtgggcggatcacgaggtcaggagattgagaccatcctggctaacatggtgaaaccccgcctctactaaaaaaaatacaaaaaattagccgggcgtggtggccagtgcctgtagtctcagctacgtgggaggctgaggcaggacaatggcgtgaacccgggaggcggagcttgcagtgagcagagatgcgccactgcactccagcctgggcgacagagccagactctgtctcaaaaataaataaataaataaacaaatctatcagacttcaactaggctatcttaattaatgctctcctaactccattaaacagaaatctcccatcataaggaaaagaatgtcataggaggaaatctcctaagcctttatcacgttaaatgcccaggagaataaattacacttatgggtaaggtaaccatataatttgtcatctaaacctgaatccttctgagagtgaaaggggtgctgttaataattctgacagggcaacaggcacaaactgagaattatgattactcaacttacagggaacctggaggatgtattatgtaagattaagcaattagagtggagatatcccagaataaaattctaggtcaataaacttccaattctaaatacagtatatttgtgatttaaaaaccttccccaaaacctggagcaataattttccaagaatccctttgattgttaaatatctgagtctcagattcaaatgtatcaagtcctccaaagcacctccaaaattcctattttatttttatctattaaaattataaatcttccaccttattcttctacattcaatattaattggtaactataccacccttagctaatttttccattaactagaacctattgtcttagaataaagtacacaattcaaggccctactgctccaaaagaaaatgcctctcttgattttaaatggtagtatacaaagatcaatgaacagtaatatttacaaaaggtagttctccacttagtaatttcagattatcatatttagtaaaatcataaactctggttaaaaaaaaacaggccaagattgtgtcagctagcaatgatgctctagaatttattaccatatactctctaatagtgtctcagaaatgaatacgaagctacgcggtaacaaaatgctggacatatcttttttttttgagacagagtctcgctctgtcgcccaggatggggtgcagtggcacaatctcagctcactgcaacctctgcctcctggattcaagcgattctcctgcctcagcctcccaagtaactgggattacaggcgcccaccaccatgcctggctaatttttgtgtttttagtagagacagggtttcaccatgttggccaggctggtctcgaactcttgaccttgagtgatctgcctgcctcagcctcccaaagtgcggggattacaggtgtgagccaccgtgcctggcctggacataccaatttaaattgtaactttttgaaaagtatatttaagccaggtgtggtggctcacgcctataatcccagaactttgggaggctggcgcaggtagatcacttgagcttaggaactcaagatcagccaaggtaaccagacaaaacctcatctctacaaaaaatacaaaaaaaaaaaaaaaagctgggcatggtggtccacacctgtagtactagctacttgggaggctaaggtgggaggatcatttgagcctcggaggtggaggctgcagtgagctgagactgtgccactgcacttcagcctaggcaacagaagtagaccctgtcttaaaaaaaaaatgcatatttatagaaatcattccatttaataaatacatacacatatattaaaacctgaaacctcagttcccttgtgtatataaccagaagactggaatggacaatttctaaggtcctttcagctttaatattcagcaaatctatgtatttgtagatgtaattgatgaattaattcaaatgccatattctatgaatccatgaagatgcacaaggtaagaagaaagaatatatgttaacagattataaattatttggaaaccaggatatgtctctaattttgtttccccacagtgccttgctgcacacattatactcaatatttgttaaaagaaaggtgaggaataagattcttattaatgaaggattaagaaaaaaatcctttcattaaattgcaacctattaaaaacttaaaatgtactagtcatgttaataaatgtataataaatgaaaccatctttctttgattagtggagtttttcatagaaaggtagccatcagagccatctttcttaatatcaacagaatcatattaatacattctaaaagactagactttgttatatttgaatttaccacagataccttagaagttaccttttgtttaaaaaaatcaaatccctaatgtcagtttgttttctaacaagcaagggaataaatttgagtttaaaatagatttcttatttgagtttttactttacagttaggtttcaacttaaccactgttttccaagttaggtagtgatgctgctcatcactaggtctaaaagagatggatgttcacagtttctgtgaaactcctagcatcaaaaacaaacagcttaacaatctttttttttttttttttaaagataatcttgaagaaaaccatggtgggccagggatggacagggaataggacactttttaactattcttaaaaaataaaaaagaacatttcaaaaagattactgagcacataactaatgtctctgaaaggaaattcattataacagcagctagcctttattgatcatttgtgttagacataacgcaaagtatatcataatttaatttgctacataaagatacagtctacctcttaaggttgcttttgccattctacacagtacagaggaatgatgcacaccttggcagtatacttccagagcttgcaatcactacactatactgcctcactgacagcaatgcttttactataaacaatcagaactaaacaatatcctatatacattatttaatccaaacacattttatcttagaaagactgtacacagtgagttccacttctctgtcatcaaggttaacagttcaggcctttatcactacactttcatccccgatctgaattacctatacaaaaagtctatgtgggcctatgagtttaaaaggcatttggcattactaacaaagaccgatttttaaaagctgatgttcctaactagtaaactggaacttggcagtaggtttccagttcttactgacagatctccaagatggttactaaaatgatacgcccctaagattttcttcccaccaagaagagatgaaaatagcaggttcatcctctttccaaccagagacttaacagcacatttctgcactctatcatgtacatatacctggatttcaaaactcgggtaagtgacaggtagctctttcttccccagaggttggcaagccttgtaataaaaattattttactgaatccattttgcatagggtaattatatttgtgctattttatacattctatcttaaatgggtcatcttttctgttggtcttatttcaacaatggacatatatataagtatcttaattctcagttttacaaagtatgcacaggacctcttccgtgcaggtatcaagactgaccaagtacattatgaaccaaaggtacaaaacactcttatgcaaaaactttaaaagtaggtctacaaaggggtcatccatttttcaatttaaaaacccggctccacagaccctaaagattctttggaacacttatgggactccctctacccctcaaacagctctacttgtatctaattaacaacaacaaactttctgcagctaaaggttgaaaactcctaaatctaattcttgccccaaattaacactcagatataccacgggccaaagaggctatactttagttgcagaacccttagctagaattcaaatattctgactcctgttcactaatgctctatccactaaaacctgctgcctcctcagtccctcaggaaatcccaaaattcagccaattgtccaaatctattctattctcccttcacaattacttcttatttctactctcctcaacttgtttcaggtctgtattacctcgtaactacatgattaagtagaattttcacctctgcagtgaggtagagagtcaggttatactacttacctagtgtcccaaacaccagtaaaaaatattgctgcttgtcttgaaaagggacagcaaaattgtttccagaatgctttcgctaaaaattagcagagctgtcccaggagttacccacatggctaagatattaaatgtgtgaacactgaagacttcagccaaaaactggataaaattgaagtagtatatttttctattccatttaatgaagcttttccctgcttccctctcagtaggccaatttcaatatcaagaatgcagtcactatcaacataattccctttggtgacaattagtaacaacagatgtattccagcagttccatacgtttacataaatgaaaatatctgtcactccaattactatattcaaaaaaagactataaataccaagatgaattgtaacatactactaaatgcaaagcatcacagtatgtaaatgacatgcctacataaaccaagctttgaaaggatacacaacaaactactaacactgctaactaaaaagcaggaatatcaaggagtaaaaggaagaacttcaacattttaaacaccaaagtattatttgaagttatcatgtaagcaaatcctttcataatttttaaaaatccaataactttttccttctttcaaaaagctgaatgaaataattcagtatcaaaatgttggctaaccactatccaatgcaggaggattcatccttcctaactaaccactggtattccctcctgtggttagttacagctattctttggaaatttgacctgatgaaaacttcactaaattctaggcacagatggctgacaagcttatgtatctggttacctcaggctcacctactactgggcctgtcaagtttttccagtggtatattttgagagttcaagacttgacacaattctttagttctttctgtgacaaacagatagtgttgcagaatggtaaggtgacactctactaagacactactaaaaacacattccactcaaactcccattcggctttacaaagctgctgaaatacacacacgtgttactaaaatacaaatgccaggaaagctcattcttctgataacttctgagcaattttcactataacctaatgttcctacagcaagaactactactttatatactctactggtgtttttttctccctttaatgcatatcaaaatttgccctttcatcctccagctgtaaagtctgactacccctagcaccactccacctcataattgaatttttaatgtctacttgccactgagtagcaaattctatgctccatgggcagacatttcgtttcacaacgtttcacgtatgctactccacagtaagtggtagctctgcagggaagcaagtaccacatagctcacaatcaatattcattactagccgcctgcctggaattctttctgcctcgatgtcctcacttccatcaggaattaatttcctttgtgactaggccttgaagaccagctgagctgtttctgagaaacatgggcattatgaccctttggggattaaaagagttaaaaaaaatatatgttagaaagatctctaccatacaaagaaagtcattaaacagctattaggaaatgcaaaaatacccactcacaatatggaaacactcctgctcaataaacaccagtcatctaaacttttatattacacttagaatatggaaccactacctctctgtctaaaaaggattaaaatagaatttaaaaattttaagtggcaaatgtttatctagaaacaactgaagataccagaagaaacaggatcaagaaagtatgtgtaagaagagaataaaattaagataggaaaaataaaataactttataagaaattacaggctgggtgcagtggctcaagcctgtaatcccaacactttggagaccagcctgagcaacagtgagactctgtctctatgaaatatttttaaaaattagctgggcatggtggcacgcacctgtggtcccactactcgggaggctggggtagaaggatcacttgagcccagacaatggaggctgcagtgggctgtggtctcaccactgactccagcctggatgaaagagcaagatcctgtctcaaacaaaacaaaacaaaaacacctccctgggcaacagagtgagacaccatctctacaaaaaagttttttaaaaaattagccgggtgtggtggtgcacacctgtaatcccagctgctcaggacactgagacaggacgattgcttgagcctgggaagtcgaggctgcagtgagctatgatcataccactgcactccagcctgggcaaacacagcagcaagaccctgtctcaaaaaaaaaaaaaaaaaaatagtaacaataaattaacttaaattaaaaaatttaaactaaggcatagaggtctttaaaaggattccaaatcatattgtagaggaaaacaaagagggacaacagaattatggtgatgggaataaagcttctattgctttaactatttagatcattgtcttaattactaatgtttaaaaagaaaactttctgctgctaaaagctgaaaacaagatgtacagcaagctatgtacgtctctacaaaattttacaagaagcaagaaaatgtaaaactttcaaaacattcactggaaaactggaagaaaataatatatcatagtttcctagtaaaactcatgctgctaaatttctaagtcaagcaacaactaccaaaacatgtcacttctatggaacaacttaattttgatggtgcaatacattactgtagtattagcaaaattacctgctgcaagacggcttcaaaaataaagaccactgctacctggatacattaatgttaaaagctaacctgaaagaccaaggagggtgatctactgaaatagtttggaataagcatatttagcgttataagcatcaggcttcacacatcctaaatggtaaataagttgtgtgttaaccaaaaaagttcattgtaattactttctagcttgttaaaaataagaagggactaatatcctctatattaaagatttcaaattttataatcattttactatagaacacatagctagctttaaaacaacagattaaaaagtaaccaagataactgaatgggtattagggcaaagagaaaagttcactaagcacatgtatcttgtgtcatgtactgtactgggcattgtatatatgcagtctcattctaaccaccatcctgtgaggtatgcgttatgtctaataagcgactgagaaaacagaggctaagagagattaagagatttgccaaaaatcagggtttcaacctaatctctcaggctccaaaattcataatataatcctttggtgaaagggacacaacttagaggcccactgataattttatttcatcagcacagtgtttttaaatccaactttcagtgttttcaaagcatgtattctctagtttagcaaatggtacttgtttagctcttgtggtaaatgagtttgcaaaccctgctttaatgcatgtcaacaaaaagagtaaaggcaagtcaacagctgttctccttgcctttccattcctagaaggcatgtggctttgactactgatagtcctagggactaagtactataatcctacctcagaggacacttacaagtacaggaacaaaatgaagatattctcaatgggggttgccctgccttttatagggcattttggaaatttctctatttttggttgacacaatgactgaggtgaaactactagtctttagtgggcaggcaccaaggatttgcaacatcccacaaagtaaggaaaagtcttgcacagtaaagaattgtcccgcttcctataccactttcaaatgacattcaagatgaaaaacttgttctgagcccagaacccaactctgttttaaatataacacaaagtattcttgcatgattttaatcatcacttaattttccaggaatgtaattactgtgtaaagtgagaatagactgttctttcgttcatttggaactctaccaagagctgttcaccttttcagaaaatcacattatcaacagcaacactgtctatagtattcaattcaccattacagcacaactgtatcggtctgaatttgtagcttggtttttctaatataaacaatgggctacttcaatgtctttctgtccagccatctcttagcacttacagactgatctaaacattgtattattagagttacttacccttattttctcctttatattacatttaggacatcagattgttttttcttcaataacatgtaggtaggtcaaaacatctatgaattttatttcaggatagtaaaagggagctacaaaaatttgctataaaaagttaacacagatagacatctgatttcactttcagtcacctatctcggggaggagagaatggggatgaaaaataacaagggtccctgtgactaaatttaacttgaagtgagagcagtgagcacactacaaagattacagaaattcgatattaaccttccctagtagagaggaataattaattcaatgaaaagactggcctattaacaaccatctaaaatgcacattttaatgatatgctcatcatttgtcaaaagagccaaccttgaaataatctggcctttctcattagtactttatttttcctcttaactttcttatgaactaccagagttgcagttaacctattaagggtaaacactataaataccatgccctataactcaaagctaaacaagcatgccatttaaaaatatagcagtttattaagcacttcagcatacattgtaatttaatcccataaaactctatgggttaagtattacactaatttttaaaacagaaaccagagtactaaaatgcaaacagacagtattacagggctactgccaaatccagtgttctttctacttaacttcattacccaacaagatgaccttttcagtatagttcttattcacattttatatttacaatggtaatttcctactttcataaaaactacaagttacttttagtactttttaaaattaccttaaatatatttcaaataaatatgggtaagtataactagggttatgtttcatgttccttaatatcattctccctggaacctattccactgttcgagtcctcttattcttataggcaccactccttgccttagcccataacaaaaggacaaaagggagagctcttacaatgaattactgataaacagggacaaaccactactaaaaactcatcaaaccatgattttcttagtactgaaatttaggtataaagtaatcacatcccataggagactgaggcaggagaatcactcgaacccgggagatggaggttgcagtgagctgagatcgcgccactacactccagcctgggtgacagagtgagactccatctctgaaaacaaacaaaaaaaaccaaacaaaaaaacaaagtaatcacatccctagtctgtctgcattgttaacatccactttctgactctctaaatcaggtggttacaattcagcaagtgaaaattattttgaacccattagaaagaaaagggtgtggtcaatcacatcttcatttatacctttttcttcttccaaaccaagaatacaaatatattccaagcccccaggcacaaatatggaaaagggcaatccttaaacgagaagtcccagaaacatccttatcatataccctttaggcaataatgccctaaatttttaaatattttaggtaagaagagggagaattgttttaaaaaaaaaaaaaaaaagcctgacgccctcagcccaccttcttctcgaaaacagctttaatttcagagaataaatgaaaaaaattactgtcagatataaggtagctgaactgaagaaaacacatatagaaatgtgaggttatcaaaataaaacaatgctactctaacctatattttctcatacaaaatttgcaatgcaacatgattttgtccatattaaatctactttaggaaggtttcttttaatacacaaaaacctcaccaaattacaaggctgtcttttaagttctaactggaaggccaaaatagcaaagatacattcttccagggttgccatattacgtaaataaaaattcttcatttttgatctgaaattcaaatataactgggcatcctatattttatctgacaaccctacactcttcaaactaaagtgagctcccacctctaccaaggtattacagcaccagctcccacttctaaagacaggctgtggcttctatcacagcaggattttaactaatgaagtcttaggagttaggatgaaagtgtccttttccaggtttttaatagcatacatttaccatataaaagaaaaagcttaatttctaatggccaaaggttatacttttactaggtttcatataaagtctaacgggctctttattatctaggcttctttgtattcaacacgtattggaaggatttcatagtttagctttttgataacaaaaagaagttgcttctgaaggttatagtaagcaaaattctgttctaatatcacaggcaagtcctaaaagctaccttaatggattccaaagttaatctaccattttacttggattcataatcatagaagtttagagctagaaacactaatttctgatctttaaaaacttctggctggcaggggggctgtggctcatgcctgtaatcccagcactttgggaggcacaggcaggaggatcactttagtccaggagtttgagaccagcctgggcaacatagggagacctcatctccacaaaaaattcaaaaattagccaggcatggaggtatgcgcctgtggtcccagctacttggaaagctgaggcaggaggatcacctgagcctggaaggttgatgctgcagtgagtaatgatcacgccactgcattccagcctaggcaacagagtgagaccctgtttcaaaacaaaacaaacaacagaaaaacacactaacttttgaaaagtccatttcatttcatattcatttccatatttttctctcattgagcttctaaacaagcacagtactatgtaagaaagagatcatttctgtttttgagtaccctctcaaccagctctttgtcctacttataatggttctgacgatgagtgcaaataactctattcttccgctagtttcattaaaatcatcttaatactaaacctatgctttcttccctgtgctctaggccattgctctttgatacagcccatccatctttggagactgcctaattcccttacttcatttacactgctaccttgaaagtattaatagataatcacatccccctagtgctccctgttcctaagtttagctccttcaggcttttctcctaaatcttaagctaccatcaacatagattctatgtctcttccaaaatgtggttagaaagtattcttatttggagttcaatcctagtagaaaacagtaatgctgttaggttagcaccatacttttgatacgtgatcactatgttatttgtgtaagggtaattcaatgacagttcactgcaagctatttgaaacctctttatacttgcttttttccaggtagcagtttcctggtttgcattaaggccatttatttcatctcccttgatgcacgatttgagattcagcattaatgaatataatttcaatgctggagctccttgtgctatttttttccagttgttcggcaatgattcccaaacctgctaaactcgtataatcaaaaaaatcccaagttaaatttaacacattccttcaatctatgaatttagaagtttttcacagatagttgccaacaaaggaggacatcttgttgcctttttttcctccaggaagcagtgtctaaaaactaggaaataatcccactactctaggatcttaaacatgaacggcagatgattctttagtgatggttctgcttaccctctctctctcttcccttggccagtattcaagtcaatctgtactcaacagaaatgtgcctcagactacagcaaccaagtaaagcatttggcttagaataaacattagtactcccagccctgcaaactcaaaggctcaggaataaggaacacaaggtctaatttaaaaggaaggtcaactgaatatactggaaaagttatgtcttgattatattcaaattactgtggcttcccctttttctaaagttctaaaaggaaaaaaaatcgctatatataatggctaatgtataaatccaaaatgttttattttctttactcataatgactaataacagtatatgctgatattactgataaatgtctagtgaaaatccttgtgttaacaaaaatcataattattccagactaacatggcatgtaaaaaataaacaaaagccccaaactactccatacctgaaaatgctgtttttcaaactgagtttcacggcccatgaattgtgaattcaatttagaaggtcactatggttctcttaactacctcacacagattaataataggtaatgtttcacaagatattacatatttgtgtaattttgttataaatttctattagtcaaaaactacttctctatctgggtcacagacaaaaaagtttgaaagcctttttctaaagagctttttttttttgagacggagtctggccctgtcacccaggctggagtgcagtggcatgttctcggctcccgggttcacgccattctcctgcctcagccccgagtagctgggactacaggtgccggcgaccacccctggctgattttttgtatttttggtagagatggggtttcaccgtgttagccaggatggtctcgatctcctgacctcgtgatccgcccaccgcagcctcccaaagtgctgggattacaggagtgagccaccgcgtccggccaagagctttatttttcaagtaatttcaacatgattacatgtgaaccaaatattatcttttactcatataaactaacccctactgactacatttcaggtcctagaaaattctagtttgcaatgtaatttttaggttatttttaaattaataagtagcaagggtgtagctgaaactagatgatgaatacacaggggtttattcattacttaatctatttttgtacatgtttgaaattctaaagatctaaaagaaaaaaaggaaaagaaatggacctaacagataacaaagtagtaccatgaatgtttacaacttgagacctttaaacacaatgtttctaaggaataacaatcaaggaacttgctaggatttaattcagttaacacttggggttgccttcttcgactataatggacggatttccaggtcttaaaaaatgcataagggactgcagaaactaactcatatatagaaaacaaactttctcgaaagataacataaaaatacaaatagttaagtgtgtttcattgtctctttattagtcaaccactttcagccaacagaaagatcataaaatacctacctacctggcaggaatattcacttctttattcacactggcaattttcccagcaagtttaatataagatctctgcataacagacacggttctgcctcccttgaaacaagaactgcaagggttgtctgaagtagatttagaggcatttagatttcaaaacagtgcatgcctcaaagttaattttcattatattcaaaagtaagtttctaaaaacttttaaacagaaagtgttatcatctctgagcctttaacctattggagacagtatctaagctataagggcaagatatttagtaatttttagaactgaaaggaaatttagacatcatctagtccaatggtttccaaatcctaccatcaggaagaaaagaatctcaaaggcataacaatttatatatgcaaaacaaactcttacttgtgtgttttcctgtatcttcctgcacatgaaatactatgccttattagtattctatcaggaaaggatgtgacatttcgttatgcattttatatttaatcacatttagtatgtgagtatccatttagatatgattaaaactattggtacgatttgggacttaatgctttctaattatagaaacttacataatatatccaaccctaatactttcagagtgatttcataccatctcatttatatttcactgtctagtaaatttgaagtaatacctgggtgaccgatgatttttaataaggcaagagaaggatatccaaattggcatatttcagccgggcacagtggctcacacctgtaatcacagcactttgggaggccgaggtgggcagatcacctaaggtcaggagttcgagatcagcctggccaacatggcgaaactccatttctactaaaaatccaaaaattagctgagtatggtggctggcgcctgtaatcccagctactcaggaagctgaggcagggagaattgcttgaacccagaaggtggaggttgcagtgagctgagatcatgccactgcactccagcctgggcaacagagcaagactccatctttaaaaaaaaattgacatatttctggaaaataccataaagtatatcataaagctccagtagttaagattatttggtaggaaggctagtcttaaaacattccataattgtttcagaaatgcaagagaataccatttagtgctttttagtacaagaaactcaatacaaaatgtttccctcgagctgactacattctattttaatgaacagataacactcagtttatttatttgaaaaacaagaaacacaacaagaaaacagcaggtatctgaggaatattaaatgtctcccctaacttactgtgtgcaagtaaatttacatacgtaggaaattctttaaatatttagaaaaccccatttctatacagatagacaaaagttctgagcaatcaggtcaaaataatctcaaattaataagagttgattgataaatgtttgcctttgtacatacacaaaagcaaacaaaagttaggcctactttcagtttcagacaatataataaattgaaattaaatacaaattttgactctccttcctaaactgaatagatccttaaaaagcagatatattttacttgtgtattcactcttttaaatttagacatcaatatcactagaataatgtttttacacaagatcacttttaaattcagtaagaagttttgttatgtatataagcctaaaatatgtaaccatttataaccaattaattttactggaggggtttcctgtcttcccgaagttaatccttaccaactaaaattaggaattttgaaaaaaaaaatccataaaaatttcacaaacaagcttacaaatgcattatctaaggtgcttaaaattaaactccatattatgaacaacattttaaaaatttgtataaaatgataatgttttgtttaaagaggcatactgaaagctaagccaatttttcacaggaggtgattctccaacattattttaactttgatgtgtgaatttactttagaggtccctggtctatttactctttctgacagcttatatttttccggatgctcctcaaacaaagattcattcctcattcttgcatcctgcttttctccttgtactactgcagcctttcttctgtctttccctttctcttacaacttcattctctacttctgatcctgtccagattgtactctcactgcaaacagtaaattgaatagaatacatcagaacgattttcataaaattcacttttccaaaactactctgcataattttattcaaacttttgttgaacatctcttgtatggtatccaacatggtcactcactgtttctctacatacttcattttaatagatattagcactttatctccttcccgaatcgttgtaaaaaacctttacacagacccagcaagtttcagagtttacacacaaaacatcttacttttaaaaagtacctcagactaatgaaaaacaatgttcaaactgacagagcacttttctaattacatttggtcatctttcaaggcccaattaaatctttttttaatttaaataattatttttatttaaactttattttaaagttaaaataaagataatataatgttgctttttattaatgtctaaaggcatattccacaaaagaaactgtttcacatcaaatctgtattaatgagaaaaaacaatgggattcccttaaaacagtctaatttctcataaggatctgtattaatcaagcgaagtcagacctgtaatgaattccaacctcacatctaaggggttttatttccttttgtggttttaaatcttggtatattcacaagttaagctctactgcgtctggcaacacaaaaacccatctgtatctctttctaatttggatccagtaaccttgtaaaacaaacccagggaatgggtcctgatgtagtaacatggcctatcctcccagaccgaaccaatttctcatgcctgggtgctgcattatatcagtagtgacattttagccagtagcctgagagactgaaagcctgtgatctccttaggaagggctttatgtcaaggcaaactatttcttctggtcaaatcttatttggattatttcaaaattttttgcttgacattcggcatgtcatttgtgccacagctgccatagataagatgtgtcttctgttgctcatttcagttcaaagaggaaacacgcaatcaattagcaaatacacctctaaaaatgtactcagtgagagaaaattgctaaaccactgaagcaaacagcccttgacagaaaagaaaaagatccatgaatcatctaatgcaaatactggcattattacaaagcacaatgttcacaactatctagtatcacccaaacaaaatggtttctaaaatttaggtcgttaaaaataagattcattagattccttattttcctccattgaacagtgttaattttgtgatgtcatattttccatatgaatatattacgtttttacacaccactccacattcattaattcagctaacatctataacactcccactgtgtgccgggtaccacactctatttctcttattcacaacaataatactctatgagaaagtgatacctggcccacttgaaagatttggttcacagaaaaaaaagaaaaaaaaaagccataaagtctctcccagaaactcaaataaaaatattaacttcctcaccagaattggcaattgcagacacagtgcagctggtcacttttctgagaaagttacataagcaaaagcacaaatctctatgtggggccttcaaatggcctatttaccatgacagcagcattaacaatcaagttttcaatatacacatgaagaaaaataaataaaaaataatgctcctttttaaaggatagtagtaatagctaacatgtactgagactcaggctgaaatctaagcggtcattatctcatttaatcctcacatcatccctagggaatggacatgattgtaatctccactttacagatgatgaactgatgaaactgaagtttgcattactcaagatcactcagctactgacagctggaactcaaacctgagtctgtcaccgtccaaagcctgcactcttgatcatcacattatactgctttgtttacactcactcaattgcagtctaatgcttttgaatgtcttataaggttactttttagaacaagttcctctttaaactaccattttgatgatacatatagaagtcaacaaataaggattttacttggaattggtcttacaagtttaaattcttggatgagaaacaaaatccatctgaatgaaagccctgaatgtccacaacaatgggtcagaaactcactggagcttcaagagaccttgagagtcatacaggccaaattcttcattttaggaataatgaaacaaatgccttttgaaaaacatctatattcaatctaaactactacattcccaattcagagatacttgtgagtttttttctccagtcatttaaatagaaaatctaacatttctaacatttcaacatcatgcacaagcaaggtatccctttttgaaagcactgtaagaaaacacaaactccatgacatgaagtcagatcactgcagggctatttattaccagctgaaagcttgaatattataataagacatgttatatagaaagctataaaatggcatccataactataggaactcaaactcaaaaatagccatctcttccttgaattaaatttacattcatttgggtcaaccagcagctcagcttcatttcatcggtcatgtcatgtgactgaattcaagctcatttcaagggaaaggccgttctatgctgtatttagaacacatatcactgagcagacagatgagtctttataggcctatccagaaaccttgctttagttgctaagaaactacaattttaccgtattataaatcattggaaaaaagctaagccagcagagattaaacatgttaagatcaagaatctctcacctattgtgcaaaatgaaactatgctattaccataaactgaatagctaaaattagcattaggcttctttaagtcatgttgacacagtcgaaaaactgataagacaaataagactaactctaccctgccttccacagtggactcatgcttagaggaaaacaggaaaaatacccaatacacttagcatattcaatgctagagacagaaaaaatgtttccttcctgacccctgcagtgatatccaaggccatgaagcacacataaaatttggtactacgaacacatatttaactgatggatattgtcaatcctttattcgttttaggaataatgaaacaaactctaacattcagcattttaaacccagtttctcaaaaaactccactggctctatcactgattttttaaaatttaaattgcagcctctctaataagagtaatcataaattgttctggcctaacaataaacaatgaaagattagcaaaaataatttatagttcactctccagtactgacttctcataaattccttcacagaaaaaatattctttaacctcttaatggctgtttccacaagggcagaaacaggttcacaatcctagactcacttgtgaaagatcaattcagcagctgaatgctaacacatgtcttcaatcagaatctgctctgtttaggtccctatgcccatgattccccaccacttctccatcttctcaaaggagcttcaattcaaaacccagtaattctctgctttctactgtaccacctcccaggggccactttcatgttcctcggaaataacgtctcttctgtcttgaaacttttaaatctcaaaaatccacttccccatctccctgtcgccagtcactgccctcaatcccaccactgcaattagttgcagctatgtgtccctgttttcccaaaggcccgaccaatatcatacagcatttgccacatcccaactcctcccttccctaatttatcctccacactgcaaaccaacattacacccccgacttcctgcattttactcccttcccttatttttcgtcttcccccacccccatctctatacccaggcctccttacttctctaataaatattcccccacctcagttccaaccctttccctccatcctctgctcattttcctctccttatttagaaactcctttttgctctcccaaccactaccctagaatgcccagcactccaccctctttagcaaacccagccctcttcccccagctcatttggagacactgctgcttctctctccaggtcccctactgcagtcaacccactccctcatcttcccacccaccttccctctatccctagatccaaggttccctgattctttaccccctcctttggtctctagtactcagctcaccattagtgttcctcaggactctcttccccccaatttcccccttatttttaaggatgtcaccagtcctacggggcctcagtagaatcctggacgaccccagctcccggggggcctgacggacaccaccatccccgtcgcccggaacacaaacgccggtcttgtgccaccctccctaagagctgcgccccctcctcatccgcccccgctactccagctccccacgtcggcttcctccgtgtcccctcgccgacccggcacgacgagccccacgacgtggagcctccgagtgggcaacacctcgggctcaccccggacgcccccgccgctcggataggagcctccggtcctcacacccgcgcctcctcaaacccgcagccggtacctcctctcggacccgcagcccctcagacgcccactcggcccccttccccgagctccagcgtctcctcaggccagagccgggccccctccggccccggcgcccctcaacccccgcccggcccgcccccggcgccccgcttaccgttctgagcggcgcctggccctgggaggagggagccagagaccagcaacagcgagagggccagggcgctgggcagcgacgaacccgacatcctccctagcagaagacccaacagcgaatgggccggggccagagccggggccggggaagggaggggagggagggagggggcgggcgagtgcgcgagggagtgagcgagggaggcagccgcggctcggctccgtccttccccgtcctcctcctgccgccgcagcgcccaggcctcgcgagaccttcgctccgggtcgtgggcggctgaggagcgaccgccgcaaggatcgcgagaagaggcggctccgacggagactcccgccccgcggactcggtggccccgcccctgcagaggctgattggcctagcgcgaggtaggtcacgtgccgagggcgcctctggccatgtgacggggcgaggcgggactccgctagctctctgggcagtggggagctgggaagtccttcagtttactcctctgtggcccgggagcacccataaataagaggaagctttggaacacagtacatttcctccacccatcctgcctttcatttgttagcgctcttggctacagagtttcatacaccgtgcctcctttcctccttcctctctttgtccccgtcctgctgtttcttccttctggactttgaacatagacctctactggtaactggctccaacctccttctctcatctgctgttttttccttccaggaaaagtggtgcgccccctgtgcccccgttaccttgtgctttcctgcctggacatctgctccctttgcctgaaatgtcctcctttgccgcctctgcctactccccctcccaccccacatctgggccttattttagcttcatagactctcagggcctgaagttcagctagcctaattgcatgttcattgacacaattctacaaggaagtcgtgtatgaacttacatgaagactcctaagaagcgtcttaatgcggaaaacatttattgagaacgtgctgtgtgccaggcacatagtgaaacccacatgaaaaggtagtccccgtcctcatggagtgcactgcctaggctagcagaggagtgaggaagggtcaaatggccccataggaaaggatctagcaaagcactctggagggtgattggcagtgtggttactactgtttgcatagaagtttgggaaatgctctttttaggggtattttttgtactaccctcagggcttgtggttggcaaaggaatttctatggcttagctcatccctgactcacagcagacgtcctgggagtgtctgtggaaactctgaggggccaagtaaacagtcctggtggcctgacttgatttaaagagagggtttggaggacctggaagaaggagaccctcgcaatctctatcaagctaaagtggtctggaactttcaacaggaactgaacagctggtggttccagaccaaaatttctagcaaaggccaggaccactatggcatgttgttgattgaagtgaaaactatgtccttcaaaacctcaggtgtgtgagtgacaaaaagattggcatgtaccttcatctggacaaaggccattctgcagacagcccagtaaggagggctacagggctgcctgtggtgggatcaagattttcagctgatggaagctttggttggatgcaaccattctgcctcattatagctgtaacaaatgtggctctttgatccttacaacaagagattcttacaaaatgatcatggtctttttgtggatagggaagctgaagccaaaggaggacacgaacggctccagctctcagaatgtttgtattaatcattaatgccaacaatctggtttgcttgttaatagactcatggtagaagtgcattttcttgtccccttgaagtcgggagtggcattggatgtgcttgggtcagtgaaatgtgtaaagtaacatgcattgcttcaagcagaagcatttcatttccagtttagactctttcccatactctttcgtcttggtagtgattactgatcatgacgatgaaagcatatatcaaaacgaaccttgtgtcagcattagtccctgagttagcataataagcttaacccccctgctaacccatacagaacaggtaccctctgttgaattaaactgtgagattcaaggggtatttgttcctgtgacataacatagactgttccggctaatggaaagatgaaattcaagtccacaacaccaacattaccatccaggagctctgtcatcttaggcaaatgacctaatctctctggaccttattttctgtcaaatggtgctaatgatagcacctaccttccaagattatagaaggaataaatgagtaaatttatgtgcaatgtttagaacagtttctggtgcatagtaaacactcatgttgatgttgatgctgctactacaattctgactccagctttgtattcttcttcttatctcatgcttgcaaaaagtgatctgggaagaacatttttaagtatgggtgttaccagtcaactctcaaaacctgcagttatgaaaaaacccttttacccagggagaaatgtcaccaaattccacatgatagtagctgtactttgtcacttttcatcgagaaaatacataataactaagaccttttaataattctgtaattttttttttgagatggagtcttgctctgttgcccaggctggagtgaagtggcgggatctcggcttactgcaacctccgtctcccggggtcaagagattcttgtgcctcggcctccaaagtagctgggattacaggcatccgccagcatgcccagctaatttttgtatttttagtagagacaagagttttgccatgttggccaggctggtctcaaactcctgacctcaggtgatctgcctgcctcagcctcccaaagtgctgggattacaggcgtgagtgagccaccatgcctggtctaagtcagtaacttcctttttttttttttttttttttttttttgagacggagtctcgctctgtctcccaggctggagtgcagtggcgcgatctcggctcactgcaagctctgcctctcgggttcatgccattctcctacttcaccctcccgagtagctgagactacgggctcttgccaccacgcccggctaattttttatgtttttagtaaagacggggtttcactgtgttagccaggatggtctcgatttcctgaccttgtgatccacctgcctcggcctcccaaagtgctgggattacaggcgtgagccaccgcgcccggcctaagtcagtaacttctttaaaagaatttaggaatttgtatttttttgttgttcaagatttacatacactgtaaaaaaaaaaaatctctgcaagtgtgtgtggctgtgccagaggatggctgagctctttgcaataccttagaagagccctaggggtcctcagagctcaagctgagacacacttacctggcctcgagggactgcttgtagttaggctctccgttgctgatcgcgccccctggtggaaaggtctggaatacagcattcccaactgaaaggcttcgcgtggtttggtttgaacgtgattcactcaaggatgttagtcaaaaggcttgtactgttcctagagttgaccttgaacttcctaatggtttcctccctcttgtaaatatctctgcccctttaaagctcttgctattcagatgaccaccccactcatcttgattgttgtcatcctccgacctcccagtcaatgtaatcttttccctgccccttccgatgcctgctggcaccatccttgaacttcatccttgggtgagttcaacatccatgttcgtgacctattcagtatcctgatctcttaatccttttaccttctcacgtccaacaactttctcctcaattaaaccaacacttctgagctcacactgtcaacactttaatcacccaaaaagtacttcatctttgaaatatgaaaatgtaataccccactgtccattcaccaacacctagcctttcagttccttgtgctaataccctatttgctgtaattcttcaacctcactgagaccactaatctgctaataccaccaatttgtctttatccattcttcatttctttcttggtccaatttagagcccatgattcatcattataatcattcccttgcccacctcaactttcaacatactttcctggaaaaaccacgacctgactgagcactatagtctgaagtaaggtaccatgcctgtacctgagcagctgagtgttgccagagaaaaatcatacaaaccttctaaatgacttcattttaaattcatgatctcaaacttcaaaaggatattcaacactactcagcaatcctactctttcatatgcgataagcatgaatttgcaactacaatggtcacttgccagaaatgcctcatttttttctttctataaatcagatttaatctagtctgagtacctttctgctgagatgacaagaaattcaatgttggcttttatgagcctccgtgactacttcccaggataatatgaaattcctggtgttttacacagcctaggacattcctttttatttgctttttagttcaccatggtgactgctggtaggaacattgagcagatccacgtgattccttgaaggtgaatggctcagtgcttcccaccacttcccccagcagcctcaccccacaccacattccctttcagttctttgtgatggttctgcttcatctcaccttgggggcctttgcatattttgttctctttgccccaaatactgaacaacccatcttttttacctggtctacttctcatcctttagatctcagcttcaactcatctctcctaatatgaaattttaaaccacagtgaagtgccatttcacatgcacatatttaattcaataatttttaaatgctgggcacagtggctcatggctgtaatctcggcactttgggagaccaaggtgggtggatcaattgaggtcaggagttcaagaccagcctggccaacatggcgaaaccccgtctctacttaaaatacaaaaattagcagggcatggtggcgcacatctgtaatcccagctactcagaaggctgagacaggagacttacttgaacccaggaggcggaggttgcagtgagccaagatcacaccactgcactctagcttgggcggcaggatgacattctgtctcaaaataataatagcaataataatttttttaaacctgaaaataccaaatattgatagggatgtggagcaacaggaactctcatacattgctagtatgcagataaaaatggcaaaattactttgaagaactgctgacagttttccatcaagttaaatacatatctaatctatgaccaccaattctactcccgaatctcagtgcccaagagaagtgaaatatatgtctacaaaatgaattgtacaagaatgttcatagcagctttattcataatagccaaaacaggaaacaacccaaatactcatcaacagatgaatggataaacaaactgtggactagtcatatgatagaatactactcaggaaaaataaataagtaaataaattattgacacacaacaacacggatgaatctcagaagaatgatactgagtgaaagtgagacaaaaaaaatgtatgtatatatatagcatagttctacaaagttatagaataggcaaaactaatttacattgacacaaatcagatcagtttcagtggtttcctgggacagggagggtattgactgaaagggacacaggggatgttctgggtgataaaaattttctgtatcttgatctgggtgatagttacgttagtgtatacatttgtcaaaacttatcgaagctacacctcaatttaaaaatgaaaacaaaaacatctccttatcaaagcctttcctgggctccacaactcagttaaacctcattctttctttctttttttttttttccagacagagtctcgctctgttgcccaggctggagttcagtggcatgatctcagctcattgcaacctctgcctccgggttcaagtgattctcttgcctcagccttccgaatagctgggattacaggcatgcaccaccacacctggttaatttttgtatttttagtagagacggggcttcaccatgttggccaggctggtcttgaactcctgacctcaggtgatccacccacctcagtctcccaaagtgctggaattacaggcacgagccaccatgcctggcctaaatctcattcttaaacacactgattgttccatgcatatcttcatggctcttatcacagctgggattttacatttatttgtgtggttattcaacttgcatctgaatccttctctagacctccaggaggagggaaccatgaccaatggtatcagtattatttaccactgtatctctgttgcaggctgaaagaatgagggtcatgatcaactcagtataccactggaggctctgtgagtaaacagcaaactgttttcatgaaagcaggatgttggcaaactgacaaactgcgtctgccgcccagaaggaatgctgagggcagtcacgccccaagcagtgtttcttgtggttaggcacatctgaagcctgttagcagtaatgtgaacctgtgatcaattaagcagctgaccaatcgttacctcctcctccctgctctttctacccaataaatacgaagggctgtagaagctcagggctgcctttgctcactagaagcagggagccttcttcttccccggaccccttctttaaaacggtttcttttgttttaagttttcatttctgtattcatcctccttcgttcagtcctgtggtaaccatagtaaccatggcaaactgcagcatatctccagtacctactacagtgcctggcagtgggcatttagtgaatatctcctgaatgaatagacaaagcatacagctagactcagaatctcagactcttgcctctcaatccagtgctcctttcagtctgtcactatgatgttggagtccagttctgcctcaaggcccgactctaattccacttattctggaaaaccatctctgttcaccattcattcagtcctcattaatttcacaaatgttgggtgcatagtctgtgcaagggtatggtatacaatgatgacagggaacatagacattgaacaacaatgataccattgcttacttaatgataattttggtccatgataagagtagacatattggatgctaagggaatatgttacagggaaacctaactatgtctgaggtgggaggagtggtcaagaaaggctcctggaggaagggacagcaaagctgtgctctgaaggatgcttaagagttagccaggctgtcaggcgcagtagctcacgcctgtaatcccagtactttgagaggccaaggtgggcagatcacctgaggtcaggagtttgagaccagtctagccaacttggtgaaaccccttctctactaaaaatacaaaaattagctgcacatggtggcacacacctgtaatcccagctacttgggagatcgaggcatgagaatcacttgaacccaggaggtggaggttgcagtgagctgagatcacactactgcactccagcttaagtgacagagcatgactccatctcaaaaaaaaaagttagtcaggctaaaaaataataaacaacaaaaaattatatctagaggcaaaaataaactaaaaaataaaaaacaaatgaacaaaaaagaattagcctggcacagataaggtaggcctaggtaggggaggtctgttccaggcaggtttaaagggttggaagcaggaaggagattgtcaaggtctgcggaggatcccagtgtgcctagagctcaaacagcaaggagaagcggggcaaaaggagctgaggctgaaggaggggcattggggccatatcaggcaatgccttgaggaccatattaagggtttaagatgttgatcatctatgaggtaacctgtagctttctttaacaaaatctagtccagaacctctttatttgtcaataaaagaaatctatctgtaaataccgtaatatattaaagcagaatgagtcgttaagctgtgctacctataagcctgatcacatgttactctccatcatcatttccttctattagtaacgttttacttagctgttcctccaggctcagctgtgctgcacagaattaagggaagggccatttgtcctttgggtcagaacataaatggccaggaagcctcccctaaggtcatggtgtggtggctgttgtctccaagtagaaagtgaatgcagcacagagaacaatgcaatgaattgtgagggaggaccagttctccctccacacaaggagactctctagcaattgccaaggctgcatgtccagccctcaatgcttccttctgcctcccaatacctataaagctcctccctataccattgaaaaatgttaccaagccttgcatgacgggctaattttgcacctctccacatccagtctccccatctagaacacgagttcattataacaacgtcttacatgctacagcttttcacagtttacaaagcatttcccacaataggaaaaataaagcattcattatcccattatttcacttggttatcacaacgaccaatcatgttcatttcataaacaagataactaggcttcagaatggagaatgccttgttcaaggtccccagctggcaggtaatagagccagaatttgaacccaagtcctttggacctcaaaggaaatatgctgagggtggctgagtcactttcttggggaagatgatctcttgcaatgaccctcctcagacaccatgagtcttatctgaagataaagcactctctttgggcaagttctccattcaagatctgctaaggctggtataatgttgtttcacctcctggccccagaagtttgaggtgctcataatttcttcagggagcatcttgggtaccagctctactatgatggccaatgctcaaatggggcagggcaactaaacagctgaggtaggctctctccactgttggggttggggttttagtggctaatacaaggcattcttttaatcccttctcaaacttggaaacaactgagagacggacacaggagtcaggcatatggaggtcaaaatggtggagaacatggcttagtctgctggccaagtgagcttgctaacactttgcccctgaatttggcagacttattcagagatgttggtagtgcaggaaaaccacaagtctcccatggccactggaaaacttagggcagcatggagaagcagaaccactcatctgctctctgtaggacgccggtcccaggcttgctcaagtccttccgcctcagttgtccaccagaaaactcattcctgaagccaggaggggaagcaagtaaaaggaggccacacatgtcacaataatgaagtgattctctgccccagctacacattagaatcaactagggagcttgaaaaaaacaccagtgccaaaatagatatacacaacaatgtccaggttccagccccagcgatttaaatgcaattgatctggggatggggcccagcttgcatagcagagtaatgcactttaatgtgctgtaatgcactgcttctcgaatgttgatgcacattggattacctggggaaccttaaaaaatcccaaccctagaccacaccaattaaatcagaatccctggaggggagacccaggcatcagtatatttttaagactccccaggtgattccaatatgcagccaaaattgagaacaggtgctcaaatgtggttgtgttgttgttgttatcgtttcaaatttgagtgttcagcagaatcacaagaaatgtttgttaaaagatggacttctgggcctcacccccagagtttctgactcagtaggtttgggttgggggcctgagaatctccatttctaacaagctcccaggtggtgtggatactactggtttggagaccacactttgagacctgctccttcacagggtgtgcagagaagcgtttccttcatcagctgagaaagccatggtaagacctgatgtgataactttcatccctgcaggtccacagaaaaatatgccaaagtcagtagcattggcctacatgatgttttaaagagggttcatagattctgactttaaaaaagagctgcctcatcgtggctagtgtcagaatgcccaagatgctctttattttggtgctctccttctcacagttgggaaactcatttctggtttttaccaggttaatggttggttatagttgaaacagagatgccttctgagtattgacattttctcttgagaagtgctcccatctacgtagctctaattggaccactccattcttacaagtccctgtttccctgtttcgttcaggggtggtcaccagactcaagccaggccatccagaagccctggaaaatttttgggttaaaactgaggaaagagagtcagtttctctcttctccgtgttataagctatgagatgtgagacttggggtgaaactaggtttcctctctactgtgagctcctcaaggacagagtgttatttactgccatatttctcagtgtttagcatagttagtggcacaaagcagggcatcaaataaatattatacacagttttgatgaggtataagtgacatacaatgaacggtgcatatttaaagtattcaatttgatatgttttgacatatttatacactctaataaacagattttcagattgaattaaaaaaataatacccgactatatgctgtctctgagatagccatttcaaatatgaagccacaaatagatttaaagtaggagaattgaaaaagtatcccatgcagacattaattaaagagaagccagaatgactgtattcatatcaaagtggatttcagaagaagaaatattatcagggaatcatagtgatattacataatgataatggggtcaattcaccaggagcacataacaatccgaaatggtgtgtacaacagtgctttattatgcatgaagcagaaactgaaatgcaaaatagacaagtcctcaattatagctggctattttaacacctttctttcagtgattgatagaaaaagtagacagaaaatctgtaaggatatgggagacatacaacacaatccatcaactggatctaatagcatcgtctacctaataatagcagaatatgcattctttccaggtgcgcacagagcattcactaagataggctgtgttccagactataaaataagtctcaacaaatttaaatttattgccaggcacggtggggcatgcctgtagtcccagctatgcaggaggatcccttgagctcaggatttgagaccagcttaggcaacatagtgagacccccatctaaaaaaaaataaataaaaagtagtgaaatcatgcaaactatgttgtctaaccacaaaggaatatactactaaaagtcaaaaagaaaaagatatcttgaaaatcctcaaagaattggaaattgaacaacacacttctaaaaagaaaccaaagaataaataataatggaaatttaaaaatattttaatagtccattacattaaagagatgtgaaaataagaaaacatatttagggccaggcgcagtggcttatgcctgtaatcctagcactttgggaggccaaggcaggtagatcacttgctctcaggagtttgagaccagcctgggcaacatggtgaaaccccgtttctacaaaaaatacaaaaattagctgggcgtggtggcttgtgcctgtactcccagctactttagggagctgaggcagaagattcccttgagcccagaaggcagaggttccagtgaatggagatggcgtcactgcactccagcctgggtcacagagtgagaccctgtctcaaaaaaaaaaaaaaaaaaagaagaaggaggaggaggaaacatatttagtatacttatattcacatttatcttttctcttttctttcttttttttttttttttttgagatggagtctcagtctgtggcccaggctggagtgcagtggcccagctcggctcactacaacctccacctcccgatttcaagcaattctcctgcctcagcctcccaagtagctgggattataggcacatgccaccatgcccagctattttttgtatttttagtagagatgttgttttgccatgttggccaggctggtctcgaactcctgaactcaggtgatccacctgcctcggcctcccaaagtgctgggattacaggcatgagccactgtgcccagccacatttatcatttctatactcttcattcttatgtgtggatgcaaatttccatctggtatcattttccttctgcctgatgaactctctaaacttttgcctgagaaagtctttatttcaccttctcttttgaaacatattttggctaggcacagcggctcactcctgtaaacccagcattttgggaggccaagacaggaggcccaggagcttaagaccagcctgggcaacatggtgacatctcatcttaaaaaaatagaaaaaggagagaaagaaaggaaggaaggaaggaagggtattttttttttgtcaggtatagaattccaagttaacagattcttttttcaattctttaaagatgtcattccattattttttgcttggcataatttcggtgaaaattctactataatccttgcctttgttccattgaacataatacgtcgttttttttctggccgctattcaattattttatttatcactggtttttcagcaatttgattataatgtgccttgatgtttattgttttctttatatttgttccatttggagttcattgagcttcttggatctataggtttatagctttcctcgaatttggaaaatcttatgccattatttcttctcataagtttctattcttctacccttctgcaactctagttacacttattttattttattttattttattttattttattttattttattttatttttgagatggagtctcgctctgtcgcccaggctggagtgcaatggtgtgatcttggcttactctccacctcccgggttcaagtgattctcctgtctcagcctacctagtagctgggattacaggctcccgccaccatgcccagaaaatttttgtatttttagtagagacagagtttcaccatgttagccaggctggtcttgaactcctgacctcaggtgatccaccttccttggcctcccaaagtgctgggattacaggcgcgagccaccgcgcacagcctgtcacgtgtattttagatcacttgttatcatcccatagaatcactaggcttgtgttttgtttttgttttgtttttgagacagagtctcactcttgcccaggctagagtgcagtggatcacagttcactgcagccttaactttctgggctcaaaggatccttccatctcagcctcccaagtagctgggaccatacgcttacgccaccacacccacctaatttttgtattttttatagagatggagtttggccatgttgccaggctggtctcaaactcctgagctcaggtgatccacctgcctcggcctcccgaagtgctgggattacaggcatgagccactgtgcccggccacatttatcatggaggagggggagggggaggggggaaagggaggagaaggatctgcccacttcagcctcccaaagtgctgggattacaggcgttcactttttttcattctcgtttttctctgttttcttcattttgggtaaatattgctatgtcttcacattcactgacctcttttttctagtgtttaacctgctctcaatccaaacttgtatagatttcatttcagataattgtgtttttcattctagaaattccatttgggtcttttaatatattttctttgtctcctcgttatttttatgttttccttttcatcttaagcatatttgtaagatttaaaaatagctttaaaatccttgtctgctaattctatcatctttgtcattgcaggtttttggcttttttttttttttttttaagagacaaaatctctgtctcactctgtcacccaggctggcgtacagggtgacacaatcatagctcactgcagtatccaattcatgggctcaagagatcctactgcttctgcttcctaagtagctgggactacaagcatgctctaccacaccctgctaaataaaaaaaaatttttttttggacaggtggggtctcatgatgttgcccaaactggttttgaattcctggcctcaagcaataatcccgcctcagcctcccaaagcgctgagattacaggcatgagtcaccgtgcccagcccatttctagtattttctaatgatgcatttttctcttcactataggtcatcttcctgctgatttgtatgcctggtagtttttcactggatgctctacatggtaaattttaccttgctgattgctaccctttgttgcttttctttaaggagtattgggctttgtttggcatgcagttaaactattgcatatcagtttgatctttttgaggcttgtttttctgcagttacggaatcagaacagccatttttctaggtgtatttatgtcttctgtcaaggccttctgcttctgagaatgccctctattttacaaagtctctttactctggctcatgggaacaaaaacgagttctagctgtgtgtgagctccaggaattatttgaacaactgttttccagtggtttttaccccaccctcctggagtttcaccccaggcatgtacagatcatcactcagccaaagactagtttagaggatccttttgcagatctctagagctttctggtgtgcagcttcctccttccctgtaggctgccccacaggttccacctcagcctccccaaattccagtctctgtcttctaaactcaacaaggctggtggttctggatgggtccctctccctgcgctagagccagaaaactgcctgaaggcagcaattgcagaactcccaatacctgtgccccttcactcagggattgcagtcctgtgctgcccacgttgttttatatattttgcttggtttactagttgtttataatgggattgcaatttttgtagcacttaatccttcataggaagaagtacaagttagagttaactacttttaactgtttctcttttagttcttctactagttgctttcataaggttaaataatattctgaagccaacatttttttaatctttcaacttcctgctatgaatgatgaagattcagcctaccctccactttctccatccctcttcccagtttgaatagttacgtgatgtttttgttgttgttcttcatttactgtgttcaagtattcagtagtatacttgacaatgtatttctcacgccgtcatcttttttttttttttttgagatggagtctcactctgtcgcccaggctggagtgcagtggtgctatctcggctcactgcaagctccgcctcccgggttcatgccattctcccacctcagcctcccaagtagctgggaatacaggtgcctgccaccaggcccagctaatttttttgtgttttttagtagagatggggtttcatcatgttagccaggatggtcttgatctcctgacctcgtgattcgcccacctccacctcccaaagtgctgggattacaggcatgagccactgcacccagtcactccatcatcttttgataatatctttggatcttcaattactgtgtaagatgaggttattggctgggcaaggtgtcacgcctgtaatcccagcagtttcggaggcccaggcaggtggatcacctgaggtcaggagtttgagaccagcctggccaacatggtgaaactccgtctctacaaaaaatacaaaaattagctgggcttgggggcgcacgcctgttatcccagctacttgggaggctgaggcacgagaatcacttgaacccgggaggcagagattgcagtaagcccagatggcagtgagccaagatcacgccactgctctccagcctgggtgacaaagcaagactgtcacaaaaaaaaggttttttgaaaaaaaagatcttgaacccgggtggcagaggttgcagtgagccgagatcgcaccactgcattccagcctgggcaacagagcgagactccgtctcaaaaaaaaaaaaaaaaaaaatgaggctaacaccctacccttcccttcatttctatttcctgacttccaactccctgcttatttaataacctataccctttattcccacattgctgtagttcctaccatttatattttgctgtgtaaacatatttaaatcttctgtgctttgcctagggattacttccaaaagttgaaaactaatagaaaataatgtatattattgtcattaagaaaatatttactggccaggtgcggtggctcatgcctgtaatcccagcactttgggaggctgaggtgggtagatcaccaggtcaggagattgagaccatcctggctaacacagtgaaaccccgtctctaccaaaaatacaaaaaattagccaggcatggtggcatgtgcctgtaatcccagctacttgggaggctgaggcaggagaatggcttgaacttgggaggcggaggttgcagtgagccgagaccacgccactgcactccagcctggacaacagagcgagactccacctcaaaaaaaaaaaaaaagaaaagaaaagaaaaaaatatttactgcagagccaagctgtgtgatcaacttacaattccttctttatgaggtcaataatacaaacccgtaatacttgaatgagtcgaggtccaatggattctattttgcttcatatttggaccatgactttgttgtacacattctttcctaaaatttctaattaccttcctcttgtcgagaaaactaatgtaagactaagccactaagctcttccagcttcttatctaccatttttgctgagaatcaattctactcttcttcctgaagacattcttgttggattctactgatctgtttttctttttctttttctttttccttttttttgagatgaagtcttgttctttctcccaggctggagttcagtggcacaatctcggctcactgcaacctctgcctcccaggttcatgtgattctcgtgcctcagcctccacagtagctgggactacaaacatgcctgccaccacactcggctaatttttgtttcaccatgttggtcaggctggtctcaaactcctgacctctggtgatctacctgccttggcctcccaaagtgctgggattactggcatgagccactgcacctggccaactgatctgtttttctgatatgaaatgattggcttctagatctgttacagtatggtcttagtgaaactcttttccccagatgagcactacaggaagtattgtaatgaacactggtagattccccaactcacatcccactcagaggattagtctagattaacaataataatcccattcattttgctagcgattggttcagaattgtgactcaattctggctaatgagacacaagaataaattagcaaggggacttctgggaaagattttcgtccctaagacgggaaaaaacagaaaacacagtcctttttctttgtctggacattgtcatatctaattagatatgacacctggaattgtggcagccatcttgctgtcagcttgaagctgaagccaacactaaggtggcagaacagagatatggaaacaacctgagcttcagatgatatcatggagctaatgactcaactaattctggaagccctgcatctggactttctgtttccttattgcttaagccagtttcctgtctcttagaaccaaatattttgtatgtaaaaaattctgttagtttcttgcacaatactttttctcctcttctttattactaggagaacctcattttttcccacagagaggcattatacaaaagaaaagaaagaaagaaggcaagaaggcaagaaggaaggcaagaaggaaagaaggaagggagggagagaaagaggctttgcccttcagattccttttttcagctagagatgactctaagacccatctaattctagcgaatgagatacagatacaaatttctgagtagggcctcaggaaaacctttttaatgggaataaatttggtcttcatacttcctccttccttctcactgagaatggagatttgatgcttggaattactgcagccatcttgtgatagggagggtgaagaccaaatgctagggatggcagaaatggaaaaagaagatgtcaggaaaacttaggacatccctgagctgctaagccagtcataaaatgcctgtgaccagacattctgtgatgtgggaaaaataaaaccttatttctttaagctgccattaattgcaatatagataatacatcaagaatccaaccgcttcctcttccttggttttcaccttcattttgcttgatgatatcctcaagattctctctcttaaaaagtatgtgagatagatgctttcttagcctttgtctgtctgaaaattccttattttgttctcatacttgattgatagtttggatgtattatacagtgctagcttaaaaacaattttctctcacaagtcttaagacattgctccattttcttctggcatttaatgttaccgatgagaagtccactattaatttgattttgcaccaatgcaagtagtttaaaaaattttgggggggagcttttaaaaaattttatttttggtgttctgaaatttcacaatgatatgtcaaggtatgggtctttttcactcattatgtgcaatacttgctgggctctttcaatctgaaaactattatgtctttattacttgagataaattatgaccttctgtgctcttttattctctttctgaatgtttgactttctgtattgattgtctcttatattttctatcatatttcccatctcttttgctttttcctctatgttctaagagatctcctttatctgccaattcttccattacatttctaatttcagccattacaattaaaattttaagaacagtttcttggttgggtgtggtggctcatgcctataatcccagcactttggaaggccaaggcagaaggattgcctgagtccaggagtttgagaccagcccatgcaacaaagtgagaccttgtcttcttagtaaataacaacaacgacaaaattaataataacaaggaacagtttcttattctatgattgttcctttaccatagcaatctatacttgtttatggatatgttatattttaaaagtctctctggaaatatagtttgtaacggttttctgttgtctgcattctttattccttttgagccagttttttaaaaaatatatttttatcatgatctgtttcttttatttgtatgtgcaatgatatacatttgcttttttatatttaagaaagagaggccgggcgcggtggctcacgcctgtaatcccagcactttgggaggccgaggcgggcagatcacgaggtcaggagatcaagaccatcctggctaacacagtgaaaccccgtctctactaaaaatacaaaaaattagcctggtgaggtggcgggtgcctgtagtcccagctactcgggaggctgaggcaggagaatggcgtgaaccccggggggcggagcctgcagtgagccgagatcgcgcccctgcactccagcctgggcgacagcgagactccatctcaaaaaaaaaaaaaaaaaagagaaaccgtgttgatttttctgggtaccagttttgagtttcctgggtactgcatgaagctaggtctgttttcccatttagtatctcctggaaggaaaaagttggccaggcataataatgaagtttgttcatgaagtttgttccgggcataagatgaagtttgttactatagtgagactgggctaggagttgacttttagcactgggggaagggtattctctatggttagtcccatctagctgagctctacatgactagagatagcaaagggcgtggtctaaggagggcaccttgggaagttgttatggaaagacttccacttaatctctgctctcataacttttctttcctcaccagccagctcttgggctctgctgggtgtacctgcccctcagcttccttcacttactctgcacagtgggcccacttctacttctcatccatcagcggcttctctccacttactattttctgcaaatctcagaacgtctctttttggtgatggtctactctcattctctgctctaatcagatcattttcttctgcttttttttttttttttttttttttgagaagaagtcttgctgtgtcgcccaggctggagtgcaatggcatgatcttggctcactgcaacctccacctcccgggttcaagccattctcccacctcggcctcccaactacaggcgtgcaccgccacgcctggctaattttttatatttttagtagagacggggtttcaccatgttggccaagctggtcttgaactcctgacctcaagtgatccgcccaccttggcctcccaaagtgctgggattacaggcgtgagacaccacgcctgttctcattttcttttactggcattctaattgagtttcaggagggagagaaggcaaatgtttgtgcttggtccatcatctttgctaaaattttatttttaatttttcatccatcttcataaatgagattgttatatagcttttcttttcctttatgtcatgtttctttggttttgggttcagggttacaggaactttaaagaatggttggttcacattccatgtatttctatgccctgggatagtttaaattcatccacatattgatccagtaacttactgcattacagtcacctgggaatatattttaaagtacatatttcacttgtcttcgtataatcacaggaaaaatatggaaggatgtatataagttgttacatttatacacaaactaataaaatttgtttcagcaggagtaagatcagggagaaaatggggagacaatttttcttttgtatattgttggatgttttttacaaccactaaatgtaacttctgaaatgaaaaaaaaaaatctttatgaaaaatatagattcccaggccaaattttggagacttaagtttgttgagtctgggaagccaggaaatctatatatgtttttaaaaatgtacctaggtaattgtgatatgcaatcaagtttagaaacccctagtatagatattataggaattagttttttcttgaaattgtgaagtacttacctatagaaccccacagccctgaggcttggtgggggagggcagggcaggtggacggaatgtcgttctttgactcctttttacaatttgtcttgtagagatcaaaatatgccactccaaaacatgccactttggcatacaattatttcagattcaacagatgcagaaagaagccatctcagagcttcccttatctcatgagaagcagaaacttctgagaaatgaggactgctgtaaatctcctcttctagggaagttttatggccacagagaagatgaagttggcgccaagatggatctgcacaaacaaaccttactccattaatttccctcatatatttactttcccatggtttactgcctttgggagcctaagattttttttttttcctttgacttgtcacttctctacgaatttattgttctttgttaagatgcataaacccacattctaaccacctctttgagtttttcatcatatcactgagtttctcctgggtacacgcccactgtacatgctaataaactatttgtttttcccttgttaatctgttttttctcagttaattttcagagccccagccagagaacctatgtgggtagaggaaaaagctcccaccctcttaccgtcaattttggtattttatgcatctcctgggaaatcatccattctattaaatttattagtgaaaaattagatctactaattttttattagctgtacacttaccctttttatctttattttgaactcctttcttattcttagtatttgtgattactctgtttttcaaaaaaaaagttttattgtggtaaagtatatatatataacaaaatttaccattttatccatttttaggtgtgcagtttagtgccatttgttcactcataatgttgtacaaccatcaccactatccatcttagaactttttcatcgtcctgaacagaaattctgaacccattgaatagtaactgtccattccttccttccctagccactgctaacctctgttctactttctattcctataaatttgcctattcttggcacttcctataagtggaatcttaaaataattatccttttgtgtctgacttatttcactcaacataatattttcaagatttatccatgttgtatctgactttcattcttgttaaaggttgagtaatatcccataaagtgtgtatatatcacattttgtttatccatgcatctgttgatgtccgtttgagttgtttccaccttttggctattgtgaatcatgctgctatggacattggtgcacaaggatctatttgagtccttacattcaattattttgggtacatacctagcaatggaattgctggatatggtaattttacattaaaatttttgagcaactgccaattgttttccacagaagtgacatcatcttatattaccgcccacaagatacaagggttccaatttcttcacatccccaccaacacttattttcttattttttttttaaataatggctatcctaaccggtatgaagtgatatctcattgtgtttttgatttgcatttccctaatagccagtgatgttgaacatctgtcatgtgcatattggccatttgtttatcttctttggagaaatttctattcaagtcctttgcctatttatttatttatttatttttctgagacagagtctccctctgtggcccaggttggagtgcagtgcgcaatctcagctcactgcaacctctgcttcccgggtccaagcaactctcctgttccagcctcccgactagctggaaccataggcaccaccaccaccaccacgcccggctaatttttgtattattagtagggatggggtttcacgatgtttgccagactggtctcaaactcctgacctcaagtgatccactcacctcagcctcccaaagggctgggattacagacgtgagccaccgtgcccggccgtcctttgcccccactcccctttttttttttttttttttaagacggagtctcgctctgtcgcccaggctggagtgcagtggcgcgatctcggctcactgcaagctccgcctcccaggttcacgccattctcctacctcagcctcccgagtaactgagactacaggcgcacactggcacgcccgggtaattttttgtatttttagtagagacggggtttcaccgtgttagccaggatggtctcgatatcctgacctcgtgatccgcccgcctgggcctcccaaagtgctgggattacaggcttgagccaacacgcccggcctgcccatttttttaaaattgagttgtttgtttttttgttattgagttgtaagagcttctctatttttttttcctttggagacagagtctcgctctgtcacccaagttggagcgattctcctgcctcagcctccccagtagctgggactgcaggcacgtgccccatgcccggctaatttttgtattttcagtagcttcggggtttcgtcatgttggccaggctggtctcaaactcccaacctccagtgatctgcctgcctcggcctcccaaagtgctggtattacaggtgtgagccattgcacctggccgagtttctctattttttattatttatttatttatttattttgagatggagtctcactgttgtcatccaggctgcagtgcaatggtgcaatctcgcctcattgcaacctctgcctccgggttcaagcgattctcctgcctccgcctcctgagtagctgggattacaggcttgcgccaccacacctggctaatctttgtatttttgtagagatgggtttcaccatgttggccagactggtcttgaactcctgacctcaggtgatctgctcacctcggcctccaaagtgctaggattacaggcatgagccaccatccccggactatttttgaatgacctgtttattattctgtgtctcctggatttctatgaagcatccattggctcttctacacttgtgctgttcagtacagtagccacaagccacaggtgactattaagatttaaactttagttaattaaaattaagtaaattaaaattttagttccttggtgacattagccacatttcagatcatcagtagacacacgtgacaagtggctgccatattggacagcacagaatgaacagtcctgtcatcacagaaagttctattggacagcactgttctagctctaccttccacagctcttattttttctccagtattctgcatctctatttttatggtcttcattctgagagatgtccttgactttattcagacctttaattggcatttaatcatggccattgcattattggcttctaatatttaattttgaattttatttggcaattagctttataaatgccaacgtttcttttgtttttctattgctaccttttcacagcagcatattcttattttattttttatttttattttttcattttttttttgtttatttgtttttttgagacagagtcttgctctgtcacccaggctggagtgcagtgacgtgatctcagctaactgcaacctctgcctcctgggttcaagcgattctcctgtctcagcctcctaagtagctgggattacaggcgcacgccaccacacccggttaatttttgtatttttagtagagacggggttttgccatgttggccaagctggtctcaaactcctgacctcaggtgatccgcccgccttggcctcccaaagtggtgggattacaggcatgaaccatcactcctggccagcatattcttattttgtaggtgaagtttgctcttgattatccccaaggacactaattcactttaaaaactatttttaaggtcttctgttttctgaattaactctgtttcctccataattaaacatcctgtttgttcatcttggattttctcttccatactgttggtttcctaaaatgtctattgattcttaattgtccatttatattttataaatacaaatctaggctgattcataacttacattcattctcttaacaattgaaactccatttccacagctgacatttctccttaattataagattgatgggaggctctcagtgtgccaaggtcagtaacagtcagatcagctcccacaattgctataaaaggaaggttttattttagaggtgagtgctttatttcaatcatgggtgaagctgcctttctatttttccctttcttccacttacattttgaatttacagaattatctgggtcctgatctgattctctcatctcaagacctaagagtcccccaggcagattctccaagtaatcagagagtggtaatcatggctttatcctgcagtgaaacattgcagccaactgctttatatagaatgatgactggctcagttgctccagggcagacctttaatttgtgactccaagttccacttctgctccttgcctttgctgactcctggaaactctttgaggaaaaaacatctctaacttatatttcaaatctctgctacatctatttcggatgtgaatttctctgctgtgatttctccaccaattaaataccaccttcattaattaatctttgcttttatggacctctagtgcattagattgaattaatcttcatagcaatcaattatcatcaatctataatgttcctctctgattattattactaatactattactttatttattttggtcttcatgcatgacaaaggcagtctcttttcaccaaaatgttagtcagactcccctgagtcttctgcttacctggcccgtccttgggcttttctctctgtcattgaagaatccagtttgagctagaatcctcaagtcagtttaatgaaaattcaccatccctgatatctgaccaccctggcctatcttcagcaagaattctgttgagtagccctgatgtttctgcttagtaattttcaattccctgatcctccaccctgctccttggttataaattcctgcgtgtccttgttggagttggggttgggtccagtctctctcccctactgcaagacctcattgcggtggtccctatacctatcaccatggcatccttgacaagtgtcatggatcatctcttctttaacatgcaccatcgcaactcctgctcctcttcttaggatgaatgtatttttgcctcatgtatgtttgtatttttaactagtataaatggtactaaaagccttgttttcttttttagtcaacattgtgttttaaatatacatccgtgacatcttataaatttctaattaatgctttaaaatgtacaatcctactgtgtgtgcagaaggaaaaaggcctggagatatttggggaacagcactaataacaaccattgtttgtcctcctggtcaacaaatattcagtttgctttatttcccctcagaaaaaatacactccttctgtatctaagggagttgtctgaaacatcacatggagtcctccccacctcctctcctcgggatgcacatggttcttgctttggccctgatttcctgccctgggagtagctactttgtcctttgttcttcttcttgttcctctggctctaccttctggaagattctttcttctccattatctgaagaaaccatcagcccatttcctgcccactggtggttgggtgccctagcccctttaagactcaaatttaaactttttttcactcataatttctttggcaacactcctaaaatttagtagccttcttatttatttgattccagtcagttccatatggcagagctcatctatagttattttctagatatatttcctgaatttgctacatttcttgtttcttcctttccccaacccttccccttcacttaattgcaggtaaggtgttaagcttatcaggctttgggggaaaagccacacatttagtctcttttcccagaaccattttgtcaaattaaaaggaattattgaatatctcacccttagttgacattcactttgagacatcttcatccattcaaaggtttttatcactggatgaaacagccataaatttgatccttgttgaaagcctgaaattttaattggtctttgtccttcaaagtcctgctcatttttccttttacttgttagggttgagaagcagttattcacaacttccaactttgcaagactccagttttctagttcttctcaatttcctttcattgctacttggaaacttgccaattattttctgagcttatctcaaatacagtcaataaaaacttatgctctctcctgtcttccttttcagagctaccttccaagtttttgcagatctaccttccaatattttgccactgcataacatgaatcactggccaggcacagtggctcatgcctgtaatcccagcaatttgggaggctgaggcaggcagatcacctgaggtcaggagtttgagaccagcctggccaacatggtgaaagcctgtctctacttaaaaatatatatacacaaaaattagccaggtgtggtggcacacgcctgtaatcccagctactcgggaggctgaggcaggagaattgcacttgaacctgggaggcggaggttgcagtgagctgagatcgtgccactgcactccagcctgggagacagagcaagatgccataaaaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaaagaaggaaggaaggaaagaaagaaaaagaaagaaaggaagaaagaaagaatgacaaaaacatgaatcgccatcctttcaacagttgctaacagtttccttgcaacctgatggccagctcctaagccttcaaagccatatttttgattatattacggcaggtaggactccacttctgtatcaaccaggatagatggattatgctgtggtgacaaacaaccttaaacaaccataaaatcataatggcctaacaccccaaagagtatttcttggtcattgcaagtcagcagtggtctcctttcatagccactcaggggcccaggccaatggagtggccaccatctctaacattgcttgtcatcacaccaaagggaaagaaaatgtggtaaacagcacattggcttttaaagcttctacttagaagtgatacttgtcacttaaattttatggacaaagcaagtcctatggccacacctaacttcaaggaggcaggcaagtggaaatatggccgctaatcatagccatgtatccaggaggagaagaagaaatatttgtggaatggtactatctcacataatttgcctattttttattgttgtttctgtcttttgttgttgattgttagagttccttgtaggatctagaaaatgttatgtactccctcatcagggagtacatttgttttgttttgttttgttttgttttattttgagacagagttttactcctgtcgcccaggctggagtgcaatggtgcgatcttggctcactgcaacctccgcctccaaggttcaagtgattctcctgcctcagcctcccaagtaactgcgattacaggcatgtgccaccatgcccagctgcattttttgtatttttagtagagacggggtttcactatgttggccatgctggtctcgaactcttgaccttgtgatccgtccaccttggcctcccaaagtgttgagattacagatgtgagccactgcgcccagcccctcatcagttttaaacattgaaaatatcttctctccatccttcatctgttaattttgtccatagcatccttccttcactgtgtagaaatcctttatgttggtgtagatccattcaccaatttttccagatgaaagtttttgcttttggggtcttattttaaaaatcctttccccatcccaaagccacaatatgtaattatatactttctcctattaactatgtattttactttccatatctaaattttaatacagctagagttcacctttttcttaaggtgtgaagtagggatcttttcttttaatccataaaaggagcgaatattcttaataccatcaactataaaattaataatttctccactgatttatggttccatttttatatttcaaatttatgaaatctgtttttgtcccactagtctatatgtttgttccaattctttctagtatagtactatatttttgtagaatattgaaacaggatattttcatgaccccttcccaggccttgcgaaaggggtgtttcacttactcagcccgcagtgctccaccgctcgtaggaaggggagcacatgtgagcaggtgcaggagccagggtgagtgcttttgggtgctgataggagcaaaactccatgtgggccctgtagcagtgactgggggtcgtccctgcaacctctgaagccccagaaggagagttacagtgcccttttagctttgccatctgtggactgcttaagagttaacagctca
